United States Patent 12,797,487 (ANTISENSE OLIGOMERS FOR TREATMENT OF NON-SENSE MEDIATED RNA DECAY BASED CONDITIONS AND DISEASES) - sequence listing, part 4

SEQ ID NO: 90 - DNA, 51438 bp, Homo sapiens
  source 1..51438: mol_type = genomic DNA
gtaagatgtgttattttttcattaccagcctcattttattcatttttctttagaattgggaatattgtagtttttgaatttgctattcttcacttcctttacctgccatttctcttgcctcttgtgtttgcttcctaggattgattggctatattttactttgtatctctactgttctttgattatcggtgtgaatgttttaatgaagttctcaaattaacttccattataatgaaaggcagtgatctttttaactttaaattatggcaacttacatagttgtaaaattatgttccggtcttaggatgggttggcaattcaaacatctaggtccacttttcaaacaggtactttagagtcataggtactagggtgtgtcccactcttgcaaatcagtagctgattcatgtgttacaaaagatgtgtcattaaccatttgtttactctgaaacttcatatagtatattagggcattctaagacctgctggtttacacgtatgactctttcagagtcctcctgctgcaccccagtcctttgtgtgacatttcatactatttttctcagcaggtagcacttacaccaagttttatttcacagggtaaacctcatttggacagtgtggacagatgacctttagatgaaaaagctcccattgatgtggttctccagtctctttggctcctctaatctcttgtacatagatggccaaagaactctccattaggactaagcaaagggcagagcttaagacttaagtaggtggcttctttgattttcttgtgactaaaaatacattaaaaaaaaaattaaataaaaacaaacagaaaagacgtaaggaggggatgggaggaaggacagagaaggataaggagtcttggaaaccctccaccagcttcgcctttcttcagagtaggatactagcttagttaagattgttgggtgctaatctgctctgtggacttccagattgatgcagaggagaaatcagacaatagtgcagtgtgtgtaacctaaatatctggacttgtgggaaatcttaggtcatgtaggctgagttctcatcttcatttatgtttcagctgctattgctggataagagtgcttatattaatatacaggaagccaaagtgacacagtttttccagcattctccctgtagagttggaggggttgcatggggaatgcaaccagaagttctgaacccgttaagaatcagaggacctgtgtaagagtgtttcgacttagcaagtgttgagcaccagtgttggtggcctctgtcctctttaggaagcaggcaaggggattgagatcaatacattggatttcattttatagtttcctaggttttaacgaatgtatttggtacacaaagccctacttttaaagatatttccagtgtttaaggttttacctctaaatctctctgaacctgggttgtaatacagtaacctcagaagttctactagaggtctctggcatggcaggaatagagaaaggaaatcagctccatatcgtgagttaccacctgttactacttaagaatgcagttaggtggttgccttaatattatgttccttaccaatcctttgctcagtgggaaacatcttctaagtgtaaaccaattttggggggtaatgttttcttcctatttttattacttagaaaccttaaaaattacagtgttcgtctggtcagaaaaaaaggtcctttttgcggggaggatagcattgagtttgtgggctggaaaataaaagtggggagagggaactttattctctttttcattggtgaatatccttaaaacatttctaagatgtagtttcagattggagctacttaatttaagtaaaaagaaatgataggttaattaaagtgcatattttggagcccaaatgtttattttatatagatcttatattttgtttccaattatcttattgtagaatgaactctgtcgttctgtcaggcattgcgtaaatgttagactgagtatgtgcttgtttccatgcgtatagaaaatagcgtcacactcactcagtcttcacaaatgaaaatgccagaggaggcaagtaacaaggaagaataactccaagccaaaactcctcaatttaaggcactctcgttaattagaagttctcatggaaattattatttatccctttttctctgtgttaggggtctgtacctttttaaagcctgaatatttctagccacgactaagcaatgtcagtgatgttactagggtctagttgtcagggttagggctaaggagtgggtgagatgggagaggaatagggaaaggaaggagaattgagtgagtcggagaaaagagtgaaatgaagatgaggaggagagaaaagatacagggtctttagtgtgtagcatggagccatcatcagttgtttcaggtagttcttagggctgctggatgccttgtgtgctagactgaactatggtgaaatgaagtaaaaactgttcttgacaagcaaaacgagagaattaaaacataatttaatatgatatagaaagatctgcaaggcagacagttaagtgatgaaagcaagatgcagaacagtatgtatgatttgataccctttgtgttttttggaaaaaaaaaaacaggagaaaaagataatttgcattggtgtatgtatgcaaaaaaaaaaaaaaaagatctttagggctgggcatggtggctcacacgtgtaatcccagcactttgggagtccaaggtgggtggattacctgaggtcaggagtctgagaccagcctggccaatatggtgaaaccccgtctctactgaaaatataaaaactagctggggcatggtggcacacacctgtaatcccagctacttgggaggctgaggcaggagaattgcttgagcccgggagacggagcttgcagtgagctgagatcacgccgctgtcctccagcctggctgaccaagcgagactctgtctcaaacaacagcaacaacacaaacctttagaagaataaataagaaaatggtggcactggttacctgttaggtctaggaattgttcaggtagaggacagagtaggaaggagacttctcattgcattatatctttttacactttctgatgtttgtatcagattttaaaaattaaatagaaaattgaaaattttagctgggcgcagtggctcacgcctgtaatcccagcactttgggaggccgaggcgggcggatcatgaggtcaggagatcgagaccatcctggctaacacggtgaaaccccgtctctactaaaaatacaaaaaaatagctgggcgtggtggcaggcgcctgtagttgcagctacttgggaggctgaggcaggagaatggcgtgaacccgggaggcggagtttacagtgagccgagatcgtgccactgcactccagtctgggcgacagagggagactccgtctcaaaaaaaaaaaaaaattttaaagaacagcatctcaatccttccttttcttctctttctgtgtctggaagtcagagaaatggcaagggttctaactgagagaatagtttttttgtttttgtttttgtttttttgagacggagcctcactctgtcacctaggctagagtgcagtggcgcaatctcggctcactgcaaactgtgcctcctgggttcatgtcattctcctgcctcagcctcccgagtagctgggaccacaggcgcccgccaccacgcccggctaattttttgtatttttagtagagacggagtttcaccgtgttagccaggatggtctcgatctcctgacctcatgatccgcccaactcggcctcccaaagtgctgggattacaggcgtgggccaccgtgcccagccgagagaatagttcttgaacagtggttgaggggatacacacgcaaaagggcccataatctaggacatgtgttctcttgggatcttcaagaattttgaatttatagatgtatatttctagtattgaactgcaaagtcaggcattaaaaaatttaacttggccagacgcgatggctcacgcctgtaatcctagcactttaggaggctgaacaggcagatcgctggagcacacgagtttgagaacagcctgggcaacatggcaaaaccccatctctactaaaaatacaaaagaaaattagccaggcatggtggtgtgcacctgtagttgcagctacttgagaggcctaggtgggaggatggctcgagcctgggaggtggaggttgcagtgaactgtgattgcgcccctgcagtccagcctgggtgatagagccagaccttgtctcttgtctcattaaagaaaaaaaaaaaattaacttgttcttaaagttttagtaaaaacaggttttcattgtatatccccttaagttagcaattagatataatctcagcattcttcttcctttttttttttttatgagacaagagtctcgctttgttgtccaggtgatcttggctcactgcaacctccacttcctgggttcaagtgattctcctgcctcagcctcccaagtagctgggattacaggcacctgtcaccatggccagctaattttttttttatttttagtagagatggggtttcaccagcttggccaggctggtcttaaactcctgacctcaggtgatccacccgcctcggcctcccaaagtgctgggattacaggcatgagccaccgtgcccggcctaatctcagcactcttaaccgtgtgactttgggcgattttcttaatctctctgagattcaggttcctccttcatactggaaataataacacttacttcagaggacttttgtattatatctgtaaaggacatagggcagtgtttggttcagtggactactactgttcttattgtaattactaattttttttttttttgagatggagtcttgctgtgtcgcccaggctggagttcagtggcacgatctcggctcactgcaacctgtgtctcctgagttcaagcaattctcctgcctcagcctctcaagtagctgggattacaggcgcatgccagcatgcccggcttatttttctatttttagtagagacggggtttcactatgttggccaggctggtctcaaactcctggcctcaagtgatccacccgccttggcctcccaaagtgctgggattacaggcgtgagccaccacgccagctcttattgtaattactgttaataatagctcctcatacactagtggtgagagagagggctctggctatgtgatactgggtaagctcattaacctcttagaaccttggtgtccacactgtaaaaagggtataatgatagtacctagatcctagagtggactttataaggattaaatgagtttattcacgcagagtgtttagaacagcacctggtaggtacttagtaaacctgagctgcgaattttcttatgacatctgtttgctaaggctgctgccacagagtgacatatgctgagtggcttaaataacagaaatttattgtctccctgttctggaggctagaaatctaagggcagaggcatgctttctctgaagcaactgggacaggatctgtttcaagcctctcttctagcttctggtggcagcataactccagtccttatgtagagttctccctgtgtgtatttcttttgtttttttagacagagtcttgctctgttgcccaggctggagtgcagtggcataatatcggttcactgcaacctctgcctctcaggttcaggtgattctccttccttagcctcctaagtagctgggattacagtcacgtgtcaccatgcccaggtaattttttgtattttttgtagaaacagggtttcaccatgttgcccaggccggtcttgaactcctgacctcaggtgatctgcctgccttggcctcccaaagtgctgggattacaggcatgagccacagcacccagcctaaattttgtattttttgtagagacagggctgcaccttgttgcccaggctggtctcaaactcctgaccttaagtgatctgcccacctcagcctcccaaagtgctgggattacaggcgtgagccacggcgcccagcctccctgtgtgtatttctttgtgtccacaatttccccttttttataaggacaagtcatattgggattagagtcctctctgatgacctcattttaactttatgacctctttgaagatcctatctctttttttttttttagagtctctctttgttgcccaggctggagtacagtggggtgatctcagcttactgcaacctcctcctcctaggttcaagtgattcttctgccttagccttccaagtagctggagttacaggtgctcgccaccgtgcctagctaatttttacatttttggtagagatggggtttcaccacattggccaggctggtctcgaactcctgacctcaagtggtccacccacctcggcctcttaaagtgctgagattgcaggcgtgagccactgcacctggtctgaagatcccgtctctaagatcacattctgaggtactgaatgttaggagtactacatatctctttttttttttttttttttttgagacagggtctccctttgtcattcaggctggagtgcagtggcacttggatcactgcaacctccagccccctaacccctggactcaagtaatcctcccacctcagcttcctgagtagctgggactacaggtgcacactaccacatctggctatttttaaatatttttagtagagatggggtcttgccatgttgcccaggctgatattgaactcctgagctcaagcgatcctgtggccttggcctcccaaagtgctaggattacaggaatgcgccactgtgcccaggcccctggagtactacatatctcttttggggaacacaattcagcccagaacaggtgtatatcatttatcatgggtactagaccctcgacacctacacataggaaatgaaaattttggtgcaaattgatagcatgacttaaagaagtagattatttatttagcttctcatgtatttatctttaacaagatttttgttttatctttgaaacttttttttttttttttttgagacggagtcttgctcttttgcccaggctggagtgcagtggcgtgatctcggctcactgcaacctccgtctcctgggttcaagcaattctcctgcctcagtttccccagtagctgggattacaggtgcccgccaccacatctggctaatttttgtagttttagtagagatgggtttcaccatgttggccaggctggtctcgaactcctgatctcaggtgatccacctgcctcggcctcccaaagtgtgtgagtcaccaagtctggcccatactcttggttttctttgcagacttttttcctcttttgctcctaaaaacattagtatttgccttcccttgacccttcttcctctcaccctgtgcagtttatgaggaatgccttagataaacttgtgcctcacttgccgtctatatgccgatgatttgcaaatgtgtgtttttccagctctgactagttttctgatctccaatcccatatacacagttgcttcctggacatctctacttggatgtcctatgggcattttattttatttttttattattattattactattgagacggagtctcgctctatcccccaggctggagtgcagtggcacggtctcggctcacggcagcctctgcctcccaggttccagcgactctcttgcctcagcctccgggtagctgggattacaggtgtgcgccaccacgtccggccagtttttgtatttttagtagagatggggtttcaccatgttggccaggctgggcttgaactcctgacctcaggtgatccacctgcctcagcctcccaaagtgctgggattacaggcgtgagccactgcatctggccatcttatgggcattttaaaatgatcttatccacttccccagtccaacctcttcctatcttcgtatcttagtgagcggtagtgtcacccagccagtcactcaaatcagggatttgagaggcctctgggttccttcttgtgccattctagtcaccacattcttgagatcctagctcataatattttcctagtcatcctacttctcctttttgagtccagaccttcatcgcccttttggctgcgtgaccttctgttgtcttgtaatcattctccttgactgctttctctcttccaagtcgctgccaacatgatccttgtaaaatgcatgttcaagcgtatgatcatatccctccctcttccaccatggctcaactagctttgaaggtagagttgaaatgttttgccagatcatctctccacttcttcctgagcatcctgtacgcagtagtacagatagcttgtgcccagttccttctgtgaaccctgttgttctttgcctctgggtcttcacacaagcagttacctctgcttaagatggactctaccctgttctggaaacttactccccctagtctttaataacagtagtggctggtccaagtatattggtgtttactattaattgatcacagccagttacagatttctttgttccttctccactcccactgcttcacttgattagccttaaaacaaaataacagtagtgataatagtaataacagtagctgacactgagtgcttcctctggacccaggtattatcactttatgatcagagttcataaagaaatacaaatgaccaagaagcatatgagaaacatttttattctgataaataatcaaaggaatgcagattaaatgacatactattttttacctatcagatttgcagttgactgtgctgtcaaaggtggtaaggggacaatctctgaaactgttagtgtgtgtgcatgtgagtgtgcatatgcagacctagcacttctattgtactgattgctagtttgctccactttgaacccagctagtgtctaggttctttgagagtgaggacttgctcttgtcttttatcctcactgcttgctgtttttgtttcttttttttttgagacggaatttcgctctttgttgcccaggctggagcgcaacggcgcgatctcggctcactgcaacctctgcctcccaggttgaagtgattctcctgcctcagcctcccaaatagctgggattacaggtgcctgccaccacgcccagctaatttttgtatttttagtagagacagggtgtcaccatgttggtcaggctggttgcgaactcctgacctcaggtgatccacccccctcagcctcccaaagtgctggcattacaggcgtgagccaccatacccggccatcactgcttgctcttgatggcacttagtaaatgagtgttaaagactgtattgctggacttgggacatgcatctttaggagggtatcagtggaaaagctgagagtcacatgcatttgccagtcttggccttactctttggatctattggtcccagtctgataagtgcaagcaactttggaataaggattgccaagaattaagatttttaatactctttctttgaatgctaaagggcaaaagtgtttttgttgtttttgcttttggaaaaagagaactagtttgctgaccacccagtgtcatttggtaatttagagtgttttcacatagttaaagtatagggaaatgaatatttaggtctgtgatgtttatatgtgccaggtagtatatttggcagggaattgatttttagaattgtttgtgacattagttcttgcatattagtttttttttttttaaatggagtctcactctgttgcccaggctggagtgcagtggcgcagtctcggctcactgcaacctccacctcctgggttcaagcaatcctcgttcctcagcctcctgagtatctcggactacaggcacgtgccaccacacccggctgattgttatatttttagtagagacagggtttcaccatgttggccaggctggtcttgaactcctgacctcaggtgatccacccacctcggcctccacaaagtactgggattacaggtgtgagccactgcaccccgcctagttcctgcacattagaaaacgtttgggccgggcacggtggctcacgcctgtaatcccagcactttgggaggccgaggcgggcccatcatgaggtcaggagatcaagaccatcctggctaacatggtgaaaccccgtctctactaaaaaaaaaaaaaaaaaaaaaattagccgggcgtggtgttgggtgcctgtagtcccagctactcgggaggctgtggcaggagaatggtgtgaacccagcaggcggagcttgcagtgagctgagatcacgccactactctccagcctgggccacagagcgagactccgtctcaaaaaacaacaacaacaacaacaacaacaaaaaacaaataaaacgcttgtcccccttgccttctccatcacagctctgttaagtatgagtttagatacacagtattttcttttttattaccgtgtataatttgtatttgtagcagcagcccagaagacaggcaagcgtatggttctagctcacttttttttactgggcacttgatggtggtggtaatttatctgtcagcagggggagctgcagttgctgatatttaaatgattccatctcagctggttttccacagaaagtttgtcggccaagagaaagaaaagttttgctggcaaagaacatgatcagagttcataaggaagaaatacaaatgaccaagaagcatatgagaaacatttttatcctgataagtaatcaaaggaatgcagattaaatgacatactctttttttaacctatcagatttacagttgactgtgctgtcgaaggtggtgaggggacaatctctgaaactgctagtggagtgtgcattgggcctagtttttttgaaagatattttggcaacatatattggcaaaattaaaaacgttctttaattcagtaattgcacatctaggaatttatcctaaaggggaaaaattaagatacatagaaagatttgtgaacaaagatgttcattgtaacattattcatattagtgagaattgagaataaacctaaatgagcagcaagatttataggaaaataaatcatggtatatttaaggatggacatttacaaccatggaatagtatttgaaagaatttttctggccgggtgcggtggctcatgcccgtaattccagcacttcaggaggccgaggtgggcggattatgaggtcaggagatcgagaccatcctggccaacatggtgaaaccccatctctactaaaaatacaaaaattagctgggcgtggtggcacgtgcctgaaatcccagctactcaggaggctgaggcaggagaattgcttggaccagggagttggaggttgcagtgagctgagatggtgccactgcactccagcctgttgacagagcaagtctctgtctaaaaaaaaaaaaagaatttttaatgtcttaggatgttgagtaaatgataaatgaaaaattcagggtgcagagctatataaggagcattctaagtgtataaagataaggaatgtatatatgttctagtataatatgtatgtatatattacacacacatacatactgaggtaaaagaatggaaggaagtctataccaaccagcctccttgagtctgtctgtccggggtctgtccaaccaattgttctgtctaaattggcaccaagtgatgttttcaggtgaaacattgttatctgttaagatgttaacctcagaaatttagggcctcacgtctgatagcacttctatcctgtaggacctgaatggacctaatatacctacatttatccgagcacttgaatctatttttaacttgtagattgtggtaacacaatccacaagtttcttttatctgttatataaagaaatacttttcaagcataaaaggtgaataaattagtatttaccatattgatacgttttctgattttgatcacattgcccctttgctttcatgtttctcaactgaagatgcttgactttttaatttaatctccagtgaaacctccttccaggatctttgtcagcattgctttccctttctggatttatgataactactcagaactgcattttagttataactacactgtgatttggtagaaggataagaaaatatgttctatttacagcaagcttgtccgacccatggcccacaggctgcatgcggcccaggacagctttgaatgtggcccaacacaaatctgtaaactttcttaaaacattatgagattttttttaagattttcttttttagctcatcagctattgttactttagtgtattttatgtgtggcccaagacagctcttcttccagtgtggctcagggaagccaaacgattgggtacccttgatttacagttttttcctaataggatttggtcctccctccctccctttttttttttttttttttgcatagaacatcacattgtctttagggaatattctataattattcaaaaattccttttttgacttgaaggcatgagtcttttaagtatagcttagattttttttcctgtaaatgccttacttttcatttgtccatgctgtaacatacctgccatttcctcgcatgtaattttttaacactcatatctcagtgggctcttagaggtaatccaaggtaagaaccacctttttagttaggtctgatggttagaaagcttgagttgaagcgtgcccttctggaattgccactttgggcccaattttgtctacacgggaactgcttagagcaagtctggtttgtcttctgctagataacccttcacatatttagacagcttttatacttgccaaagcattctctaagctgaatataaatcttagtttttgcaaatgtttctcatttaatatatttagaaaccctttccatcactccgttcccttatttttccaactcgtgtggtatttcattattaggaatctcatcatcccatctgcaaaatggggaattctctgtatattttttgtacaatatattaaaatgttaaatatagcatttctaaaaaaattttcaatcttctgtttttacttcttcatttggggaagtacctcagcatctacctataattttctgtgtctcagttatgtccagtctacagtaaatgttctcatcctgtggccactcaggtcttttttttttttttttttttttttttttttgagacagagtctcactctgttgcccaggctggagtgcagtggtgcgatctcggctcactacaacctccgcctcccgggttcaagcgtttctcctgcctcagcctcccgagtagctatgactacaggtgctcaccaccacacccagctaatttttgtatttttagtagagttggggtttcaccatgttggctaggatggtctcgatctcctgacctcatgatccacccgcctcagcctcccaaagtgctgggattacaggcatgagccaccgtcacccagccacacatatttattttctcagagaatttgggtgaactggtgtggtgtgatgtccacttttagaatccatgttgtcttttcctcagaaggttattcatgctgatatgtcttctgagcccatctttattagagatttgctagtttgggcagtttgaagttgcagcctacttgagtagatggaagttactttgatgacagcatttttttgttcgttttggttcagcacatacttattgagtacctaatatgtcagaagttgagcaaggaaaatattgataaaggaaaagtggattctatcctcctggcatttagagaaggtcactcatatgaccgtcagctaatatgttctgtcctgcagtttaataatttatacttaaatgcctttaaaacacagagaaggggctggtcgtggtggctcacacctgaaatcccagcactttgggaggccgagttgggtgaatcacttgaggtcaggagtttgagaacagcctgggtaacatagtgaaaccctgtctctactaaaaatacaaaaatcagccaaatgtggtggcacatgcctgtaatcccagctacttgggaggctgaggtgggagaatggcttgaacccgggagacagaggttgcagtgagtcgagatggtgccactgcactccagcctgggcaacagagtgagactctgtctcaaaaaaacaacaacaaaaaacccatggagactattttgggtcttcatgactacctgacatctgacatatcagtttgaggaatttagtatatttaatgatgcatttgattcactattagagatttgtatgcttattaagagtaatttagatagcttttcccctctaccttccccagtaaatatcgaagcaaataagaattatataatatcagctgtcttgctttttatcaatcccacttatcaagtgacccatccagttttatttggcatcgagctttttatgtatttaaactgtctcttaggtgactttgcattttcttttttttttgagatggagttttgctcttgtcactcaggctggagtgcaatcggcgcaatcttggctcactgcaacctccgactcccgggttcaagcaattctcctgcctcagcctcccaagcagctgagactgcaggcatgcgccatcacgcctggctaatttctgtagtttttggtttttttttagttgagataggatttcaccatgttggccaggctggtctcgaactcctgacctcaaatgatccgccccactcggcctcccaaagtgctgggattacaggcgtgagccactgcgcccgggctgcatcattttgttgtaaggttttttttttttttttgagacggagtcttgctgtgtcgcccaggctggagtgcagttgcaggatctcggcttcctgcaacctccgcctccaggttcctgcaccctctgtctccggtgggctgagctgaggtgggacagactgacgcggagaggaagggaagccacctggcctgaagatcctgtctctaagatcaggttctgaggtgctgaatgttaggagtactacatatctttttttttttttttttttttgagacagggtctccctctgtcatccaggctagagtgcagtggcacttggatcactgcaacctccagccccctaaaccccaggctcaagcaatcctcccatctcagcttcccgggtagctgggactacaggtgtgcactgccacacctggctatttttttatatttttagtagagccggggtcttgccatgttgcccaggctgatattgaattcctgagctcaagcgatgctgtggccttgaccttccaaagtgctgggattacaggcatgtgccactgtgcccagccccttggagtactatatatctcttttggggaacaaaagtcagcccagaacaggtgtatgtcatttatcatgggtacaagaccctcaacacctacacataggaaatgaaaattttggtgcaaattgatagcatgacttgaagaagtagattatttctttagcatctcgtgtatttatctttaacaagatttttgttttatctttgaaactttttttttttttgagacggatttttgcctttcacccaggttggagtgcagtggtgtgatcttggctcactgtaacctccgcctcctaggttcaagtgattctcctgcctcagcttccccagtagctggtattacaggcgcctaccatcacacctggctaatttttgtctttttagtagagacggggtttcaccatgttggccaggctggtctcaaactcttgacatcaggtgatccacccgcctcagcctcccaaagtgctgggattaaaggcatgagccactgtacctggcctttttgtattttttgtagagatggggttttaccatgttgcccaggctggtctcaaactcctgagctcaagcagtccccgcaccttggcctcccaaagtgttgggattacaggcctgatcccctgtgctcaacctgatgagatcttttcatgtgcttattggccattcatatatcttctttggagaaatgtctatttaaattctctgcacattttaattttatttttatacactattgttttttaggctaggtcttgctctgtcactctggctagagtgcagtggccaatcgcagttttcttttctttttttttttttttggagatggagtcttgctctgtcacccaggctggagttcagtggcactatcttggctcactgcaatctctgcctcctgggttcaagtgattctctgcctcagcctcccaagtagctgggattagaggcacccaccaccacgcccagctaatttttgtatttttagtagagatggggtttcaccatcttggccaggttggtcttgaactcctgacctcatgatccacccgccttggactcccaaagtgctaggattacaggcgtgagccaccgcacccggcccaatcatagtttctggaacttcaaactcctggactcaagggttccttctgcctcaagctcctgagtagctaggactacaggtgtgtgccaccatgcctggctaattgtttttttttattattattaatttattttgtagagacagggtcttgctatattgctctggcaggtctcagaatccttgcctcaagggatcctctccttctggtgtgagccaccatgctcagcctttgcccattttaaaattggattctctttttattgttgagttgtaagagttctttaaatatactagatacaaatcccttgtgagatacatgatttgcaaatattttctcccatctatgggttgtgttttcaatttcttgatggtgtcctttaatgtacaaaatgttataattctgatgaagccaaatttacttgttttttcctttgttgcatgtggttttgatgtcaggccaccaaatgaaatgaagattagctttgttttcttctaggaattttattgttttagctgttacatttaggtctataatccgtgtttaaatttaattagaattaatttttgtgtatggtgtgagatatagtggtccagcttcattctactgcatgtgaatattcagttgtcccagcatggtttgttgaaaagaccattgtttgtttcttgtagagatgggggtcttgctttgttgccctggctagtctcaaactcctggcctcaagcaatcctcctgtctcagcctccccaaatgctgggattataggtgtcagctacagcacttggcttaaaaagaccattctttcctccactgaattgtcttggcatttttgtcataaaatcaattgactgtcagtgtaaaggtttatttctgaacccacacttatattccattgatctgtatgtttatccttatgccactaccacactgtcttgatttccatagctttgaattatgttttcaaatcaggaagtgtgagtcccccaactttgtttttcctattcaaatttcttttgggtatgctgggatcacattgattctgtagatcaatttagggaatattgccattttaacagagttgtatcttctgatccattctcatccatgaacatgggatatctttccttttttttttttttttttttttgggggacacagtcttgttctgtcatccaggctgcagtgaagtacagtaatgcaatcatggctcactgcagctgtaacctactaggctcaagtgatcttccctcctcagccccccaagcagctaggattacaggtgcatgccaccacatctagctcatttttgtatttttgtagagatgagttcttgccatgttgcctagtctgatcctgaacttctgcgctcaagcagcccacccacttcagtctaccaaagtgctgggattacaggtgtgagccatcacacctggcctttccatttagttaggatttctgtaacttcttttgtaatttttatatatctcagagtataagattgtcactgcttttgttaaatttatttctaagtcttttttttttttttttttgagacagtgtctcattctgtcacctaggctaaagtacagtggtgtgatctcggctcattgcaacctccgcctcctgggttcaagtgattccactgcctcagcctcctgagtagctgggattacaggcacctgccaccacacccaactaatttttatattttagtagagacggggtttcaccacgttggctaggctagtcttgaactcctgacctcaagtgatccgcctgcctcggcctcccaaagtgctgggattacaggtgtgagccatcgtgcttggctttctaagtcttttttttttggcggggggatgctattgtaagtggaatttttaaaaacttttcatgttcagattgcttattgcttgtgtatagaaatacgattactacttgtatattgagcttgtatcctgtaactgtgttggatgtgtttattggctctaatagtttatttgtgggattttcttaggattttctatatacaagattatatcatctgcaaataaaggtagttttccttcttttttttaagcctgagtgatttttatttctttttcttgcctatttgccctggccataaccttcagtgcagtgttaaacagagtggtaagagtggatatccttgttttgttcttgacctgagggagaaagcattcaggctttctccattaagtatgattttagctatggggtttttgtaggtattctttttttcccccataggtattttttattagattgaagatgttttcttcaatttctactttgttgagtgtttttatcatgaaagcatgttggattttgttaagtgctttttctgcatctattcaaatgatcatgtggtttgtatcctttattaatatggtgtattacattaattgattttcagaagttaagccaaccttgaatccctgggattaagtcatacttagcaatggtgtataagccttttaatatgttgctggattcattttgctttgttgaggacttttacatctgtattcataagatatattggtctgtagttgtcttgtgatatctatgtctggttttggcatcagagtaataatggctttattgaatgagttgagatgtgttcttggcttcatcttggactaattttggttgaactttgaacattcatttagcaattgtaaattctaattgcctaattactgaatgaagataataattaaagatataactgtttgtttttttgagatagagtcttgctctgttacccaggctggagtgcagtggtgtgatctccgctcactgcaacctccacttcccaggttcaaatgattcttatgcctcagcctcccaagtagctaggattacaggcccctgccaccacactcagctaatttttgtttttagtagagactaaagatacaaaaattttatcatgttggccaggctggtctcgaactcctgacctcaagtgatcctcccaactcagcctcctcaagtgctgggattacaggtgtgagccaccacacccggcctttttgtttatgtttgttttagagatagggtcttcctatgttgcctaggctggagtacagtggcctatggtttcaagcactcctcctgtctcagcctcccaagtagctgggactagaggcacatggcacacccagcttggttgccttcccctgctcccctacccgtgagacagggtcttgctatttgtccagactagtctagaactcctaggctcaagtagtctctccacctcagcctcccaagtagctaggattacaggcacatgccaccacacttggtagtcaactatttaaaaaacatctattatttaacattcagggtagaggttccaagtatagaactttagatccttactgcctgcttggttccctggattttttctcctagttttatttggggtacttactttgttatttcattttggttatgccataaataacacccaattttagcattcctgggatgatttaggcaagcttcagaaaagagtccagaagaaaatggaattggaagcataaagccactaaaattttttcattgttctctgatcattttttagctttggattttttgatcatttaacgtatcaatgagtagaaaggatttttcttgactaccacatagcttataaagtgaccgagtattctttccttagagattctacagtgtttaacatccactggtactcagtatgtttatgaatgaatatgtattaatggtagggcttttatagggtcttattttactgaaaattgaagataatcattcacatttggattacaagtgtttgtgttatgttataaacatttaatgccgtagcccaaatattaacaagcatggtcatattttggtattgccacggtaggtattctgggaagtgtgagtagttgttttttcctaccctctgtgctgaaggatttctttctttttttttgagacggagtctgctctgtcgttcaggctggagtgcagtggcgcgatctcagctcactgacactgcaacctctacctcccgctgggttcaagcaattctcctgcttcagcctcccgagtagctgggactacaggcgcatgccaccacgcctggctaattttttgtattttagtagagacgggttttcaccatgttgcccaggctggtctcgaactcctgagttctagcaaaccactggcctcggcctcccaaagtgctagtattagagatgtgagccaccacgtctggcctgaaggacttcttataccaaagaagatacagtttcatttaactattttattttattttttctgatgctggttaaagttggttcatttgggacacatttcattagataaaattgtgtttaaatgtgatagtgagaatttggaatatggtggaaaatattgaatattatattctataatttttgtcagtctaattcagaaacaaaaaagattgcagttgagaaaatcatacatgatttctttgtaaatgagttacagagataagacaggacctttagcatttcctgaattccagtcatgttctcggtaacttatggtctcttttataatattgtacccatgacaatttatacgttagatttcaggttttatcttctgcctggaaggattacattcaggggttttagccatgcatatttatctataaatggtctaaaccagtacctctttatctttccttaaagtacttttcagggtctagggctgtttggagctgtttgttacaagcaggacatatctctctgaggactccttttctatcttgaaacagtgagaattctgccttttgctctgtatacattgaatatcccttatccgaaatgcttgggaccagaagttttttggatttcagatttttcagattttgggatgtttgcatgtacataatgtactatcttggagatgggatccaaatctaaacatgaaattctatgtttcatgtacacattatgcacatagcctgaagataatttcttttttttacctttttctttaagagatgatgtctcatactgttgcccaggctggagtgcagtaatgtgatcctagctcacagcagcctagaactcctgggctcaagtcattctcctgcctcagcctcccaggtagctggtactaactggtacagatgcacggtgccaagcccagctaatttttttgtttgtttgagatggggtctgattctgttactcaggttggagtgcagtagcgccatctctgctcactgtagcctccaccttccaggctcaagtgattctcccaccttggcttcctgtgtagctgggactacaggtgcatgccaccatgcctggctaattttttgtgtttttggtagagataggttttgctacattgcccaggccggtcttgaactccagagctcaagtgattcacctgccatggctttccagtgttgggattacaggcctgagccactgtacctggacttaatttttttttttttttcagagatagggtctcactatgttgcccaggctggttttgaactccagggctcaaatgatcctcccatcttggtctcccaaagtgttaggattacaggcatgagctaccacaaccgaccagttttatacaaaatttaaaataattttgttcttgaaataaacagtgtttctgatggttcagagaaccatcagaagcaaaggtgtcacgtgtggaattttccatttgaggtgtcatgttggcactcaaaaagtttcagattttggagggttttgaattttcagattagggatggtcaacctgtaatatatttgtgtttattttaacaaaagtatatctgattttactataatccttgattaaattgatactccaaaaaagttgctcctgcatatattcagtggctttggttactccccgtttgtagctgtatgttcctgagtgtacatagaaacaagttcaagaatccaagaattagtgggttaaaaataatgttctaggctgggcgtggtggctcacgcctgtaatcccagtactttgggaggctgagatgggcggatcacctgaggtcaggattttgagaccagcctgaccaacatggcgaaactccgtctctactaaaaatacaaagattagccgggcatggtggtacgcgcctgtagtcccacctacttgggcagctgaggtaggagaatcgcttgaacccaggaggtggaggttgcggtgagcccagattttgccatgcactccagcctggcagcctgggcagcagagtgagactgtgtctcaaaaaaaaaaaaagtaattccctttccaagaatggtatgctgcttcattggaggaaacaggtctgccatcttccaaagtccctaggtttgccatgccatcagaacaagattttacaagttgcatcataacttagaatcagcaactgacgtaaaaagaaaaatatatatatatatatattttgagacagagtttcgctctgtcgcccaggctggagtgcactggcgtgatctccgctcgctgcaagctccgcctcccaggttcatgccattctgctgcctcagcctcccgagtagctgggactacgggtgccccccaccatgcccagctaattttttgtatttttagtagagacggagtttcaccacgttggccaggatggtctcgatctccggatctcgtgatctgcccaccttggcctcccaaagtgctgggattacaggcatgagctaccgcacccagcctgtaaagatattttttaaggtgtgttttgccttgtacacctgctgcctccttttctctttgaacattttcccttctgactcacttttgtcaggccctccacaacttggctgctcacagctgccttgaagttctgcatatttacctttatgtttcctttggaaaagaactcaggtagtttcttggtacattttggccaaattctgacactcagctttattatctgataaaaagtttgggtcctgcgtagattgcttaatctgcaaaatcagtatattagaatactccttctatgtttggtcattgaacgttcacacattctagttatttgagaattttaaaatattctaaagttaaaaacattagaattaactaaaattcaccaaaataatcagggtgtgtgtgtgtgtgtgtgtgtgtgtgtaaactcattgaggaactttattaaaatgttcgtataaaatcctgcttaaactgcttgcactagaaatgagtgctggtagctgctattaaatccaccactgtggagaagaccaacaatcttgggtgttagattttaacaatagctgatggcctgagagaacctgacttgtttctttcagtgatataattgtattcagctgagctttaatgttgtcttctgaattatcctaaagtaaattatttctagacttactagtacatttaggtttaacctacaacagtattgttctcattactaacacagttaaattaggaggctgcctaataattagtttttcttttgtatgaattattgggtcagttctgtggtgagatggcaaaataatatctttatgtaaatcctgcagtttgtatcagtagtatgaggaggaaaatatcttgttaggttggattgaaatgaaggaatgctatgcattcttgtaatactttgccatttatgaaatgcttttgtttaatcttactgaaagtttgtttctactggattcagtcagtacataaaaatactgtatgatattttgaatcagctaaggcctccatttaatgaaaaaaaatcttgatttctgagctttgtagtcattgtaatcagtatgaggattttcttctacttgcatttggctaaatctttatacttgtgacactgtgaaataggtagtatggtttaggtttaatgcctttagcatgtttgcacatccagttcaccaattgagtagcactggtgaattagaagtgggaaaagtgagaattgaagactgagagaccctgattccagctttgacgctttggcaatctcttaactggcttctttctgttggcctcattttcacactaataaaatgtggcggctgaacatattccttctacatcctaaattttttgacttaaatttcttaactttggtttagttgactctggctatttaatatttagctggttaaatattaatgtgagaacatgcctcagtttcagcttaaagatgtttcttttataattttaatatgggtttttacataggtttatgtgttcatttctgtgatatctagaataaattcttgagcttaataggtactcactagatttttgttgaattaaatgtatttgaagtatttaatgtggcattagatttatgattgtaaataatcattctcagaatatgtttttagggagctaaaagtatttttatatatagtgttatctaagttcatgaatgaaaacattgtttgctagagtctagacagggattttgtttttgaaacagagtcccgctctgtcactcaggttggagtgcagtggtgcgatcttggctcactgcatcctccaccttgtgggttcaagcgattctcctgcctcagcctcccaagtagctaggactataggcatgtgccacaatgccaggctaatttttgtatttttagttgagacagggtttcaccatgttgcccaggctggtctcagactccaggcctcaggtgatccacttgcttcggtctcccaaagtgctagaattacaggtgtgagtcaccacatccaggctttttttttttttttttttttttttttaattaaagtaggtccaagtcctaagtagataggtgtttgaagtttgaattaggaaagaggtgctgatttttgcttcactcagattttaacctttaaagtttagaactgtggaaaatagcttcattcactaataataatagttaaacttaagaggtaggtggtattactatctccattttacagagcagaatacgtactttgcccaaagtaacacaaagaataagtgagggaggcaggattagaatcgggctacctaggtcctgtgtgcttaagtactacactctacctttttcatttattcagtcagttcttatgatgtgtctcttttgtgccaggccctgggctaggtcctaggtaagtaaccaaaaaaatgggcccctgtgcttttgaaactaaatggcctaggctttagaacttgtcctgagttaatatataataattgctttttcttaagtgcaaaaaaagttattcattgtccttttgagattagtttggacatacgaggtactgaatttgtgagattattctgtttaggaatttctggcttgtttagaaggtctgtggcagggaaggtagagagtgcctttttggaatacgtttattatctatagatgagttacagatcttaaattagaacaaccacagttcctgcctgcaagggctttcaggctggcttgaggtggcaagactggtatatgaaaacaaactcagaggaattacagacagcatttaaccaagggtaatgtagtgccaactctgtacattattggttctttttttgagacacagtctccttctgtcgcgtaggctggagtgcagtggtgtgatcttggctcactgcaacctctgccttccgggctcaagtgattctcatgcctcagcctcccgagtagctggaactacaggcgtgcaccaccatgcttggctactttttgtatttttagtagaggcggggtttcaccatgttggccaggctggtctcgaattcctggcctcaggtgatctgcctgccttggccttccagagtgctgggattacaggcatgagccaccacgcccagcctacattattgtcaagtgaagtgagtagacgataacagtggtgtggtggaatataagaggataacatgagttgtaggtggattggagagaggaattaacaaggaatggtggtaatgagggatggtcctctttttctaggtagagagaacacagacaaagatggatggatacagagctgtgtgtaagagggaacaccttttccttttttctttctttccttcctcccttcctttctttttctttttttggagacggggtgttgctctgttgcccaggctggtttgcagtggcgtgatcatggttcactgcagccttgacctcctgggctcaagtgatcctcctgcctgagcctctgagtagcttggactacaggtgtatgccaccacccccggctaaatttttttattatttattttttgaagagatgaagttttgctgttttccctgggctgttctcaaactcctgggctcaagcaatactctcacattggcctctcaaagtgctgggattataggtgtgagccaccatgcctggccatggaatgtcttttctgaggaagaaataataagattagttatataaaatactgtaatcataaagtaagatacaaatactaaaaaacattagaactcaatcattgttttttgacttcatttattatataaggaacctaactcaaattggcttaagcaattaataaatgtttattgttacattgttgtaatgtggctggaaatccagaagtcatacaaattgtcaggattggttgatacagtggcttaatgctatcaccaaggaccaactctctattccctttgatgttggtggcatcttcaggcttgctgcaaaggtgactgtagcagtttgaggtgtcactgtctgaggaagagggactgttttttcctccatcatttttaggattgaagaaccttttctcacagttctcttttggaggctgtccagggggcttctactcacatctcatggccattcctaaccaatcattggcaaagagaatgggttaaaactaatcagaatagagtggatattggagagtcaacatgactattccaagagtgatttgaaatatgttggtgtttttatttttttatcacttttcattttgagatggtctcgctctgttgcccaggttggactacaatggcatgatcatgactcactgcagccttgacctcccaggctcaagcaatcccctcagcttctggagtagctgggactgtaagcacatgctaccacacttggctaatttaaaattttgtttgtagagatagggtctcactctgttgcccaggctggtctctaactccggagctcaagtgatcctcccacctcaccctcccaaagtgctgggattacaggagtgagctgctgcaccaggcctttttctttaaatctttttttgtttgtttgttttattttgtatgtaggtgttttcaatcagccttttggacatccactattttttggggggaaatttaagaaaatttgtttctcttcataagatttttgtgtggtggctcatgcctgtaatgccagcactcgagtccaggagttcgagaccagcctgggcaacatagggagactctgtatctaccaaaacaaaaaggagtgaaaaaaataacagctgggcatggtggcatatgcctgtagtgccagctactcaagaggctgaggtaggatcgcctgagcctgggaggctgcagtgagtttgattgcaccactgcactctagcctgggcaaccgagcaggaccctgtcaaaaaaataaaagtacaagtggatgcctaataagaaagatgtctgattttagataagaatatacaacaggttgactgatttaagtgccataaaccctgtgaactcttgactcttgcactaagcaatgagagaaaggggaaactggaatttatagttcccccaaatacatggttttaaaaatgagcattttccagttttctcctaatccattagaaaaatatatttcatataatcttgcttatttggttgcctaattaaatctgacagttcagtcttaaaaatttggagcagcagtaagattattttgttatggtgtgtctgaatttaatatttaagtatacgctgcaaagggctttgccttatttggtatttttcattctgctaatttagatttcaggagcctcagattggggctctagttcgccatctgttggtccaatacccttctactgtattttgtggaattactatttatgtgtgtatgtgtgtacaataaaaaagtcaaagtttttccccagggttgtaaattaaaaatccaagactaaagacctcttttggatgtgtatacaaatattagtttattctttgtgtaatttgaccctatgactccaaactgcctgcctttggtatttgagaactatgactatgcttgagagtgtgattttaggagtacaaatggaaattcgcagaaacctaggtgcagatgttgcaggggcaggtgagttagtgtaactttgtgggaagactaaaaccgttctgtaacgactgtgagggtgttttttgataagcagaagtgacgtataatgccggatattggttctggtaagccacaaaaaagtgtgaagcattttgcgtcttcctttttggtagtagagcatacatacccttcttatctgccgaatttgatgatttaatgatttgaacgattttttcttcagtcatttaagccagttttgatgaatcctagattagtcttttaaatctcaagatactccactcatcttttggcaactttaaagggtggtagaattacactttgtgtgacactttgtattacattatgtttatgaattctttaagtctaggaaaggttccattattttaaaggtcctattttggggacaatataaagttctgtactgataaactggtcatgagaaatgataaggtgccaccactttaaaccaactctggtaacgaggtgggaagttggctttttgttgtgagacttgtgtttctttatggagttctttgttaaacttttagcatggcagtgaacttccttttggtggcggcaggaagcataaatactcattgtgtaatgccatttgcctgttttggcggatctgccaagccatgacacccaaaacaagacgcgtgtttcttcacgaaaactacagttcccagcgggcccggcgccggcggggccatcacttcccctctggctcccggctgtcccttcccgggctggcccggcgcgggccctggctggggcctgcgcagtgactacgtgcaccctccccaccccgcccaactctggtggctgcggagcgcggtgctggggctagtgcccagccgtgctgcagtatacggaggctggctgctagggacaaagggcgggcggcggaagccgcttcactggtcagggagctttctgcagggttagccttggaatagtgtggtgccgacggccttaccctctttactacacagtgcaaacagttcctcgctcacgtcctctcgctccgcggcgccggcccgccctgcccctcaactggcgagccgcaccgccggccccagcacggagggcatgtgacggcgtcagtgcctcaggttagactcacctcggccgcagcgagggctggcttccccctgccgcagtgctgcgtgccgtcgccgcacgtccggggcagctggggccgggcgccgcggcctccgcagatggaggtacaaaaacatcggccacggcgaggagccatgactgaggcggcggcggccgcgcctcctggcggcccgcgggggcggcgcggcgggcgccccctggcggcgcgccggggtggagcggcccttcgccgccgcagccgcagccggcggaggcgctgctgtccctcctccccgtgtccccggcgctcgcccgcttgctcgctcgctccattctccctccgcttcagattaaagggggggagggaaaaggagctcggccgccattttcccagtgccgccgccaccgccgccaccgctcgccgagccggcgggagaaccgagcaccgtagcgaagccgactcgtctcgccgcggcggcgcggggggcggctgaagcgcgctccccggctggaaagaggcggccgggggtggcggcctgggtgcgggttcgggctgcagacggcggtgcttgtttgtgcggggcgggggggcggtttcactctctgcccccgcccgcccgccctcccggccgggctgcggtctccagccgtgctcgggccccgtcggtgcggagcaaggccgggaaagggcccgaaagagaagaaaaagcagccgctccccgccgccgccttcccctccccctctgcctcgcccccccgcccggaaagtcagggcggctccgggcgtcggggggaggagagcggcgggcccgggccggagccgccgtcgcgcgcccccgcccgccgctggccctcggcgcccaggccggggggctgtttgcaaactgcgcccattttgtggggctgaatccgcccgggctacgctcctccatcacgtggtaggtgctgctgctgctcctctcctcctcctcctgctgccctttctccttctcctcgctctccctgtggctcccatttctctctctctttgttagttgtaactagaaaggcagggcagggtagaaaaatcccccggaactttaaatggcctctccgggcttccctgctgcgggtccgggctgggagtcgccccaagggcgggggtgtgcgggggcccttccccaggagctgccgcctcgttcgccagcttttcctttggcgttctatttaaaaaggcggcctgaagaacatgatttattcccgtaaaagaaccccccaaacaaactctggctctcgccttgaacttctcttgactgcaaaaggcctttctctgctcgaaacacacatcttggcgcgttgcacggtttgtatcacaactctgattgtttcatttattatttttgttgcctgtaaattcaggtcacttacgttttcagatgtagtctccctcaggcggactttttttttttttaaactaaagaggaagagggatttatttgcttttaagtgagttggaatcttaactgcctttttgggggcctgttttccggctgacggtcttttgattcttagcaaatagtttgttttccatacgataaacagcgctactcccgtgtcttacttaaaaatcctcgttttccaatgttggaatcccaatgtggatttatagagaaacgtgctacttaactattgcttactgattgctttaggggagaaggggtgacatgatggcgccactttaaattgctctctttccttttcctcggtcccccccacccccctttatcctggaggtcactggagcattttctgtgacttattaataaaactgtacttgagggtgttagaagcacaactcgtaggggctggagtttagtgctcctagggtcggcagaccgactgccgcggtccccaaagttccgagaaatctctcttcctccagcctcgcctccctcccctccattcacaatcctggtgttgccatctcctttgtcacgtggctagcaatcattgtgtttttttgtttgttttggggtgtgtgtttatatttttaaattgcagctcagaggaacctttccttttcgctttggagagatcaaaacgttttacttgttttagttttagagtcggagaacattttaaaataaacgataaaattacataatctttgccttgcataatcatgatatagttatagattgctactgaacttcattttgaaagtcctttcaagtatggaaactagtacgttagaatatgttttccatttgtcaggatggtctgtaatttctgttttctctgctttttgggtcagttaaaggaccactatttacaaaggcttaagtgggtgtgttttccctttcccctttcctataggctctacttggttccttttctagcatgctgtctgaccaatttagaaaatttcaattgtctacaggcgttgtcagttaaaactatttttttaacctatcaacagtgaatacttttgagtagtaattgttttgtgcctaatgctaagtgtatttattagcatttcggtgttgatctagaaaatttttacttttaatcctgtagttttagaagtatgttattcctttatctgtttctttatatcagtttttcccataattgggtaaactcctattttataaaatacgaagtacatttctggttttttctacataggttactagacattttttcaatttgaaaaaacattttgaattaagaaactttttttttaaagtaaatacgaaatgtggttcttgagtatgcattgatcctgatttaccatgtacattgtcaatggtttggaccattttctttgctaacagttacatcatgtcatgtgatatgtgcagtgtgatgtgtagttctaaaaataaggcaaggtaaaaatgctcatcccttgggaatttaaaaaatgtattataaatgtggaataactaccttcagtcatgaaattctgaattggatttccactaggtttatgcaacaaagtgtgccgttccttcgacctttagcatatttggtgtatttgttagtacctcataatttgaggtgattgactttttattttttgaactacttggagggaaacattaaatgttacaaaggttcttaatgtctatattatggtgaagatggttgtcactgatggccacctcatttgagtatataccagtgtctgtgattgtgaccagttaaaagaatgatcagttaagaattattagagcctttatggtagggtgggattttcggtctttccatctatatgagtccactgaagtgaagtattttagaagttttcttgcatcttttctgaaagccacgttcagaacattcgtatttgactttggtgctttaccaacgtgagatgttaaatttttgtctgattttctttcttcctgcctacacatgttatttctctggttaaacctgcagagcactctttgttacgtgagtgtttcctgttgaggaaaattctggaagttagaaaatgagtaggccttagttcacttgtgaactcatatcaaggtgagaagaaagtgaagtaactatactaaacttttttcttcactgtcactaaggctactcttccatctctagtaatgctacattgtaaccagtgtctctgcgtcttctgtagaggattgagttgaccacaggttttaattgcattttaaagtgaataagaagttttaggtttgttctgttcgttatgacctgatttgtgtactctgtaaacataggggtgttgtggttgtttgagaaggtattttagtattgagaggttctgattaggcccctttgcgagtaaagcttagttaccttgttatatcaggcaagcaattttttttttttttttttttgaggcagggtctcgttctgtcgcccatgctggagtgcagtggtgctatctcagctcattgcagtctccgcctcccaggttcaagcgattctcgtgcctcagccgcctgggtagcagggactacaggcatgtgccattgggactacaggcgtgtgccaccatgcccagctaagttttgtatttttagtagagacgggggtttcaccatgttggccaggctggtctcgaactcctgacctcaagtgatccacctgcctcggcctcccagaagtgccggaattacaggcatgaaccactacgcttagcctagacaagcaatttttaaaatgtgctataaaacaccaaactaatccacactggattttctaaacatagtaaacgccatgtttaaagagtaatgcgtattccttttatgttttttcagcttgtggggagatgggtaggggctatttttttcttcttggtgagtccattaagacacagaaataagcgactttcttgctagatagatgtatatagttttattgtccctctccaccccccaacaaaggacctctccgttccattccttgagtttagaggggagggactagggtaaactgaataagtggttgtctgttgattgccccagagtaaatcttattgagtggtttagagattttgtttctttttcattttagagacgaggtctcggggtctcgctgtgattcccaggttggcgtgcacagatgtaatcattgtgcgctacagtttagagtgcctgaactccggggctcaagtgatcttcctgccttagcctcctgagtaggttgagcaacgggagcatataaccttgcttgtctttttttttttttttttttttttttttttttttttgagacaatctttgctctgttgcccaggctggagtgcagtggcgcgatcttggctcactgcaacctccacccctagggttctagcgattctcctacctcagcctcctgcgtagctggcattacaggtgcccaccaccacgcctggctaatttttttctatttttagtatagatggggttttgccatgttggccaggctggtgttgaactccggacctcaggtgatccacccacctcagcctcccaaagtgctaggattataagcgtgagccaccgggcctggccccttgcttgtcttatttagagttttaaagcagctttcgttgtactctttcttcattttaaatgttcctgccttgagtgatttgattagtctatgtcttgggaagcgtattttaccttagtgcctctttacttacttaccttaagaaaggagtacagggcaggttcttaagtaaaatggccccagacacctggcttgcctactgtgtcagtgcaaagaacacttggatcatgtctttttcctaaaattggacttcataactgtttcttggaagtctgttttaagacttttttagttctcatgttgcttctgaagatgtatgtttaaattacagtttctatgctgataagttgcgtatatacctctgggcatactaaaagttgtgcagaacaatagtttatatgacaagataagtttccctcatcagtacttcccattccctgaaatgtgagatcaaaactcagttgaaccacactatggctgtagaagacagtatgaattagaaaagacaaatatccactgtactagagttcaccagcgtttgaaggctatcagaagatataggaggtaagtgatatccttgggtgtcacttgcagattgaggggaggattgtgggtcataggagatgactagtatggcagggggtaactattattatttgtttcttttttaagccatgtgccttttaggatgtagaacaaaatacataggagaaaataagccaaaaggtgtgatttaccaaaatacttggactccaaaaagagctgcaatatatatttttttttattaagcattttcttgtctttggtagaataaaggtaaagctaaaatagagtgcggaaactgacttgaccaaagtagaaaacacagctcatgtttatgaatcaaaaacaaatgagtttgggcagtctgaaagaaaaaaatcaaacattttatatgaagattttaaacctttatgcaaagagtccctttaaggtggaagagaccttttaaatagagtagaccttccccatttagtagcacaatgcggcaaaatagttgtttaataaatgttactttctgcaagccttgcttttccaagattttaagctgcttccacagtgttaacatttgaaagccctctaccaggaaattatttagctgtgtattttattgttgctgactgtgaacttacccttttttttcctggctgtaatttttttagaattaaagtttctttccaagattttgagggtcaggaaatgcaaagtggaggtagattgagtgcagttttatctaaatgttattttaaaaactctggttcttgtaacctgaaccaggaatccaaaatgagatcttactctgaattttaattacagcagattctgctcttatttggaaaaagttgcttgagtgacatcaaacttaatggagtccctcaccttttaattcctttttaaaaaggggagagcttaaggttagacttggttaaattcagttggaaggtaagtattagggaataaaaaagaggaataacaattttgttgttaggatgttaaaccaaaaattgctaagaactcatatctagactttcctcttgctgcttgttatttggcctttgtgactgtttgttagcacctccaccagagggtgtgaagggaaagaggctcaaagctaagtactgtagctagtttctggtttctagtataggagagacacttcatagaaataccagcctgggctgggtgtggtggctcatgcctgtaatcccagcaccttgggaggccgaggcggatcacctgaggtcaggagtttgagaccagcctggcttaacatggtgaaaccctgtctctactaaaaaaaaaaacagcaaaaattagctggacatggtggcgcatgcctgtagtcccagctactcaagaggctgaggcaggagaattgcttgaacctggaggcggaggttgtagtgagccgagatcgcaccactgcactccagcctgggcgacagagagagacttcgtctcaaaaaaaagaaaaaagaaataccagtctgataagttgaactgtcaggaaagtttcattaaactctccatatgttaccatggagaactgaagctctttgaagaccttaagcatgtctccaaaaaattggactgtatttttttgcacttagtgatttactccttaccccttgcctcccaagagaatgaaaaatggatattagtattgacttaacattttattggcattggaaaaatgtacttttaaaagtcattaattgacttttctctaaaggtataaggtaggtttcagtgggaactcaggaatttggccatggaccctcccagaataacctgtttcctttagaattctttttttttttttttgagacacagtctcgctctgtgccccaggctggaggtgcagtggcgggatctcagctcactgcaagctctgcctcctgggttcatgccattctcctgcctcagcctcccgagtagctggaactacaggtgcccgccatcatgctcagctaatttttttttttttttgcattttagtagagacggggtttcactgtgttagccaggatggtctcgatctcctgaccttgtgatccacccgtctcggcctcccaaagtgctggtattacaggcatgagccaccgcgcccggcctcctttagaattcttaaaatcttccagaagtcgctgattttaggattgttcaggagcacttacaccaaccattagggcttgttggaaagagatatgataaaaagtatgatttttttttcctctgtcttttgtcagctaaagagtggtaggaaatttgaattcagtgctagcatagaagtaggattaacaccattaatagtttgatatatagacatccttcagaaaaaaaagttttcttgagatggtatcttgctatgttgtctaggctggtcttgaattcctgggctcaagcagtcctcccaccttgacttctagagtagctggtattacaggcatgagccatggggcctagcctatccgtgtgtgtgtgtgtgtgtgtgtgtgtgtgtgtgtgtgtgtgtatatatgtgtgtgtatatatatgtgtatatatatatgtttaatgggatcatacttgttatatggcttgatctttttaattagggttttttttttgtattccagttcttcagtgaaagcattgtgtatacatctttgagtacctatgagaatatttctgttgaatagatttctagaagtgcagttgctgggtaaaagtttgagcaattacatttgtgattttgatggctattacctttataatgctgtgtaaccacatttaataatagcttaaaaagtgtagttaaaaagtttcctagtctgggtacaggtgcttggtcaagtaaataactggaacttgtagtgggtgaagcctatcctaggttcagttgatgcctcttcttgttaggtggttgatcacttcagacatccccattaacgtcctaatggatcttcatctgatgggtttagcatagaatgctcaggttgcttaacgtgtgttggtctgctgtctgccaggcattgtgctgcttgtaggggacagagataaaacaagctataaccctccttttttaagaagtacatagttggccaggcgtggcggctcatgcctgtaatctcagcactttgggaggccgaggctggcgaatcacgaggtcaggccaggccaacatggtggaaccctgtctctactaaaaaagacaaaaaattagctagatgtggtggcgggtgcctgtaatcccagctactcaggaggctgaggcaggagaaacgcttgaactcaggaggtggaggttgcagtgagccaatattgtgccgctgcactccagcccgggtgacaatgagaggctctgtttcaaaaaaaaaaaaaaaaaaaagtacatactctggggaagaaagagacaagacaaaattgtgagtttatattgtaccatgagcaatagccagggtgtcatgggggtgcaggtaagagcctagagggagggaccccacctcaacctgggagtaatggggaatacttgaaagagcatgtaaccttgagctgaaccgtgaaagagtagcatgagtaaaggtgcaggggcatagaagagccaggaaacatatgtttcaggtggctgcagtgaggacaggctggagatgaggtctaatgtaaaaaggggacagataatggtgtgtggggaatttggactcatccttactctagagtcagtgaaagattttaaatggttagatttaggtttaccccctcctttccttttttcttccctttctaataatcattttggtagtggacgctagattagaggcttgctgagacaggaagaaggaagaatagttgggagattattactgcctgaattactatagtacataatgaggttctgcactagggcattggcaccaaggatggaatgaatgtgcctgtcattctgtgtgttgccaaccctcaccctctgtgcaccacctcacctttcaaaattcagtcagtatgtcatcttttctagaagccttccttgaccccttcaggtgaaatacagtactttatcaagctaggctaccttcacacctaatttatattttactatcttgtatctggcatttagtagatgtttaaattaaatatttatggtaaaaagtaagttggtgatttgaggtcatgattaactcaaatagacaatgttgaggagcaggaggaagttttggatttggtgttggggcagggaatgggttttgaatatgggatgcttgaagtagttgtataggcaatgctgaattctactcatttctttctttttgtttttttggagacagtctcattctgtcgcctacgctggagtgcagtggtgccatctcagctcactgcagccgctgcctcccagattcaggtgattcttgtacctcagccttctgaatagctgggattacaggcaaagacggggtttcgctgtgttggccaggctggtctcaaactcctgacctcaagtgatcttcctgccttggcctcccaaagtgctggaattacaggcgtgagccacctctcccggccctactccttcccttccttccctccctccttccttctttccctccttttcttctctcacctcctctcccctctcccctgtctcctctctcctctctcctctctcctcccctctcctcttttccttcttttgagacagaatcttgctctgtaacccaggctggagtgcagtggcgtgataacagctcactgcgacctccacccgccaggctcaagtgaccctcccactatgcccagctaattattatttttttagagactgggtctcagtgtgttgtctaggctagtctcaaactcctcctgggctcaggcgatcctcctgccttggcctcccaaggtgctgggcttataagtgtgagctaccatggtaggccatcatttaaaaaaaaaaaattagtgtttttgtttgggtggcttttttagatgggggctatgttgcctaggctggccttgaactccttgcctgaagccatcctcctgcctcctgagtaactggaaatacaggcgcctgccactgcacccagctcctactcattctttaggtttcagcctggatgttcttttttctgaaaagcattttctgactccgcctacttctcagcctgtatgaggattgcctccatcccccaaatcacacagtagtgtctctctttactgctgcttgtcatccttgtatgtacttactgtggtgctttgaatactctaggcattttaatatttattggagatactcagtaggtagttggtgttctttgactgactttcctctaaagactaaaattcagaatttactgtcaggcagttaagaccgtttcagtttaagccttaaactatctagtgtagtagttaaaagcatcggctttagcattatggatcctgcccctgcaacttcatagttgtgtgatcatgggcaaattacttaacttctttgagcatctataaaatgaggacagtagtacttaccttacattgttattgtgaagattaagagaatatatgtaagatacttagcatagtgattgacatagtaaaacgctaattaatgttagtgaacaacatttgtaataacctatcctgcactcaggaatgattcctttagtaatataaagctttttcagttaagaagccctgttggccaaggaaattgataatggtcttgtgggtgacacacattatctctttgttttatagtaaaaattttgtctctccttccccattgtattccacaacaaatctacttttgttcatatgtaaaataaatactttgcagtgcattccataatgtagcttgcagtacttcatcacaaatcactgttcttttcctctctttctcttgagaagctgtacatataccacctgattcatgcaagttgttttgtggatcatgccccacgtctttcccattattttgattgtgtcaattttttgattcgtgtttcctcctttttctcttcttagtaaaatcttacacttgagggcaacccccacgaggcctttttgacttctctagtccagtcatttagggcttacagcacttactatgtaccaagctctcgataaagttagcacgctaaagaagggtgctgttaaggaattttgcttgtcttggaaatagaattagttaacaattagggaaaattcagataatttgaactgaatgacagtgactttaagtgcattatacaattcaagcaggaagaaagtgatatgaattggaagagtctaagaagtttttgtggagatgctatgtattgaaaaattagtaagtttggggacaaaaaaaaaaagtagaagaaggaccttccaggtagaggtagcaacataggcaaagatacggagttgggaatctgtggggagttctgggtccgtatcaattgatgtgcttgccctgacgttaagtttcatcttgaagaatttgaactcattaaaaaggtgtgaggggctgggtgtggtggctcatgcctgtaattccagcactttgggaggccgaggcgggtcgatcacctgaggtcaggagttcgaaaccagcctggccaacgtggtgaaaccccatctctactaaaattacaaaaaaattagctggctgtggtggcaggcaccggtaatcccagctgctcgggaggttgtggtaggagaatcgtttgaacctgggaggcggaggttgcagtgagcggagatcgcgccatcgcactccagcctgggggacaagagcgagactttgtctcaaaaaaaaaaaaagtgtgaggaacttgttcagagtaggaaagtgagatgataaaaaggtaaaggatagtttggggcactgaggcactagtcaggaagctgttgtgataatctagacaggagctgatgaggacctgggctagactgatagtgttagaagtatagagaggacataccaaacctgaaaagcttcgtgagaaaagaaggatttcgtcacaaaggagatgaaattatgaaggaaaagagagctttctttccattctttataagccatcatgtttttgtttgtcatatatttggcctttttgttagactggccccttcacatttctggatttaagctttggtagagactttgactattattttctggttgaagttctcattgcatcctatctggattattgtggtagcttttttattggtctttgccatctatagatgcctttttacttactttcaatccatcctacccaactgatctctctaaagcacagtctgatgtttcactcccatttaaaaagtgtttaatgatactctgctgtcattattttatatatacatatacatatatatgtgtgtgtatatatatatgtatatactttttatttttcagagactcgatctcgctatgttgaccaggctggtctcaaactcctggcctcaagcaatccttttgccttggcctcccagagtgctgggattacatgtctgagccgctgcacctggcctctgctgtctttgtttgtttgtttttgtttttgagacagagcctctctttgtcgccctggctgaaatgcagtggctcaatcttagctcattgcagcctctgcctcctgggttcaagtgattctcatgcctcagcctccctagtagctgggactacaggcacctgccatcatgcccggctaaattttttatttttatttttattatttatttctttttttgagatggagtctcacttttgtcacccaggctggagtgcaatggtgcgatctcggctcactgcaacctctgccgctcaggtttcagcgattctcctaccacagcttcccgagcagctgggattacaggtgcccgccaccacacccagctgatttttttgtatttttattagaggcgggttttcaccacgttggccaggctggtttcaaactcctgacctcaggtgatccacccgcctcagcctcccaaagtgcggggattgcaggcgtgagccactgtgcctggcccctctactgtctttaagtctgaattaaggctattaaaggctgtccgttaaggatctggcttcaaactgcctttccaccttcattctactatttcctctattaaaatatgctttgtgttttaagcaaattgttaatttttttttttttttaagatggagtctcgctcttgttacccaagctggagtgcagtggcccgatctcagctcactgcaacctctgcctcctgggttcaagcaattatcctgtctcagtcttccaagtagctgggagtacaggtgcgcgcctccacacccggctaatttttggtaattttagtagagatggggtttcgccatgttggccaggctggtctcctgatctcaggtgatctacccgcctcagcctcccaaagtcctgggattataggcatgagtcactgcgcccggcccaaattgttcatttcttttaaccttcagaatgtcgccttttcccacacagcgttgccttttcttatgccatttcctctcactagaatgccacattaccattctcttgtcctagccttttgcataatgacattttagctaattttcaagtctcagctaaaattgcggcaacttcatggacacttccctaatcatccttcctgctgtttctttccgtcctttgtgtagagaaatgaggtaatggtgaaggaagaggttagtagaagccacattatgggcaaacttttcttccccatctgatttttgcttttgctttcagtgcaagtgtggttgtaatacttgttggccacctggatgacctattccttcccctttgttctctgcagctaaatatttttgcaaggtggatgcttccaggttattcttgtgtatctggagtcttgtcttggaaattgactgggaataaatgaggttttcatttgtgggtgtggagttagttctgacttacagtatttgaagcagctggatacgttttgcttttgaaagagtatatatatgtgtgtgtataatctttaggatatggttctctgttgggaggtgtgatgttgaaccccccagctcccatatttgacatgtctggagacatttttgattgtcataattttcagaagggcactactagcatctagtgggtggaaaacagagatgttgctaaacatgctactgccaggatagccccctgtgatagattactcatcgtgagatgtcagttagtggttaggttgagaaactctatcctagaagtatatttttgcttcccaagtgccacttgtgttaggtagaagtttgtccttggaccgatggtgcaatttagaataatagaattaacataggaagggaccctagaggtcacatatttgaactttatcccaacttgtatttctcacaatgatgtttctgcttgatattaatagatgtaatggaaaaaggtgcttgttaaaaaagtttggtaaaggtaaacatttgcatattcagtatgatgcaatacgttgtgagtctccatctgggaagtttttccgaaatgtatttgcttgctgagtgcatttaacatcttccagaccctaaaatacttctttgaaactgagagagaaactattgattatctagcccaaccttttatagctaaatgaccttgaataggtagccttttcttttatctgtacaagcttactgcagaatctcaatttgtgtgagtgacagcaggtgtagcagctccatctgtatttgtcagattatagtttactaactgaatgaactaaaaattgggatatttggggcttgaatttttattctgaatgtacagtctgactttatccccaccggtaaattagaaattataatctcagccctaattctactgcccaggttgttatgaggattaatcagttaattatagcttttaaggctttgtattctttggagaaagatgatttatcagataggctgttgtgctgtttgtgtagaactgcttcctttttttgtttttcgtttttttttcctttagccctgagcttctctaagaactgcttaaatttgacagtctttccctgctttacattgtcaaagattgaagctttttgaattttgtaggggtcaagtgggataggaatcattgttttgctctgtatattaaatttaagaatgttactatgggccgggcgtggtggctcatgcctgtaatcccagcactttgggaggccaaggtgggcagatcacgaggtcaggagatggagaccatcctggctaacatggtgaaaccctgtctctactaaaaatacaaaaaactagctgggcgtggtggcggacgcctgtagttccagctactggggaggctgaggcaggagaatggcgtgaacccgggaggtggagcttgcagtgagcttagatcacgccactgctctccagcctgggtgacagagcgagactccatctcttaaaaaaaaaaaaagaatgttactgtgattttgttttacttagttattggctctttaagaatttccattgttttctttttgtttctctccattttattatagaagtaatacatgtttatggtggagactttacataagccaagaaacaaaagacaaaagaatcttaaccaatgactttttaaagcaaaattgagatgatactgtgttttgttttgtaactttttttcatttaataatgaagcaagcacttttctatgttagtaaatatagctctgccacacttagggttgcacagtattccattgtatggatatttaataatttaaccgagtttttggcattcagttttctttttattataaacaacatcatgaaatattaaaagtaagtctagacataacagggaaaagattaaagtactaaacttaggtggtggtttatggcaattgtagctaattgcaaactaggtgcattaaaaagccatggaaattcattccttctatgtttcctttttgtttccagtgtaataaaagtgcaaataatactgggtggttgctccaggtacgtggccaagtaattgaaagtatcttatttcatcatcatagcatccttgtcgggaaggctctgttacttgtagatgaggagacttaaagaacagaatagttaagtaacctacaggaggtggagccaggatgggaactgagatttgctcacttgagtcagtgctcctcttacttatgaatatctttgggagtaatgttgaatcttagcatagtatttcgagtcaataaaggtatgtcaagtcaataaatggtatttctttggtatagaaatctcaagatttaggaattaggaatgggaattttttcggaaaaagtggtcactttttcctgttctctgcactctctctcctcccccacccccttacttagatgattgttttagtaactacactatgctgtgtatcctatggggatattgagaccaaggataaagtgcaaatcaaataaactattgtctttgaagtgtatatgttaatgtcaagttcatagacatcatttcagagaagtcttggagtagatgggatttttttttttttttttaagatggagtcttgctcttgttgccccggctggagtgcagtggtgcaatcttggctaattgcaacctctgctgcctgggttcaggtgattctcatgtctcagcctcccaggtagctgggattacaggcgctcgccgccacactcagctgatttttgtatttttagtagagacagggtttcaccatgttgaccaggctggtcttgaactcctgacctcaggtgatacgcctgcctcggcctcccaaaatgctgggattacaggcgtgagccactgtgcccagctggagtagatgggatttaagccggcattttttcttaaagttgtaagctttaaagaattgaataatctcagaataactttgagaagtttactacttaagcaccttctgtgatgtgatgttaattatgaccctctttttcatttgtgctggagtgagcctgggttttcctaagttttatgtaagtcataaagcatatttgtgcccttgcttgggtcctcagagggaagctgtttcctgcccttgctaagtcttactgtagtgctgtcaggcagtagggtacaattactcttcacatgttgtattaatcatctggcactgataatatgcctccttgcattgctcatatcaactacatattgacattcaaaaggggaggagattgaattgatgggaattatctggtagtgattttcgtttgtccatgggaaaaaccctttgcatattataaaagtgactcaaaatatttttaacaactatattggtccagctgtcaactggtctataacacaatgtttaataacaggaattagtactgtcaactggtctgtaacacaatgtttaataatatattagtaattagtattatatttaaagttagaaatgggaaaagacaacatagaataatttgtgccacacagaatgccatatgccagaaagcccacaggagaaaactacataagccctgaaaatctagttcataaagagtgttggttaaaatacaaccctggaacaagaaacttttggtgttaataattatatgaggccaggcacagtggatcacacctgtaatcctagcactttgggatgctgaggcaagcggatcacctgaggtcaggagtttgagaccagcttggccaacgtggtgaaactccatctccattaaaaatacaaaaattatctgggcatggtgacacatgcctgaagtcccagctactcgggaggctgaagcaggagaatcactccaacacaggaggcggaggttgcagtgagccgagatcacgccactgcactccagcctgggcgacagagcgagactacatctcagaaacacacacacacacacacacacacacacacacacacacacacacacacacacagcaataagacagattcgacccatatgtatattggtgcttttatgaataatgttttctcagtcatttatttgagtatttttatgttaatgattcaaattgtcatactataaagaagcttactgtggtcctgtagggcctaccatcctgtgttggtattgctccaaagataagcatttttgattaaattggagattgccctcatttggggcagggaggggggtgcttagtccagtgatttcacaagcattttggtctcaggacccttttttaactcttaaaatttgttgagaacagcaaataaattgtttttcttataaactttgagaaatttaaaaaatatttaataagtaattcaggctgggcatggcggcttatgcctataatcccaggagtttggaaggctgaagctgggagtttgatagcagcctgggcaacaaaatgaaattccatctctacaaaaattcaaaaaattagccgggcatggtggcacacacctatagtcccagctactaggaggctgatgcaggaggatcacttgagcccaggaggttgaggcttcagtgagccatgattgtgccgctgcactctagcttgggtgacagagctagaccctgtttcaaaataacagcaacaaataaatgatttgtcttgcacttaaactttttacccatgcatgatttcctgacattcactggacattttatcgttcactgggttatgcagatcttccaaatgttacacattacattatatgcaatcaaaaattcacgttcattaatatcgtcacaagtctgttaaatcagaaatggcttttaaaatattcagaaagtccgaatgtggcagcttaggcctgtaatcccagcactttggaaggccgaggtgggcggatcatgaggtcaggagattgtgaccatcctggccaacatggtgaaaccctgtctctactaaaaatacaaaaattagccaggcgtggtggcacgtgcctgtagtcccagctacacgggaggctgaggcaggagaatcacttgaacccaggaggcagaggttacagtgagctgagatcataccactgcactccagcgtggcgacagagcaagactctgttaaacacacacacacacatccacacccaccaaataaaatattgggaaaatgtttaagttcatgattgttgatacaagttttcaaaaacactaatctttgcctaaaaaattcagattttattattggcagcaaatatcgtcagtggtcttccttgaagtgacaggttcactttgttcatttgcaaggaaatgtctgctagtgaagcaggtttcaaataatgtttgtcagtagttctgccaagtaaaaatcgtgttccatgaacaaagctctagttcattttgcaactcagttgtactgtgctttttcctgagaattcataaagcagcagagtgctttatgcatactttccctttcatcacaaagaatatttttaaaaaatgcactaaaggctcaagataattcataatttttgctgttcatcaaggacatcttaagtggaactcccttaaaaaaagaaaaactgagtggagagtataatgactattagtatagtttggtgcctcttccttgatttgtgctaataatgtaccagcagttttgttcacctttgtttttgtactctgattgcaaatgtcaacacagtgtaaaaggcagataatattctagtattgctatgaaaatacctttgatttcacgaacctccaaaatagcctgtgagatccccagaagtccagagaccacactttaaagaacaactggcttagttctttacgtatgtttcctttggctcccagaccacatagatcaagggggatcaaacagaggcaaatgactgagatttttagcttggttactaaataaaagcagtgtcattacttaaggtaatgaaacaggatgcggaatagtgtgctggaaggagaaagtgaattctgagcttcagggggcttgaggaacatagaggttataggaatcttgattagtgcagctcagaagtttttcttatggttaagaaacctcaccatactagtggttgttgagagagaagagggcagaagggaccttgtgcagcaccagcatttaagggtccaggaggaagagaagaggatgatagtacaaggacatcaggaaagaattagaagaaggtcggtattgtccagtgcttcagagaagtcagatagaatggggactgaggtttgaccattggatttgataataagattactggtcacctttgccagagcagtagggggtgaaatccagattatggaagagtgaagagtgcagagacagttatttatactattcttagagaagttttggggtaaagggaaagagagatatttgggcaattaagtatgagagagaggctgtactgagggcagaagatacttgagtaaattcctaggctgagaggaagaagccagtagagaagatattgatgaccactttgatctgaaagaaaagaaaactgatgaaacaagttggtattacagatgtggtacagttagctttgtagtataatctatacttctagagaagtgagaagctgatgaaaactggattccctggccagaaaaatgcacagacctgtgatatttggcatactttttttagtgaacacgggaattccttactaatttttttctgtttaattattgcttagtttgatgtgtcttgctttaaatccatttatttcaacaagcttaaagagatttttttttaatggagatgatttaattttaacaatctgtgattttctctgaatcgaacttgtgttttggcacctttcaatctgtggtaacaaatgacaagaagggtgcaattcttccttcccttgtgcagggattttgcctccccctttctcccagatgaaagatatttgggtctctagaataactgtggtacagttagctccagagtgttttctttctggaggcagtttagacaacagcctcaagtagtgcttttgttaaaaatatacatgtttttaaaagtgcttgtatttctaatattcttttctcctttctcttctag

SEQ ID NO: 91 - DNA, 25330 bp, Homo sapiens
  source 1..25330: mol_type = genomic DNA
gtgagtggccggcggggcccccgtggcgacccccatggcgacccccatcggcgaccccatcggcgaccccggccaggctggctgcggcgggtttggctccctgcccctgggtctgggtccggggccggcgctccccggcgggagtgctgggccgagaccggagagcgattgtacagcgcgcgggcaggaaggattccggggtcggggccgctcaggtcggggtgggggctccaggcccgcaggacagagacgtgcggccgccccagccccctcctcagcctgggaggcccctccccgcggcctctgcgccgaacaaagggccggccggggagggacggcggcagcgctgggtctggactctccgggactctcggggacccgcggggctggggccgcccgaccaagcgagggcgggggggaggggtctggcctgtcctccgccatcctcccgagccgctctccctcagactagggtgagcttctgggttcctgagatgggggaggggccctcccatgacccccccaccccagcccgggctgagcgcagctgtctgtcctgccccctcggcgccgacgcccctccctggccccgcgaaccccctcagctcctgcgctcagctcctgcgctgtcccatctctgcagccgccggccgcccccgtgcacatcccgggctcaggacccctccttggcagagcgaggcccgggggaggggctgcggcagacctgggacccccagccctgggcctggaaggggctgtcccctcttcccgggcgaggctcagggaacggctgcctcctggggcagggctggcggggggcggccgaagcctgcgtccgtgtgcacctgggtgttcgcatgtggaattgcacggcccgctgcgtgtgcggcctgtgcggccggtgtgcacagcctccccgcgccagggcgcttgctctcccatcccagctgaacaagggacccgctgagctccgggaccggccattttgtgtgagaggcattttgggatgggagtgaggggcagactggtcacaagctggtcgggcgcccacctgggccgagaggggtgtgtgccccacgagtgtgccccagcctgcgtgtggccttgagtgtgcccttagcagaccctccgtggactgtgatatgagagggttctggggtagggagaagatcccagagggaaatgccaggccgcttacagggagggtgtctccgtggagggcccctgggcacccagcctgggactccccaagcagaagcttctccgacctcctgggtcctggaagccctgtggcccccaggaggtgagtctagcttttccagtccagggttcattcccgaatccccagatgagcttctgtgttctcaggaatggcctcccctgatggcccccacctggctgggggccaaaggggctcttggtgggccggtactggtcagccaggtccctgcccaaggtgactccccggaggagggtaggatagaacccacccccacaaccctcctgccctgacagcctggccagcgccccgctctgcgtctgacccagggttggttctgctttgagtccatgatccaagggcccagcgtggctgttcctgaggtttcccgttgggtcagcagctctccgcatggccgccccctgcctgggcctgcgtgggtcagcccctctgtctctccttcctgtctctgcctcctgagagcagcagtccagaactggggcaaagcatggggacacttgcacatgtggggtctgagccgtctcttcctgaccacccccagtccggacgggccccctctaagatagagcagcagcatgcgggggcttcaggcgagaccctcaacgtctgaacagccccgccttccagcctgcactaggcctctcctcagctcctttgctgtgggcacggagctccctgaacctccctgagctcccaggctctcctcagctcctttgctgtgggcaggggtggcttggactcagggaggcggcccctttgggagggggattttttctaagcggcggggctggagagcagggtttctggtcctgcctcgggttggacactgggggctggtctcagaacctctgcaaacctcagttttccgtcggtaacgtcggcacagctgcttctcaacccagggctttgtgaacaccactgctggggggcatcacactcttccaggccggcccagtgccctctgtgaaaggggatgtggctcagcactgctggtgcagctcaccgcccggctcccagacccctggtgtggtgtttgctgctgtccccgtggcccagcccatccttggagtgcagcccccacctccacttgggaggcctgatggccccatgtcctctggcccggcatggactggcccgtgtggcgtgttaggcagcatttggtctgtttgttcatcagctaaacggagacggagctcagttgggcctggggcagccgggagtggggggaaggccagggctccttgtgctgccgcacccagctgtggctgaatacaggtccccaggcccacctgccttttgcctattgccaccagtgtctggcttcggagaggtcaagttgtgagaacctctctgggcatccctgttggacccggggtagccactgtctggggtagagagggcggtggctgctgccccatggccccagggcttggtgggcgtcaggccaggcccctgctgcccccgctctggggaggtggggacgtccagcactgagttagagagggacttcatccactgttgctcctctgtgggagccgtggcctctgctcgcactgcctgggtgctttcccagaggctctggagacagggccttctctgagttagaagggcgtcagacctgctctctgcctggtcggggcggggtgctgggccacctctcccagacctcccaaagggagtgtgagctgcagaaatggcccgaactagcagatgatgtgcccctggggctgccgcaggggactctgggccagatcaccatggggggcccttcggagcctgaatcccgggctccagcctctctcctgcagcccatctgcgcataggactggagccgggcactgctccaccacggagttgaacctcctcgtccaggatccccgcgtgggttgctgggtgtgggaaagggagctccgctctgttcccgctgggtgcggacctcagttaccgcttagttacagcctgccagagggtcacgcagcctggttcctgtggatggggaaactgaggcagaggaaggttgagtgagctccagagttgtcctgcttaactgaaagggggggtcccagcctgagatgagagcttgggggtgcagattgcttgatcttgccagcagcccagccacgtggagtggccagagtgaagctgtgtttaaaataggccagatgggaaatctggcaccggggagggcctgtccctggggctcgctgtgccatcctggcttttgcgccaggcctcagctggggtccagggttttaggggcctctggccctgggctgcttgaccaggtgctgtgtcccatttcactgcagggaagggcctgggacggagggcctatgttcaagtcccccggtgccggggcccaggcgcttcccctcacagtcctggagaactcgggtggtgctgagcacaggccgctgggcctctttcccaccccttcattcagctctggggctggtgtgagccctcgaagggctggctggggtgggcaggcgcctggcacagtggtggggttcagacactctcttcttggtcaggctgctttgaggggtgagtgcaggcctgggctttacccagcacagagcggggccctggcaggaccagggtccagtctctgctgacggagcattgtgtgccgagaaagagactcgagtgcttgaacggccacattccccttcttcccacagcctcctgtgtaggaaatcttatggaaatttcccaaaaggtgaagaagcctcggagagttgtggtttctggggaaacctggatttctctggttcctggaccccttgggaggtctcgggcttcctcgcaggatttctgcccctcaccaaataatttaaagtgaaattactctggagtgataagacattgtacatgatgctgcttagttacacagtggagtcaatctctgtgcacattctgtgtctgtgagaggataggagctaaaggataagcagaaactctcctcctgaccattccacagtgagagcagagaaaatctgttttattagaaatcactgcaagccaatctctgcagagacgcggtctctccagaggtgccggcgccctggatatgggcactgctgggcactaaggattctcggcccccaggatgctgaccacgtgggaatcctgtctccagttttgaaaatgcttaaatcctggagtgtttcagaactggggtcacttctcacggcacaggctgagtccagtggtggagagtggcttaacatagtgattttcccagtttgttttagtcaataaacaaatgaatctatggatctccgttagtccctgtgctcctgacacgtccatggcccctgtgtgcacactcagcaagtccgtctggcagctgctcgcaagagcacggggctagcctctgccctgtaggagtgacattccatagcctcacaggagctgggctagcctcagccccataggaatgacattccacagccgtagaggagccaggctagcctcagccctgtaggagtgacgttccatagctgcacaggagccgggctagcctcagccctgtaggaatgacgttccgcagccgtagaggagccgtagaggagctgggcctgaagctgcttccagtgtggggagatgaatctgctacacagagtgggttccctcctaggaaaatgggcaagtctggaggaccaagggggacctgtgggggccttgaatatggggagaagggatatgggatggccgagctgccttgcccagaggcaggggaggggcagcctgtgccctgggccctccgaaggtccacttgaggtttgacgggaggctggggccagcggccaggccgtgtcctgttaaaggctcaggcgggagcaatgtgcccgttttgggaggatggggggcaaggatggtggggtgatgcctgcgatgtcccccgggggagaccttggccttgtgtccgacatcttgtcatcacagacagagcccaagcgtgttacctcacggggggctgtcttaactattttccagtgtgcatgccaggcagctctgagacgggaaactgctcgtgtgtgcgcggtctgtggacgcagccccgctcccctctgtgcttccgcccgtgtgagacgtgctcctgtgtggccgtgacctgtgaagaccctgcgtgacccgtggggcgtgaggctcggggagggcagggctggggctctggccgggggcgtcatcctgagactggccagcgtcgggctcctagacccgagtttccttgtctgcgtggtgggggtaacctgtctgcatctgtgtcacgtgatggccgccgggattcaacgtgtgagtcactccacacgatgcctgatgcgtgcgatgttccccaagctcgtagctgtcatcgccgtgaccgtgaggctccttcagcagagtggaaggcctcaccccggacggagcgtggaggccaggagggaggatggctggccggtccgggacggcgtcgctctgcccctccggccgattctcagtcccattggtcagcggctgggccgtgacggagaggcctgcgctgctgttgagggccaggtcgtgggttgaagtgcggggcccgggctcgagcgtcggaagcctgcgggggtcgtgggttgaagcgcggggccccggctcgagcgtgggaagcctgcgggggtcgtgggttgaagcgcggggcccgggctcgagcgtgggaagcttgcctgtttgtcgtgtgggaccggccgcggagatgccggctgttcacttggaacgaaggtgcctgccctgtgtgtgccgggtagtttgggggattgtcttcctgttcgtggcttccggcgtgttcccagcatcctgagggttgaggcttggaggacaggaatgatcttcggcttgagaaaccactgtgggcaggttttaccagggaaccccttaagctgtgaaagagctgcagtgcaagcttctagtttccacgcagaccgcgccagagaacccgccgggccgcctcgggacggcagcagaggacccgccgggacgcctcagcaccgacacgcgcccagccatgaggccgcctttagcacggagcgtcgagcggaaacggcggtgcccggaacgcggatgccctttgcagggctggagctcagctctgccttccgacaacacttggctgacagctctgggagtctcaaaacggtgcctttgtggaggggagggccctggacatcctcagaggaggaagcgcgtcctgggtagggtgggcggcacctgttcaacacgcctaacagatgcaaggtcgaaggaggaggggcctgcagatctgagcttgtcgccgaggaactctctggaaatggctcccgctggcccctgcgtgcgacccctacgctcaccagcccgtgtgccgagctttctctgttgatttcggagtgggttctggttcctgcctccctagtgggctctgagtggcagggccctgccgaccgctggcctcagcagcgggtgatggagtgtgggccctgcaggaggaggctctgtccttgatggctcctgggtgagggggtgtgagggaggcggccagcacaaggcgggtgggccctgagaagcccctctgtttcccctttagcctgagaaagctgtacccacagagctggaggagggagtggctcaggatgctgcttagcaaataggttggtctggagtctgggaaatggagggttagactttttgttttctgaagctgggatgggtcgtgcttttaattcgtccaggagaacatggggctgaagagctctctgctcttgtggcccctgatgggagtgctctgaggtctggcaggccacagagctgctgggacggcctcagccccaaacctgcgcctgtcgcttcccggggccaggccagaggtttcccagtgagagctttggggtcgacatttccaggaggagaaggcacttctgaaatagcgtgcccttggtgagcttgtgtggcttttctttctctgtaacctgctctgagttgtcccattgagtgttctggggatgtgggcatctggagcctgtggagaggacgggactgggggtgcgtgggggagacgcccctgccaaggacaggggagaccccctcagtcccacctgggagagtctgtgcgcggggctgtggttgattggctggcaagtttgaatgcggatcaatgtgccacttgtttctaagtcagcagggcccctgcccccacacactgagtggctggattctgggagccttttcctgtggagagtggagctggagtgtggggcgcagggccatggccctgttccagcgtcggggagctagtgtgcaggtgctttctcctgttagcagtgggcctgtgctgtgctccctgtggggttaggcggccccggtgggagcttcagtcttgaaaggggctcatagccctggggtgcaggctgctgtgcgtggggggcatcacacgcaggtccccaggatgatgtgtggtggaggacggggcgacgggagctctccacagagcttcatgtcccttctgttgtctaaaccacagaccccgtgccaggtgaggggctggggtgggtgaggctaaggtacctgccccgaggcctcggggcacttggcggcccctccacccccacaggagacatcggcttgagtggagaggccagcctctgagaaggcttctctctggccaccagctgcccagagctcccagcccagggccagcagcttgtgctggccccagacaggggatgctgggcggcctctcgcagggggagtggtggttttcagacagtggctgcctcgctttggggatgaggatgttttccagacgtgctctggaactgacattaggctctgctgcctacccagcttgaacaaaattaggtctttcatttttttgggttgctgggaatggctttgtggatgcataggagagcatggttgctccaggaagtccggcggggagtgggttgaacaatcggagtctcccatccctgaatcatctcagtgggggcggacgggcagctcctgggggtgtggcaggggctgggctccaggctgcccagcctgcagggagcctccttctagattcttcctctgtatctgtggcgtggaggcatctgctgcctctgtctgcccccgcctcatcctccaggtcttctctagttttgttcctccccatggagcccttacccgtgacgtaagctgaacacctgagaactttcgagcttgcttttctgtttaggtttggaaaaaacatgagaagggtgagtgggagcaaaaggccagtttctgcctggctccctgtcctgggaggaggtggggagaagcctcgggcagggatgagaggttgggatgtctgccctgaggggctgtgggcgggaggccggaggcgcctggttaatgtgtttctgcccctgtgtgcgggtgcagggttctaagctgggactcagggtgcagagggcacgtgtgtgggactttaaagtttgtcatggaggctgagccctggggaagggcagcagcactcggccggctgggcttccttctcctggagtagggtggtcagggaggcagggatatcggggagcgccaccccaggacggagcaggaggcagcctggagtcccctttgtagaccagataaggccaggcagggcctgatgtccgtattctattatttatttattttaagtgtgggggtctcgctctgtggcccaggctgagtgcagtggtgtgattgtagctcactgcagcccagaactcctgggcctgagcgatcctcctgccttgacctcctgagtagctgggagatgacccccttcttacccgttcttccagaataggtcaaattcacatgacatgtgcacacacacacacacacacacacacacacacagaaaagacacccacggaaaccctgaaatatataaaatgatgtccagccagtatgatttgccccctctgcgctgccccatctccgtaccgggtcagccatggcccatctcctggagccgttctctgcatgcgtgccacggtacagcatgtgtgtgtctgtgtgtgttcactcacttcttttcacatgtgtggagtcactccgtgtcctgccttgtgcgtgtggccccctctccctgcatgtccccctctaggctccgtcgggcgctcacgacttctctgaccggtttgcagtgatggaccttgaagcaggtgctaggactttgccgctgcaaatggtgctgcgtggggctccatgcacatcttcacgcaaggtgcaggtcggcaggatgaattcctagaagctgcctggtggctgtaaaaatgttctcatcccaaaggaccaaatatgcagagaagtttaacactcacttttcctgtcattgaaaagttacatttttgtggaaacccgtccaggctggagacagaaggtgtgtgcagggagaggaggctctggggcaccactctaggctgcctgctgctcaggtggttgatgtgggggcagatgccctgttccttggggtaggtgccacctcctccctgctccctggggtaggtgcattttcctccctgctgcctggggtaggtgccgcctcctccctgctccctggggtagatgcagcctcctccctgctgcctggggtaggtgccacctcctccctgctgcctggggtaggtgcagcctcctccctgctgcctggggtaggtgctgcctcctccctgctgcctggggtagatgcagcctcctccctgctccctggggtagatgcagcctcctccctgctccctggggtaggtgcagcctcctccctgctgccccggggtaggtgcagcctcttccctgctccctggggtgggtgcagcctcttccctgctccctggggtgggtgcagcctcctccctgctccctggggtagatgcagcctcctccctgctgcctggggtaggtgcagcctcctccctgctgcctggggtaggtgctgcctcctccctgctgcctggggtagatgcagcctcctccctgctccctggggtaggtgcagcctcctccctgctccctggggtaggtgcagcctcctccctgctgccccggggtaggtgctgcctcctccctgctgccccggggtaggtgcagcctcttccctgctccctggggtgggtgcagcctcttccctgctccctggggtaggtgcagcctcctccctgctccctggggtaggtgcagcctcctgcctgctgcccggggtaggtacagcctcctcctccctgctgcccggggtaggtgcagcctcctcctccctgctgcctggggtaggtgatatttctgccctcctacctgattaggctctggggccactcttggggatgggggaggagggccggcccccggggtgctggccatggtcctgaccaggagctgcagttgcggctcctcgtgggccagaggatccccttgtgtgattcttgtttggcatccgcccaggccatagagtcaggggcttggctcacctctgggcagctatggggaaggggctggtgtttgggaggtgcccgaggaatgatcggtggggggtggctgctggggcaaggtacacgaccggcttctctcctttacaattagcactgagccagcttatctgagaccatcccttcccacgggtgccatttaattagccaagagctgagttaagatcacgtgaagaaagttgggggggccttggcctgagcggcgggtggacagggctgcgtctgtcagggtgagggggtctggcggcccctgccgccctcgtttcttaaataaacgtttggtcgtggcttattttcttctgactgcaaagtaagcacatccaccgcaggagactgggaaagcgtggaaaacagggaaggacgtttgctcttcctggtttctttccaggtgtctgcgcccgcctgtgcgtttctaaacagaataggattcaggcggtcccgtcccgctgtggtgttaacggcatactgtccacacttctcatgggcaagatgagtctcgcgtgccaggtagttggcttgtctctgacctggggctgccgcagcacctgtccagccacctgtggacatggatgacggcagagtccctgtgttgtgtggtgtccctgcgtggatgtcgacaccacagctgtcctggggacgtgtccacatgaggcttggggaatccacatgtgtcccatccagggctgtcctgcaggccccgggtctgcctgaatgtgattaggtgatgaggccaccctggccaggaaggctggtgaggggagagggaggacgcaggctggcccaggaggggcttgtgttggaacgagattctttctgtggggtgagccctccgtcgccggaggtgtgcaagtggaggccgagagagagcactcactaggacgtttgtagggggccagggactggagctgtgagccgtggaccagctgagggcactggcctgcttgggagggggttaggcgtggctgtctcagggggctgtgggggggaaggcctgctgggagcctcggtcaggagtgccactgttggggtgccctcagcacctgaatgggtttcgggtggggctgacaggcagcttgagcccatgaagggagtgtgggatgtctcaggaggagcccccttgttgagggtggggggagcccctctccaccccagctcccctgggacctcatgaagcctttgctccccaaagctgctaagggcttgggtaaggccagggagggacctgcagggtcaggagcccaggccaggccaagcaggggtccccaaaggtgctggggatgggggtgtgcatgacagggaagctccggggctcgggtttggggaggagtaggctgggctgggatggggacactggccagggccagagccaagcttcagccacagaagaaggggcgattctacagctcacaaggtccccgggtgccgtctgcttcctgtagtgtaaacgcacctgtccacattccagccttcctaccgagacaacagcaccatggactggaggagtctggaggggacaaggtgtggtgagtgttaactctccccacccaaagctatcctattcagagagaaactgaggcacaggtgggtggacaccctaggcacagagccactgatgggcaggcaggttacctgtgtgcgcttgctgtcccagaccttgacaacacggtttattttgttttttaaaaatagaggttaaattatcctaacatgcagatagcattttaaagcgagtaattcagaggcgtttagagtggagaatttagtgatggtctgccgccaccagccctatttgaaaacttgtcaccccatgtggacactcttgccctctgccatcgtgtgccccaccctgtccctggcagttgccggtctcctgcctgtctctgtgacgtgcctgttattttattttatttaatttatttatttttgaggcagggtctcttttcgcccaggctggagtgcagtgtctcaatcacagctcactgcagcctggacctcctggactcgagccatcctccagcctccgtctcccgagtcgctgggactgcaggtgccccaccacatctggctaacttaaatcatttgtagagatggggtctcattgtgttacccaggctggtctcgaactcctaggcccaagctgtcctcctgcctcggcctcgccaagctctgggagtacaggcgtggccgccgggcctggcctgtttgcttcggatgtttcgtgtaagtggagttgtcatcgtggtgccgttttgtgcctggctttccttgccgagcctgccctcaggttccttcgtgtttagggtactccttcatcctctccgtgtctgggggccgctgcctcgtccttcctgtggccgcacggacggacctcagtttatctacccacccaccaactggatgttgggttgcgtctgccgtgaggctgctgtggacacgcggtgagtgtctctggacatttcgtcattcctcttgggacgaagcctgcgtcacatgtggccaggtgccctgggtgggccgtgccctcctcatctcagccccccagacccacacaggccccctcccggagccctcgccttgctcttcccgctgtgcggaaggtggtgcagtgacgcctgagtgtgggccccaggcctagctgccagcctgggctctcgagcaggttcaacttggccagggcagggtcttggctgccgcctgcctggatgtggggagacgcctctgtgcaggttctgggctgggcacttggggccactgtctgagcagaggatgtggggtcctgcctccgggagggcgagcagaccgctgctctggggggacagtgctcggtcaggctcagggccctggagagaatacaccagggagacttgggggctgcccggggaagggatggtcgggcagcctttcagagaaagtgacctgagattgaagcctgggggatgagggggcggctctgggacctgcgggtaggagaggattccaggcagcaggaagtgcacgtgcaaaggccctggggcagggacggcgtttgccgagggcaggaggggagcagggtggatgggtcgcgtggggtccaccatgaggcactgcagcggcctcgagggccaggccagggtggggtctatcttcagggcctggggctcgcctatgctggctgccattcccacccagcttctccacatgcttctgggatcaaagtggctggtacaggggcgcttctctgcgggctcagtgggttgggatggggcagtggagagtgggtagccggggcatgccgggaggaagagtaaagtccaggggaccccaggccaggggctgcgagcccagggaggttgcggggtcggggagggcgggccaggacctctgcatggggctgggctgggcactttggccagccctgcttggtgcaccggctgggtctctgtccagcacctgtggtctgggtgggacaggtgactaatggagaacaaatgagccctgcggagcttccgtctccagggaccgtgagcaggcgctgcgaagtcacgaggcagtgcccggggagctgatttaaccacgtgctgagccagcgggtttcctgccagggcctgggagtctgcccacagctgcagctcccagagcccctggggtgcatggcggatgccccctctttctgggccggggcgaaggccctggaaggacctgtggttgctgcagcaatgcagggggctgggggtccctgtgggccttgggcgtctgctgcgggagtggttagggagcaacgtgcaggtgggcaggacccccgcctccagctcctccactcctgttcccgagggagccacagctggctgaaggaagtggccatcctggggccatggtcagtgtggggcatcgagagccccctgagagcgcctccctgcccaggatgttggaaggagggctgtaggtgccaggtgggtgcaggcgggcataggcaggcccaggccgtttggaggccgtgagcatcaggctagcagctgggccttctgaggacctgagacttcctgacctgtgtcctgtcagggtccagttgagcacccagtgtttgggaggctcggtcccacctgggtcacctcccgtccctgccccatggccttaggctcaggtgggtgctgccggaagctccgaatgagggtggaccctggcctggcaggtacaagccacgcagtgctcagcatgaggcggctccacgcgagaggtctctgtgtgcagctctgcaggagcgtggcccttgtcccctccagccccggcggtctgcagtgatccatcacgcttggttcatgcccggttcacgcctggactctgtcagcggcgcccgcgcccgtcacttctgaggtgggaggtggcgtgtgtcctggaaacagagcagttcattagatggtgaaattagattccaggttgcagcgtggcggctgcctaatggacgaggcgagcggggcccccagggaggctcgagcagtcctggacctggtgcccactccggcctcacgctggctttctgctcatccccggggccctgctgggctcccaggtccccagccccggggaggtgcagcctcatcagcatggacattgttctggacagggaatttctgcctaaggaggctgcgtgggaccccccaggaccccctgcagtgggagaggggtgcatggtgggggccgtgcagccagccagctctggccaatccgcacgtgggcctctgagagtctccggagcctctgttttcccgactgtgaaatgggcacgtgactgtagggctgcttccctcctggcaggtcatgggtgtgctgagaagcttagcccgtggagtgggagtggggtcttgatgtcaggggcccctcctgacccaaccctggctctgtctgaggcaggggctgagggtggcggtgaggtggtgacgccttccctcctgcccgcccatccttcacgtgttccgttttcatttaactaaatacgcaagatgagatgaacagccctggccaacttggagtcagcctctggggaaggggcctgactggaggatccagagtcgcagagcgagggggctggctgtgggactgactcggggggcccagacccctcctgcgtcgagtcctcttccccaagtgcatgaagcgagtgaggagcggggtggcggcgtctgtgtcatgctttcccagaaaagaaatatccccttcaaccagaatggggaaggaaggcgggggagacctggaagcacaggagtctcccggaggtggggggcccatgagcagaggggtctcccggaggtggggggcctgtgggcagaggggcctcccggaggtggggggcccgtgggcagaggggcctcccggaggtggggggcccgtgaagcagaggggcctcccggaggtggggggcccgtgagcagaggggcctcccggaggtggggggcccgtgaagcagaggggcctcccggaggtggggggcccgtgagcagaggggcctcccggaggtggggggcccgtgagcagaggggcctcccggaggtggggggcccgtgagcacaggggtctcccggaggtggggggcccgtgagcagaggggtctcccggaggtggggggcccgtgagcagaggggcctcccggaggtggggggtccgtgagcacaggggtctcccggaggtgggggccccgtgagtagaggagtttttgcatctcaaggcctgagggtgccagcgtgggggccccaggactgtggtccggccttaactgggcggtgggggccccaggactgtggtccggccttaactgggcacccctctggcctggtgaccctttggtccctcccatgggcccctccctgccccaacttctcctctttgcacttgggtcccaggtcccaggaggagatcccccgctgctccatgctcagtctgtgactgcattcggggtgcctgatccccgccatggcctctcttgtgatctggggctgtctgatgggcacggggctgggctgtgcgtcagggacgtgcggtgagccccagccgacgcccgcggtccaggtgtccccctgcccctctgctcagtggtgggtgccagggctctgtggatcctccctgcccccaccttgactctttgcctgaatctggggctggggaccagctacttgccttatctccttggcaacggctgccagggaagctccggaagttgaacccattatcataattagcttcgaaaccctttgtgttgtaattctgggctgcagagaagctgctcggtcctcccatcgtcctcccagcgtcctcccaccgtcctcccatcctcccatcgtcttcccgccgtcctcccctcatcctcccccattctcccgtaggaagtctcttctttcttttcctgcagacttggccgctgcctgggcaggagggggcgggcagcccttgccgagccagcgagacctcagctgagtgccccgtggtgggctgtgtcccccagcttagtgcaggaggggctgtacccacactgtgggcctgggtctgaggtggtgatggccccgtcccgagaggcctctggcagctggccctcagggagtgtcccacatttggacgctcgtcgtgcctgggaccctgaggccacatgggcagggagtgtgtcccagtgttcccggggagcctcctctcccgaggcctgggggatgccatcaggggtctcctgccgccctctccctcccctggttcagaggcagaggccctcacctgcctcagtgagcctcagtttccccttctctaagatgggcatgagtgtggatgtcttggggacaccacggtttgtaggcggaggcctggaagcccctgtgtcttccccacggttcggccgaccggatggctggccagtgcgtttgggaactatccgcagtttggaggtttcttccctggtctgtcctggggcctggagccacggccgaggcaccgggatctttgcgtcccccagacgggcccagacgcaccccgtgccgcctcctccctcctccaaggctcttctcgcacgtccgtctctctgcctcccctgcaccggccgcccccggcagcgccatctgtgccatctgttccaaaaacttaaaaaacaaaagtcggagctgttgcctgcactttccgggtggggctgtggcaggaggggcagcggcgggaggggcagctgcttccttcatgcagggtctgcgggccggcgaggcgggggcagatgggcggaagctgagctggaaggagctggagccttctgagggcctggctgcgagattcatctccctgaattctggctttattcctcctggtccacgcctgctgggaggagccacagatctcggccgcatccggctgcattctgtctccagggtttctggaatgctctgagatgcctggtcggagccaccttaggaagcaggctgagtcctgaacatttgggacctgggcctcgttttttttagtttagaggaaggttccctgcagcccgaggagctgccttcctggatgcggcactgaggactcagaattcaagtctgtggggctgtcgttgtccccaccccgccctgttctcaagtctggtcagcctcatcctcggtgggatgcagatacgcctgcccttctctcgccaggcctccccagcggctcctccctctgctgggaatgcccttccccttctccccctgtggccaactcctctgtatcctgtagcccccccgcccctgtacacgcctcctccgggaagcccacaggattatgtgcgtggctctgctgggctgagctgggtccctgagcccctcctgtgatgtgtgatgccctctgtgtccccgcggcgcccctcctgcctcccaagcctctgggctcctgactgggaagccagggacccccgcgtcctcccctgctcctaccccgctgagagttcagagaaaaccccgttaggcagacagaggatcgcccgcagaaggcgcacgagatgtctgcgcatttttcccagggctcagttaattgaagaacttggccaacgagcacaggaaattaatcgcggcttggaaatgggacgtcccttgcgtatggtttgtctgcctgggcctcggcaccactgccagcgcccctgcctggagccgggagcttcggggtcctggcggaggcctctgggtcgcacacgtgggcggggccgagtgccccctggcgacggtgcctcagggccagtgccttcgagctggaagccgtgggcctgtggcggcgggcggaggactggtgtctcctggggtgcccgacacagggccttcctggtgctgctgtgccgacgtccaccgcggggcggcagctggatagggcaggacctggctgtggcttgtggtcttgggggtggcggggaggggtgcagcgtggggcaggctctggctcttggacccacccggcctccacacgcggtgctgcgctttgagcttctcactaggccctggaccctcccctcagcctgcagggactattcttcctggaagcccccgccccaacccctgcccctgcagctggagctccggctggcgcgtcgtcccgggctgaggcattctggctggcctgtgtggaggctcccagttcccacgaggagggtcccggtggggcctctctctgtggctgcaggccagctggtggggtcctgggcaggtgtgtggcctggacctgccctggagccgagctgccggcgagagacctggctctccccaccactgtccttcagcatcagtcagggtgttctgtgcctgcaccgctgaatcagcccgttcctgctgcagtcccaggcctctggccgaggcccctgtgtcctctcccagcccgtgatgcccactgtatgcatacactctgtatacacgcagctgcgccatggtgcccggctggtggccacgcacctgcctcgacgctgctgtgcaggtgtttttcggcatgaacacttagctcagcggacttcaagtgaagctagtgaccctctgccgtgggggtgggcgtcgtcccagcagctgaggccttgagagcaaagactgaggtttccggaagaaaaaggattttcctcaagaccgcaacatggaagtcgtgctgagtttccagcctgctgccctcagctcagaggcaggcactggattacagcttctcaatggcatggagctgggacgtcctcggggtgtacgtgggtagaatctgaacttgggctcacgctagagatgctgacagttttcacatgagacgctttaaaatgtggctttggcccctgcgccttcatctttggtttgggtgctgggccagagccttcacaggcacagtttctgccgccgctgcctgtggctgagcagtgccaggcctcagttggctctggtgctggaatgggcagttggtggggctgaccttggccgggccgcctgtgcccgaagcctccacctctgcttcagactgtgtggtcccgggtgcttctgaagcacggccgtggtccttcccggggcagatcttgggaggaccaccctgtgccccgccttccctgccctggacgccctgggccgtgcagcagaggccgctgctggggagtcggaaggtggagctatggggactgcgcctgcccaggccagaggactcaggctgcctggacttgggggtctccagcgagtgggaggggggctgcagggggccatgctggcctccccacatccagagggtgttcagtggggagatgactgggtccgggcagagggaagccgtgggggtgtccgtcgtgaatcgagcctggaacagcatggccaccctcttgttcttggctgaagggagcttgcccaagtccccaggtcctggaggcactttgcacacaggatgggcttgacacgaggtccacgcgggtttgtgtctttccacagggtcaggcttttattgatgctgtttcaatcacaaaagccacgagctacgtggagtccccaagcaggcaggttctccctagagcttctgggtcatgctgcggtcacggccactccatgttggtcagtgttgcagaccgtatattgccgtgtgctcatctggtcaaattccactttccacccaaagccaggtttaacatcatgaggaaaaagacacaagacagagggttaataccagcccagaggcctggcctgggctgctgcaggtgactgtgagacagcggcggtgaagacagaggcctccagggagaactgagcacggaggactggcttgtgtgtgtccttatctggttggacttggtcttcatttttttgtttgtttgtttcttttttttttttttttgggacagagtcttgctctattgcctaggctggagtgcagtggcatggtctcggctcactgcagcctccgcctcctgggttcaagcgattcttctgcctcagccttccaagtagctgggattacagacctgcgccaccatgcctggctaatttttgtatttttagtagagacagagtttcaccatattggccaggctggtttcgaactcctgatctcaagtgatctgcccgcctcggcctcctcccgaagtgctgatgcgtgagccgccatgcatggccaggttttcttcttttttgctttttggtttttaaacagacatcttatccttcttggtagagtgccctgtgagacaaaatggagtcttttcctaagatggagttagttatgccaagggctctctgcacaggtctgccctcccctgcttccaagcccccgcagcctcggctccacagacgctgctctgccagctctcacctgggcgcctgccactcttgttcaaccttgaccccaccttgaccctgtgtgacctctgcgctagggatctcctggcttcccccacccccagcaggtcttcccccacccccagcagtcttcccccaccccccagcaggtcttctggggctctgcccccaggggtgactgcagcgcccagtgctgcctcagggagtcctggcccttgcatggggcagccacagcgtcccacacctggggcagccccagggccctgggagcgggggcaggcatcagtgctgccttattcctggaagcctaaagccacttggggagggagatccagccctgacctcatgtgtggtggccttgctgggcctctgcggccgccctcgtccggcacgtgtgctgggccgtgacctctggaagagcagccagggtttcgtctaggtccctccggagcagtgggaagagggtttggggcacttcgtccctttgggtgagggaggggtgggggaggagtggtggtggaggtgaggggcctgtaagtgagggacggggtgaggcggggtgaggggcctgtaagtgagggagggggtgaggcggggtgaggggcctgcaggggcagaggcagtgagctcgtgtggtggcgggcgggttccaggggcgcaggcagcgcagggttgtgtgctgggtgtgggtgctggtgatggcactgatggtgcgggacggggtctgctctgagtgctgtgtgtcagatgtgggcccaattacgtgctccaattgctgccaccacccagtgggctggtcctggtttgggggctcagagcctgagcctggggtgatgggggccccgggtttgtgcccggatggcctggccctgtccttctgcctccgcggccaaaagtctgagaagtctccctgcaggccgcagacactggggcttccctcttccctcttctcccaggagctcagacgctggggcttttccctcttctcccgggctgtggagctcggcctttggtgagtccctcctctctctgcggtgctccccaggggctctcccacaagacagtgaagccgtgagcagagtggggtcctcttcccaccaggcaccacagccaatgctgacctctgctccccaaaccctccagaccctccaggcactgcggccaacgctgacctgtgctcactaaatagctccgcacatcgaggacttgttttttcctttttgatccgtggcagcttgtgtcacagccgcgtggcttgtctgcccagggaggagctgtgggtcagagtagcatgtggccacagcatggtggagtcaggcgtgggctcgcagcagggacacaccgatgtcagctgctcatagcgtgaaaggtcatggtcttttatttgcaaggggcagaaaacaaatgcaaagggttgtaaggaatgggcttacataacctggaagtccaaggggcttcaggcacagctggatccaggtgctcacattatgtgtcttaaggcctcttctcccatccttctgtgctgccttcctcatgacctcatcttcaggcaggttttcctgtgcccacccgtcctcctgccagtgccccaggcctgcctcctcctagttggcaacctttgtgggaagggggtgtcttattcctggtagttccagcagagattctggggccaccactcgctggccgtggttggccagcctcgatcccatgagcatccctgcacccccagactggaaaggaaattgcaaggctgagacaggaggggtgggtctagacaggtgctgtgatgctccgaagctccaatgatgagggggcgtgaccagtctggagagactcccccccaggatgcccatgcctgtggccagtgccccggcccagcaggtcaggggtgggcgtatccgggctggagggacttcccccaggatgcccgtgcctgtgcccagtctcggccctgcaggtcggggcatccagggaatatttcctctgtgggagtggggagaggggagcggggacactgcccggaacccaggctggactgcagcactgctttggggacagagggaaggagatcctgagtgtggggaatctccctcccttgacacccacctggatgtgggcgccggggaagggctcgggtttgagacacaggagggccccacaggctccgtggcggtcgtgtggtgccgcagggtgtgcaaggtgatggcgagtgtgaagacagtacaggggcgcggacacggggaagcggctgctctgtggctccgtccccgccggctcctggttctgagcacggttggaacgagaggcagcaacacggtcaaggtgaaggcgtctctcacattgcctggaatgagggcgtgtcccacgcatggcctcctttatggctgtgacgaaggacctggacgttggacacgtccccttcacatcccagaacacctgcgaaaaatgtaaatgagacaaagcatttgcttcctgcgaagtgggtttctctctggtgtgcattcagtgacttcagcacgcgggagttggctttcctgccaaagcggcagcttgaggctctgggttgcacagctttgctcccaggaagagctgggagatcttctatgtctcttctatgtgggtggccttgttgcagccacaagccgggttcccgcggcagggtcttcgggggctagcgggctcctcctgtctgcagcttcctggggtgggcaagggagcaagtgtagcagagtcgcttgtatcagaggagaatgcagggctgagaaaaagtcacgcatttgggccgagcatggtagctcatgactgtaatcccagccctttggggggccgaggcgggagcatcacttgagcccaggtgttcgagactagcctggccaatgtgatgaaaccccatctccactaaaaaaatacaaaaattagcctggtgtggtggcacatgcctgtaatcccagcaactctggaggctgaggcgggagaattgcttgaacccgggaggcggaggttgcagcgagccaagatcacgccattgcactccagcctgcgcgacaagtgaaactgtatctcaaaacaaaacaaaacaaacaaaaacaaaaatacccacatgcatttgggggaattttggtggggtgtgaacttgagcatctgaggggaaattgaagaaggatcagtgagtgaggtaatcgcgtgggacgtgaatgggaagagcaatcatggtggaagtcactggcgggaggaggtgcctgcaacccgggaggaaggagaaacggagcctcctggcagccaggacgaggctggaaagaaggtgatccgaggagctcctgttgcttggctccgggtttaactggcagagagaagccctctgcgttggggtctggaggaggtggccgagagtgaggagaggggaaggctgatcggtgccttctgccccaggggttttgcttgttcctgtgtttgtagcagttgatgggcaggccttgctgttcccatttgactgagagttttggagacgttgccaaaggatgaggctgccaggctgaaaccagacagaaggggcaggggccagagtggagaggggggtgcgtcctggagggggcagctgcgcatagagggggcagctgccactgtggagttcagggtcccgggaggtggctatgggggtgccctctggcccgagcgagctctggtggggtgggtggggagtggggtcctgcgttctggagacgcggccatgctggtgccctgctgcggcctggtggggagtggggtcctgagttctggagacacagccatgctgctgccctgctgcggcctgtctgagagcgcgcgttccctgcccccag

SEQ ID NO: 92 - DNA, 1702 bp, Homo sapiens
  source 1..1702: mol_type = genomic DNA
gtgagcttgtgatgctggagccaagggatgtgggtgtgggtgttgacagggatcctctggtcccattatgaggatttaggatacagatcagagttcccgtggagaaaatggggaatcactcttagacttcctaattagagggcatgcaggtattagtagggtatccttttcctcctctcccaacctgctcagatgcacttgggatataggacagaattatcttgggcaccctggggaggtaatgggtaaactggtgaaattttatgaaatatataagggacttggtcacctctttcttctcctgttttacttctgggggagggcctgtgattctcccaaacctcagataccccatgggtgctagggtcaccttcccttccccatgagtgttggtgtcaaaaataaatagttagagatataatagaaaaataataaaaccttacatttgtatagcactttatactttttttttcaaagcgttttcacatccattatctcatttgatcctcacaacaaccttatgaggtaggtagggcaggtggtatgacccccattttacagctgagaaaactgagacccagaaagattaaatgactaggcaaaggtcacacagctgggaccagacccttacttcttcactgcaggtccttgttctttctgtgtaccagggaccttagtccctgggtagagggaggcagaatctgtggtagcagggctttctcgaaggtctttggtggctcctaggctgttgtagaatgtcagagactctccatccctagccagccttgtccttgatgccctgcaatggtggttttcaaactgtgagtgcctgtgttccaaaaagtcctggatcacttaaactgatgggttgaacttttccttcccatgcatatctcttccttccccaaattggattaaaccagaagagctccattgtcatctagtttatgtattggagttccagtcaacattttgttaaagaaaaaagcaaagatttctgctaaataaaaaaagaaccagaaacgtttgaaaaccactgctctgggatggcaagaatttggctggtgccctaaggtggtaaaaggcatcctgccaggcagccgtcattcccctgcactgagccatctgcacagagcccaatgttatgtcagagaaggggacagtccgaagaaaggataccacctttaggctgtgagttcacagccagttttaattcaaatctagcccagcgtggtaggcacagtccccattttcagggcttccagtatgtgcaggaggtaggattcagacattcaagcaaaccatcagcttaaattctaggcctgggctgcttgcggaaaacttcccagaggagcatggccttgagaatggtttggcaggagagtggtaggaagtgggagatgggagaacaggctcagtgtaggggaattggtgccccccatctccctccacaccccacccctcaccctgggctctctgtgccacccagggtgtcagaagggtccctgtagctagttgcttcctcaccagagctgagacccagttgcctctactcctttcccaaggctgcacttccagtgcttgccagcagcacacgcccctaactggtgtgttgcacatcccaggaggtggcagaggaggtgggtggtatgtacttggtctgagggagagctgtcttgtcatggattatatcacctcccag

SEQ ID NO: 93 - DNA, 1927 bp, Homo sapiens
  source 1..1927: mol_type = genomic DNA
gtgagtgtctccatggcccacacatggacaccctgatactaaatatctatatctgtatatctatatctatatctatctgtacatgcctccatacagcagcaagcttaccccacacccatggtcaatgtgtctggtgacaacagaagtgcccagggggctgggtgtggtggctcatgcctggaatcccagcactttgggagactgagactgagaggagtggatcacctgagggtcaggagtttgagaccagcctggcctgcatggtgaaatcccatctatactaaaaatacaaaaattagccgggcacagtgggtcactctggtaatcccagcactttgggaggctgaggcaagtggatcacctgaggtcaggagtccgagaccagcctgcctggccaacgtggtgaaaccctgtctctactaaaaatacaaaaattagccgggcacgtaggcatgcgcttctagtcccagctactcaggaggctgtggtgggaggactgcttgaacctgggaggcggaggttgcaccactgtactccagcctgggcaacagtgagactctctcaaaaaaaaaaaaaaaagggctgggcacagtggctcatgcctgtaatcccagcactttgggaggccgaggtgggtggatcacaaggtcaagagttgagaccagcctggccaacatggtgaaacccggtctctactgtaaagaatacaaaaatgagctgggtgtggtggcacatgcctataatcccagctactcaggaggctgaggcaggagaattgcttgaacccaggaggcagaggttgcagtgagccgagatcgcaccactgcactccagcctggactacagagcaagactccatctcaaaaaaaaaaaaaaaaatgcccaaggctgcccagactggtggcccaccgagtcctccagccccaaatgtctctgcctgtcaacaccttgcatcctccagccccacaagccattctaatctccttctaggaacagaactggcaaagaggcaagaggtcactgagggcctctgtcacccaggtgaggacctgagccaagcttcagctctgggtgtggcagaagcaggtggggccatgattgctttgggaggggcccagcagcgcccagcctgacccagattgccaggcctcctcacacctgctgccagatcagcagttcacatagctgtggggaccccactggcctgcccccacccacgctgcctccttgcctcctccggtctcttcctgtcttcagccaggtgtggcctgatagaaagaaggcatgcgcacctgggctcaaactccagctgtgccacttagtaagtgctgtgtgatattgggcaaggcacctcacctctcggcgcctcagtttccggagtcaatctatttatctttttttttggttttgtttttttgagacagtgtctcgctctgtcacccaggctggaatgcagtggtgcaatcatagctcactgcagcctcaaaactcctgggtgcaagggatcctcccagctagctggacgagccattgcaaccggctaattttttttttttttttttgtggagctggggtcttgctatgttgcccaggccagtctcaaactcctgggctcaagcgatccaccacctcagcttctcaaagtgctgggattataggcgtgagccactgtgcccggccgagacagttctaataatgaaagcataaagccctaagcattgttctaagaggtttacatgtattaattcctttaatcttacagcagtacctcaagctaggtactattattatctccatttacagataaggaaactgagacccagcctatccagctgtgagggtgaaatgagagatgttgaggtcagggctccagtgggtctgcccggggggtgctaacgactcctcttctgcctgcttctctctttag

SEQ ID NO: 94 - DNA, 7550 bp, Homo sapiens
  source 1..7550: mol_type = genomic DNA
gtaagcacttttccaaaattttactttgtttttccaggatataatttactgtttttccatcaaagggacaatgaaatctcactgattctgtccacgctgtggcctgcctaagtgaagtttgttaccaccaaagaggaccattatagacaagccaaattagtgattatggaaaatatcctcttaacattttatgtttacactatgtgtaatatttgcctcttcatctgttctttcttcattccctgcatcttcattcctctcatttagtggaaaataaaatataattaatattctcaacatatagcaattaaataggctctggaagtgtagtgaatcaatccatttgcaattcaaatactttggggagtaaatacccctcgttgtacacatgtaaataattttggcagattactagtcaaagtgatgctaaataaagattttttttgttgcatcagggatgtggacttaaaagtaagttttctttggaattacaacaagaagttgaatttcaggccagtattattcaagtttttctaaatctttattttctgagtaaatgtagtacggacaagcagataatattagaaacatagtttttactgtgatacaatgtatgtttatgtatcataactattatttcatattaaggtagaaaactacaaatgtgcttctctatatgtacatagctatttaaacatatgtaattgatatgcctgttcagttgccatactaatttctgcattatcaagcaaccaaaaattatatattagttaatttttattcatttgcaaaatgatcctcacatttccccccaaatattgacacataggcttaatgtgtatatgtattgtcgtctttctaaaaataccattttaacttctgtttgtacatcaagacttacaaagtggagatcagaatgattcgtagtgtatcttgcatagaaggcttatataatgatatcagtaatatctattaaaaagcattctctttcactttatggtgtttcccataattctggccagaggcataattttagaagtcaacaaatcttaggaagactcttcacctcaataaaaggtatctgaaaagatgacagctgcaaggggcaaactcctatgtctctatgtcccggactcctttaaaaggtagcaaattggtactggctgtgtgaaaggccaagttaattgccggataacatccctctagacctgataaggaaaacagggatcaaggtcccttctactcttactgaagcacacttgctatgcagagcttagcaacaagataaggccactaaaattaatacaaggtctggataaaagaaggaaaattgcaaattacctacaccacaaatttgcagtgggccagttgctgtaaactattcaacagtacccatttctttggtgtaaaggagccctgaaaatgtttcctacagtgaaacatgccagttacttggattatgtacaaaataaagttaataacagaaataaaataactcctccaaatattcaaatacactgccttgaaatgagctgtattttccccatgtatttgctattaagcaatttctgaaaggtaatgaaaaacaaactacaattttaaaaatgtttcttcaaagccaatttcctatttgtagtaaattaatgtgagagctatctaaaggaattctcctcatgataaccataaacttaaagtacagtttggagaagtaaaagtagaaaatacaaaactaacatttataaaaagaactttatttaccatactattgtctaagcagacagactttccttttcgatgcccagtagaatgctttacattttgcacatgtaattgcaaattcatcattttattctcccagtcacgagatgggtcaaaattactgagccatttgcagatgcggacactcagactcaaacactttaaataattagttgaaagtcccacaactgataaattatatgttgaaccaaatcattttttaatttatgcatttattcccaatttaagaagacaaatttagcaaaaaaaatctgtgccaggaacagtgctacagtccctgaagctcactgtttagtgaaagagacagatgcagaaacaagtaattcaaatgtcaaaattgcaacaacagcaatatatatactatatttttgggtcacagggaaaaggcaggtaaaggaagggttcctagaggagaagatatgtgggccaagccttaaacactacataggcatcagccacacaaaggaaacaaagacgaagatggggtgggatagtgtttagatgagagcagcagttggatttgggggactgtaaagtatcggatgggaagatataagaggtataagcgggaaccagatcatgaagggcctagtaaggaccaataggatgttttattgttttggaagtgcctaaagggggcaggtggtcagatttttcaccttaggtatggccgtgtacaaggacaattttaaggcaacaatattgaagatgaagagattgttcaggagccatggcagaatacaagggagaacgaggacccaaaccaggagctggtggagttggggatgaggatggaaaagaaggaatgtggtcaagaaatacttaggaggtaaaatagacagaacatggggtgattgatcagaatgtaaaggaaagggaacaaaatcaaggacagctctcaggttttcagcttgggagacttggtaggttgtagaaacactgactgaagtggaggttacagggggaagctgttcagtacagtttggggtgcctgtaggataggctggacatacgtgtctgaaactggggagaagtggtatttgacagtatacaaatgactgcagtcacacaaagatactttgaccaatttgaagaatagtaggctaaggattgaacatgcaatagaatgaagaagatgggaagaatggtcagtgaggaggaggagaatcagggaaagtagacagagtctcagaagtcaaagactgataaaatgatcaacagaggtgcagtaagacaagaactgaaaaatccccatcagattgggcaatttgaaggtcactggtaaacttcagtgagaacagtttccagtagagtgatgggtatacacacaaaatggctattaaataagaataaggaaatagggagaggagatgtagattatttactcttctttctacccataatgtgaaaaattcctgaaaaataacgaagaaagaatttttaaaatgacaaagatttgactacttttgtagactgaggggaagaagaaaagaggaaaaggctgaaaaaggaaggtgtcatttggagcaagataattaagaggttggtttttcacctggactcaagtcctgtttctaccacttcatagctgtgtgttcgtaatctccctgggcctaaattcttcatttctaaaatgggcataatcctattttaggattgttataacatagataatatagagagagcctcagcacagtacttggcacatggcatttagtaaatagctatttttcttataaagatacaggtgaaagaaagaaaattatctgttatttttgccagttgaaacattctaccaccatattagatgtttggtattttatatagtcattttaatcctcagtatcctcaatcaaactgtacaacaaataaatatctttaaacatatgttctaattatatcctagtagtaacatatttatttaatacattacttagggcaattttgtacttaaaagcagaaatagctttattaaagaaaaattccacagcttttacatatgttatagttttcatttaagcgaggagcaaatcttctgtctatatgtacgtatacatttcttgggaaacctgattttttgtgaagctggaaaacaataaagtgattaagtaaatcacattttcactttaaaaccaaggaatgatacttaccatgttaaatttcctgagatctgcatacattccccatggattcagtttcagagctcagggtttttgacttttaggtctcacccaaatttgttacatactgtatgaagtgagtcacttaaactctgaactgacagtgtagaacaacttgcaatttctcatttcccttctatttcttgtactactcatagaggtgtacctggctttttaaaaaattagtgaagataaagataatgtgtgacagtgtaggcaatgaagttgagaagtggcaattatctccattaataattagaaatgtgattatatgaacatctattacttaatcaagtaggttttagagtgtccattagtaaaaatgtttattattaaatgtcagcagggaatagaaaatagtagaagaaactccacagggaggccctctggactgaaagactgaattttgactaattgttcatttcttgaattcatagagctttttcttcctcttttaagttcattcttccctgacctgaccagtagctggtctgcagatatgacatctgggagagtctctctttacctctcaaatctcatgatatatacaaataatttcatgccccacatctatgtatttattttctcttccaaaagtagtcatttctccctctattaactactaagttgtgttaaaggtgaaacattatactaatttagcttgaattaatgcaaggtgtttacaaatattttaaatatcttgaagaatgagatgacaaaactcatgaaattgttttttccaacaagtaatgctgaatcgtttttgtgcttgaatggtaattgttattgcaatttttcatggttaggtaaaaatcttttacccatgactatcacttttgaaaactatagtcaaatatccattttcttcattacaaaattagaattaatttcaccaattcttaaaaagtcatgaagtatcacatacaaacagttgtcataatacctattccatcaaattattgtaaggattaaatgagataatgtatatagagttttaatacaatacttgggccgggcgcggtggctcacgcctgtaatcccagcactttgggaggccgaggcgggcagatcacgaggtcaggagatcgagaccatcctggctaacacggtgaaaccccgtctctactaaaaatacaaaaaattagccgggcgcggtggcgggtgcctgtagtcccagctactcgagggggctgagacaggagaatggcgtgaacccgggaggcggagcttgcagtgagccgagactgcgccactgcactccagcctgggcgacagagcaagactccgtctcaaaaaaaaaaaaaaaaaattcttggcacatagacattttttaataaataacaggtatttcttttactaagattaaatgtgagagaaccaaggttctctggaggtttttcattaaaacattgtaacttcattttaaatatttggaactttatatagtcaattttaaactcctaagatattttaatcaaaatttataataaataaatgtcttataaaacttgttaatacgtcaaacttatgttcatacaaaagaaatagtgaggataaatttatttaacacattacacacagtgcgatattgtcaggcaacgtggcaatgataatactgtcagaacccttgccaagcagcctgcaaaaggggccccagcccagcctcagcaaaccctaggtggccttgcagagtgctcccaggagcttgcttggcagacacctcattaggaaaacaactgagactgactccatgagatgaccagggccccttgaaactggaatgggtaggtaaaaggaagacagtacatacataataaaaaaacttcttatataccagttagaaggaatgaatagattatacaaactagatggtatttaaaacagttataaggagaaaaaagagaagtatgtatatcatgacaccttttgtgtgtgtgtttaaaaaaaaacacacataaaacaatactagattaaagtataaaagcagactaaaagttgaggggggaaggtgagggaaaatgggaccaggataggtaacagggaactccagctttatttttttaatataaaagacttaaaggaatttattaacatttccttccagcgggggaatatattaggtttattttatcctatgtactcctctgcattttaaaatttctaaaaataaatgacaaaaatataaaagctaaagactagcttacagggcagcaaaaggtaggggttgatgccatattccccttataatttggttaaaaccaatacactaatttttcccttcagttaaactgacctaagtacgtatatattttttgaaacataggaccatctgggccacctttgacaaatatttttatttagcaaatacatagagcatctatggtatgtctagcactatagaactcaggggtggaaaactcggagttctcaaagtgtagacagaaactcaatgtatgcattgtccagtcctggtgtgtgaggaaaaaacctagggaaagctatggtaaactgaactaaagttcaaaaatgtttcaaaacactatgctaaccaaactaaatacaacagtaagccaaactctcccacgactgcaaatttccagtctccatggtagatgctaagataggacttaactcatggaaacccatgctaaccacctgttatgaaaacgttacctccagcagcttttctagtaattgtcatgacagggtaaatgaaaagaatcaccttagcacttggaaaaaatgagtaattatttattgcataaaggaggaaaaacaagttaacagtcaggatgggcaaagtgtacataaccacagaggtgggtagcatggatttacctgattttagttcaacagcttcatagatctaagcttcaaaaatggcagatgcaccgtgtgtgttattcgggccaaacatgtgtaatggaatgctaagtggagagaaaaggtcagagaagtgataggcaccctgaggccgtcattctttatctgttcaaatagttacctcattttggcttttggccctggggggcaggctccggagcctcaggtgcgtcagagttaagctgtttcccaccccggaacacgcaccggcatttcagccttcacttgctcaactccagagccaggacgctccagagaggacagagggagctccctagtggccagagcctgcagttcagcccctccgcccttcctctgatcacacagtcaggctgactgagaaagaaacaagaagcaacacagggccggctggagccagggagcatgaggggcgtctctgggagagggaacccgtggcccaactttcttcccaaatcaccagattgtggaagaagcatgtggaagaggaaaaagtccatctccccgccccacaatctgttcaactttttttagtagttctgtgactttaatcattagtattcagtgataagaatcccagagtgatgttttgtcatctgaattttccaaacgcgagtataaattggctttctctcgtggaattggtacttttgttttctgattaggaaattaaattgagttttgtttctttaattttttaatctggtgtgttgttttcattaattccag

SEQ ID NO: 95 - DNA, 59626 bp, Homo sapiens
  source 1..59626: mol_type = genomic DNA
gtaagtaaccttcctttttttttttttagtatatgtcctggtttggccatctgttttttttttttttaaaaaaaaaaaaaaaaggaaaagaggaaaaaaatatactactcttggacagtataaaagtaccccaaagactaaagacataactgtgccaaactgtgccatataataaaaaaaagtcacttccctgagccctgaaaggtcagtgtgtgtagggttacttggtcgccacagcgtgatctgggggcgggcgtcagattagagccggaactggtgatctgcaacttcagttcaccttgaagcaggtcagctgagctgagagcgcttgcactgagcccttttgcgctgctgctgttgccttagcggtcttcagcatgtgtttgctttggtttggggtaaatggcttagtggtcaacattagtgagcagtggtaatgcattttcagatatgggaactggtatgtggttggttccctagaaggacaccctcctgaaagctgtctcagaacaccgggggccatggctaatgtcatgtgcttgctacactcctcccatggtaactaaagagagtacccagatatacatctggttcttgggactctagaggaggatgagtactttgtaaaaacctgggggccccagtcattctaggtctgacactcaggtgctgtatcagctgcagtttgaactacttggcaccattgtgtggactttagttttgtaaaaatgaatggttccttaatttctcaaccttcaggctcaacatctcaagctgtttgttgttgttgttgttgttgttgttttgttttgtctttttgattagtggtcactccgcatttgatgttttgacatgtggatttcagaacttctgtgtggtaaagcagaatgttccaattgaattttcccattttttttcccctaagcaaaaatgtgagttttcacttatgcggccattgtgattccgactgagaccctaagtcgttctttgttgtctctctagtggtttctgacacctcagtgtgaagctgttgtagacatccataagaaatagcctgcttagggattatgtgagggcaaggtttggctgaaggagaatagaaggtgtggaaggaagcggaagaccagaagagcatcacactgcctcaagtcccaaatttgattctgctcctgatcctgtgactcaaattgtcattctcttttactgctgtggggtgtgctctgggcccagctgacaggacattctttgtactccacgtatttatgctggtgggagttgtatggctagtgctttgtgctttgtctcagaaattgtgtggactaaatgtaatatgggcagtgaatgggtttcttctggaagatgttaggcctggagggtggtttgggtttttacgagtctttttctcagattacagattacgaatggatgttataaaacaggcagtgttgacaccatacagtttctcctaagaaatgtacagagagttcaacctgaggaagctaattgaaaataaacttttaaaaagaaatgtagaaagaggaaatttaaaaagtatcttatgaatgggaaagatgtagccatttgagcttcaaagaacttttgagggaattctcaaaggacagtacccgtctttagtagataaatgcttgatatctatttttcttcttttactttttaaagaattactaaaataatacatggatttatagaaaaatcaaaccacttaaaaattgatcaggtggctgggcaaggtggctcatgcctgtaatcacagcgctttgggaggcctaggcgggtggatcacctgaagtcaggagttcgagaccagcctggctaacacggcgaaaccccatctctattaaaaatacaaaaattagctggccatggtggcttgagcgtgtagtcccagctactcggaaggctgaggcaggagaatcacttgaacctgggaggcggaggttgcagtgagccaagatcacaccactgaactcctgcctgggtgacagagtgagactcggtctcaaaaaaaaaaaaaaaaaaaagtatcaggtaaaaaaatgaaagctccccgcttaatctctgctcccactacccagaataactgctgttaatagcttaatgtagatccttctaagtcttctaagactaaactgtgtactttttgtgttgtaattaacaggagggtttttgttttgttttgttttttctttttttgagatggagtcttgctctgtcatccaggctggagtacagtggcacaatcttggctcactgcaacctccacctcctgggttcaagtgattctcctgcctcagcctcctgagtagctgggattacaggcgcctgccaccacacccagctaatttttgtatttttagtagagatgggtttcaccatgttggccaggctggtgtcgaactcctgacctcaggcgatccacctgccttggcctcccaaagtgctgggattacaggcgtgagccaccgtgcctggcctcaggatggtgttatatatacatattctgcatttttccatctcatatattcatctctgcctcatttcttttaaatagcagtgtagtccagggctgacttaccgtcatgcatttcgttgtctctctatgttattaaaaatgctacaggattgaaattcctcatgtgccagtcattttgaagaatggctgcctagacttggaatttctggtggataccaccacatcactgtccaaaatggctatcccagttcccacaacagtctgagaaagtgccattttcccatatcgtcccagaattggatatacatcttttaaattggtgccgcttggattattactgaggctaaacctcaataatcattgtcatagctcttaatgtattaaagatgttaactctttgtcatgcagatattttcctgttttgtcttacgtcttgattcttgtctttctgatatataaaatttatgttatgatttattcttttgctttcatacttaggaaatccttttttactcttttttttttttttttttttttttttgagacggagtctcgctctgtcgcccaggttggagtgcaatggcgtgatcttggctcactgcaagctccatctcccgggttcattccattctcctgcctcagcctcccgagtagctgggactacaggcgcccgccaccacgcctggctaatttttttgtatttgtgagacagggtttcaccatgttagccaggctggtctcgatctcctgaccttgtgatccgcccgtctctgcctcccaaagtgctgggattacaggcgtgagccaccgcgccccgccaggaaatcctttcctactcttaacaacagatcaatagtcatctatattttcttcctaaaaaacctgatgatgtattatattcatacatacgtatttaatacatacaaaagggccagatgcggtggctcatgcctgtaatcccagcactttgggaggctgaggcgggtggatcacctgaggtcaagagttcaagaccagcctggccaagatggtgaaatcccgtctctactaaaaatacaaaaattagccaggcgtggtggcgggcacctgtaatctcaactactggggtgactgaggcaggagaatcgcttgaacccaggaggcagaagtttcggtgagccaagatcacgccactgcactcctgcctgggcgatagagtgaggctctgtctcaaaaataaaaaataaaaataataattttatagttaagttgccctgtgtttttcctgtgattaaaaaaaaaaatacctgttttgtatttaactttggggtgggataaggtatagcccacttagtcagttgtgtctaagccacttgatgaaccagtcaatccagtcttcacctttaacaaatgctgatttcttcaagtgagcaaaatatctcttaaactttttcctattttctctataaagttgcttttttctgaattttttctttatgaggcttgatgggcagccctatcagcagacaatcattcattcacccaacaaatatttgagtatctgcttcaagccaggggcagtgctaagccctggaagtggtatcttctccttatccgggagtggggctacagtgttcattccagaagactcaagaaaatagcagatcatcacaaaagtaggttttacataaatgaggaggaatccacagggttgtgtatatgtgtgtgtattttaaattctgacataagttggagctttagggtagactgtgacataagagtagtttgttttccaactcatgtaattgccggctgatttttgtcttgaattatgataatggtaacttctgttgaaacaattctgtattcatcttagcttggttgggatgcaataaaagttttgtactggtaaaaatgataattttcttccatgatgattttgaagcttttctgtaacacctgataaaaatagaggggccaggcatggtggctcatgcctgtagtcccagctactcgggaggatgaggtgagaggatcccatgagcccaggagttttaggctacagtgagccatcatcacaccactgtactcctgtactctagcctgggcagcctcgttctttagagtaagacactgtctctttaaaaaaaaaaaaaaagaaaaaagaaaaaaagaaaaggcttttagtgaatatatttttagggtagcaagtgtaatttttataaattgcattatttgaatctaataaataccctcaaagctgaagtcgaattctgattttgattgaaaatattttttacttaaaggaagagggatagaataaatgacacgattaaggaaaagacttcttgtataaggccggggttttttaaatgattttttgaatagttagatggacaatacggaattaaaaaggtggtgtaaaaagttatacggggctgggcacagtgactcacgcctgcaatcccagtactttgggaggccgaggtgggtggatcacctgaggtcaggagttcgagaccagcctagccaacatgacgaaacatcatttctactaaaaatacaaaaattagctgggcttggtggtatgcacctgtaatccagctactcgggaggctgaggcagaagaatcgtttgaacccaggaggcagaggttgcagtgagccaagatcgtgccattgcactccagcctgggcgacagagtgagactccatctcagaaaaataataatagaaaaaagttatatggggctgggcatggtggctcatgcctgtaatcccagcagtttgggaggctgaggcagcttgatcacttgaggtcaggaattcgagactagcctggccaacatggtgaaactccgtctccactaaaaatacaaaaattagccaagcgtggtggtgcgtgcctgtagtcccagctacttgggaagctgaggcaggagaatcgcctgaacctgggaggcagaggttgcagtgagccaagatcatgccgttgcactccagcctggacgacaagagcggaactccgtctcaaaaaaaaaaaaaaaagagttatattgtaaagtatctctgctaccctgccccaaacattcatttctttccctggaggcagccactattacctgtttctttaaaaaaaaaaaaaaattgtggccgggcacggtggctcacgcctgtaatcctagcactttgggaggtggaggtgggtggatcatgaggtcaagagatcgagaccatcttggccaacatggtaaaaccccatctctactaaaaatacaaaaaattagccgggcatggtggcgggcacctgtagtcccagctactcgggaggctgaggcaggagaatcgcttgaacctgggaggcagaggttgcagtgaactgagatcacgccgctgcactccagcctggcaacagaatgagactccatctcaaaaaaaaaagcgtgtgtgtacccgtgtgttaaatttttattataaaatatatataacaggctgggcgtggtggctcacgcctgtaatcccagcactttgggaggccgaggcaggctgatcacgaggtcaggagatcgagaccatcctggcgagcacggtgaaacctcgtctttactaaaaatacaaaaaattagccgggcatggtggcgggcgcctgtagtcccagctactctgagagcctgaggcaggagaatggcgtgaacccaggaggcggagcttgcagtgagccgagatcgcgtcactgcactccagcctgggcgacagaccgagactccgtctcaaaaaatatatatcgatatatataacaatttacagttttaatcatcttaactgtacagttcagtggcactgagtacattcacattgttgtacagccattactaccatccatctctacaacctttcgtcttgcaaaactgaaatttcatacctattaaacactaactcccacttctcccctttcccccaccccaccctctggcaactactattctactctttgtctctattggacatatttttgtgtgtttaggtttgtgtatatattttacatgtgtgtataaatacacaagggtatgtgggcgttgtgtttttacacatactataaaatattgtgcacatttgtttattttaatgtatcctgtagattatttagaatcggttcatacagagccgtatcattccttttaagggttgggtttaaatagtctgttatggatgtaccacaatttatttaaccagtttttaaattttttacttattttttttaatgtttttttagagacaggatcccactccatcacccagactggagtgcaacagcatgatcatagcttactgcagccttgaactccggggctgatgtgatcctcccacctcaggctctcttgtagctgggactacagggatgtgccgccatgcctggctaaattttttatttttatttttatttttatttttggtagacacggggtttcactgtgttgcccaggctggtcttgaactccttgggcttgagtaatcctcctgccttggcctcccaaagtgccgagattacaaccatgagccatggagcccgacaagagtagccttttatttgcagaccattagagaaaaagttgcgtgtaagtagataagcatacgaatttatcactgcaatactgtttgtagagatcacagagctgttaggctaggaagaagtttttagcagttagcactagaaagcaaaactttggaaacttccatttcatcaaaagtgacctcatctgagtagggcatgtgagggaaggacctttttactcgacaaggggaacttgcccagttcttgtttgtgaaccttgaagaaagtggagcatttttattttgggaccattctaggttgtggtagttccttggtactcggggttggagaatctccctctgctgctggaccttctgcctcctcatgctgtaatatgcataagaggtgtcctagaagtattcaggaacaggctgtggttgctttgttgttctgtgactgttgaactctttatatagcagtacttttttaagctgtactaattgagcatttattatgtgtcagttactgtgctagctgctggaaactatcctaccctcagcagtcttctggtctaatgggaggtacagacaggcaaatgggctatgactttacaagaggctaacttctgtgatggagagaagttccagccactaagggagcacataaaaatcagaggagatcctaccaagaattgggaggtaggtcagggaggagacttctttgaaaaatggcatctaagacctgaacagcaaggaaacattagctaggtcaaggacaaagcatcagtggggagagatgcatgagtcttttggaaggaccagcatgtgtagaggctctgacaggagagaatctctcaggcccattcagagagtccactgtgtgaagacgaggcatgaacaaccagccaggacatgtggagaggagcatttttctttttttcttttttctttctttttttttttttttttttttgagacgtctttctctgtcacccaggctggagtgcaatggcatgatctcggctcactgcaacccccacttccagggttcaagcaattcttctgccttagcctcccaagcagctaggattacaggcacccgccaccatgcccggttaatttttgtatttttagtagagacggagtttcaccatgttggcctcaaactcctgaccttaggtgatctacccgtctcggcctcccagagtgctgggattacaggtgagagcccccacgcccggccaggctcggctttctttccaggccccgtcacactcttagatgttccctgggccccagaaggcagcgtgaggtgctctgcccatctatgctgtccttttccaccccaccctatccactgggcccctggggctcccactccactccaggtctcttcatggacccttctttcccttcacttctgtcccaggagacctgggagactcatgggaacaggcatcatcttctccagcacagttcattgtctaatgcacgaaagtgctgggctgtgagaaggtcaggagcttacatggaatgggagtcagctgtggtacaaagtacgctgcttagttctactgattttttattttttatttttacataagactttgatggtaaaggaagcagtgtgtgagcaagctgactcctgtcttgtcaagtaccaggtccactctgatgagcccctgtggacagcactgctgtaactccccaagcctgggctcaggaggtgggccctaagcgctgttcccagctcttcctccatgctgtcagctcttccaccattcttcctggcgtcattctaaggtcctgtcttcccccgccctcttccttcctggcttctacgctcagctcaagtagtagctgtttgggtacttttcacccagacttaggaaatgttatcagttggtcgtattcctgtcagccctcttactatggaactcaaataggacagattcagctgaattcccagccctgtggttgcactctttgtctgccctgcttccccaaggtagcctgctccctaaaggtcaccgagatactccccatgcaaggtttttgttgtattacacatgacaacatggaataaagtgttttgcaaatttactggatgatatcctactatgtggaacatcctacaacttactcttttcactcaacatttgacttttgaacctggtctgtactgctccgtgcagaccaatgttcattcatttgatatgtctccttgtgccatagaaatagttttacaatagaagcctgtccagagccatgagggagaaggggattgtagagaaacaaggattggcatctggtttatgtttacatcctttagtcctgttaaccgagaagaagatatttttatttccatgtttgcgaaagctttccacaaaaaaagcatccattttctagacttattaatagggcagtccaaaggttttatttttagatttgaaagaaagcaaagtaggcttctgagatatgcacatttccctgtgtccctgtctcttttgcaacattccacattgctgctaaaacttgaacatgagcactttcaagcatgtgcttactttctatgtatgactcattttttaaaacattaaagcattttcggccgggtgtggtggctcacgcctatattcctagcactttagaaggccgaggcgggtagatcacttgaggtcaggagttcaagaccagcctagccaatatagtgaaaccccatctccactaaaaatacaaaaattagccgggcatggtggcgggcgcctgtaatcccagctactcgggaggctgaggcaggagaattgcttgaacccaggaggtggaggttgcagtgagcagagatcgagccactgcactctagcctaggtgacagagcgagactctgtctcaaaaaaataaaaataaagcattaaagcactttgtctggtggtatgtaagttttggcattacttagataagttgtattttaagtctttctacacacaataacttatttttaaaatacaagtttctgtgtacttccgggttttgtgtttttgtaaacagcagaaggtattagtccatattaagtactaatttgttctaatattttcagctgtttttggaattacacttggcaaaaaaatagacaaatgtctgcagttgtgacagtttgtttttttgttctttttaactccagaataaataattctagtgagtttttttcttggcttgtaagaacatgggaatgattagagtcatcataacacttaagtagttatagaaggttgaacatctgtagtcagttgtataaaatttcctagtcatccttccaggttgtttaagacaaacaaatacatagtatttattaagctcttataaattttaattgtaaaacatcattgtacaaaactttgaaaatgcgtataggtacaaagataaaaaattaggccaggcatgccatggctcacgcctgtaatcccagcactttgggaggccaaggtgggaggatcttttgagcccaggagttcaagaccagcctgagcaacatattgagaccctatctctacaaaaatatcataaaacaaaatagaatcactctggcgattccactatccaaaaaaaaaaaaaactgctgttaatatttggtatgtatctttctagaccaaggcctccaactttggttgagaattcagccgggtctgtgaccttggatgggaaaaacattcactctttattttcactaatgtctctgaaaacccagatttttagctgggcatggtggctcgtgcctgtaatcccagtgctttggaagcccgtggagggcagatcacttgagcccaggagtttgagaccagcctgggcaacatagcaagaccctgtcttttaaaaaaaaaaaaaatccagccgggtgtggtggctcatgcctgtaatcccagcactttgagaggctgaggcaggcagatcacctgaggtcaggagtttgagaccagcctgaccaacatggtgaaatcctgtctctactaaaaatacaaaaatcagccgggcatggtggtgggcgcctgtaatcccagctactccggaggctgaggcaggagaatcacttgaacccggaaggtagaggttgcagtgagccaagatcacaccattgcactccagcctgggcgacagagcgagactctgtctcaaaaaaaaaaaaaaaaatccacattttcttcaatgacaattgtaagcaacagatcatggtagtattagaatagcagtgactgtcaccagtagagatcaaagatactttcatatcatattatagttgttacagatattttgaaatatatatgtccatcactgcttcaaacttaaggtaattattagacccatctctagatctggttatttaatgatttactgaagaagcacatattatttgagaacgaactcttgaaatatgttgttaatttctgtgcattttacacatttcaaaacattcttctgaggaggggtccagaaggccaaaagggtccatggcagaaaaaggttaagaacacctgttctgtactttgtaccatgtggctacaaatataaaaacagacgttaagccgggtatggtgatgcacacctgtagttccacctacttgggaggctgaggtgggaaaatcacttgagcccaggagtttgaggccagcctgggcaacagagcaagaccccatctcttaaaaaccagtcagcacttgactagtcagttagtgggggaaaacacaggtacagtaaaaggagtcaaaattacacttaaacttaggtcatcttattatatcaaacatttattaacatgtttagtgttttgtgtatattatgcaaagtgtaatgcaactaaaactgtttaacacttctcgatatcacataaatttgttggtgcataatagcctaaaagttacttttgctgttggcattttattttattacttacttatttatttatttatttatttattttgagacagagtcacactgtcgccaggctggagtgcagtggtgcgatctcagctcactgcaacctctgcctccctggttcaagcgattctcccgcctcagcctcctgactagctgggactacaggtgcgcgccaccatgcccagctaatttttgtatttttagtagagatagggtttcgccatgttggccaggatggtcttcatctcttgaccttgtgatctgcccacctcggcctcccaaagtgctaggattacaggcatgagccaccacgctgggcctgctgttggcattttaaacatccttctagagtctttcttatttgcctgtaagcacgtacacatgttgttgttgttttgagacaaggtctgtcgcccaagctggagcacagtggtgcaatcacagctcactacagcttcgacctcttgggtgcaagtgatcctcccaatcagcctcccaagtaggtgggactacaggtgtccgctaccatgcccagctaatttttgtattttttttgtagagacggagtttcaccatgttgcccagactggtctcaaactcctttgctcaaacgatccttccgcctcggcctcccaaagtgccgggattacaagtgtgcacctctgtgcctggcccacatgttgttttagatgaatgagatcatatatgtacttttgtaacttgctacctttcctcaacaaaatgttgtaaatatccatgtccataaaaatagacgtatatcttcacttttccctaaaatgaaaataacttaacttgcattttcttttttgtttttgtttttgttttgagacaggctcttgctctgttgctcaggctggagtgcagtgatgtcacagctcactacagcctccacctccagtttcaagtattccacctacctcagcctccaagatagctaagactacaggcacatgtcacgacgcctggctaatttttaaaatattttttgcagaaatgggatttcactatgttgcccaggctggcctcaaactgctggcctcaagtgatcttcctgccttggcctcccaaagtgctgggattacagtcgtgagccactgtgcccagcctgcattttcttattataaaagtaatacatgttcaatggacaaaaaattttcagaaaatatgcaaagatgaaaagtaaaaattgtccataaatctgtcatctacagataaagataacttctggataatgtttttctaccatcatttttagtaatcacataacatttcgttgtatgtctatgccttcatttaattaagaggcatttccattatttctgcatgttcatgactctgaatgatgatatgtctgcctgctgatggctacaaccctgtttctgcatttcaaacctctctcttgagctccagatttgatggcctcgtcagcatttacttgagttgctcataagtgtctcaaatttaacaagtcccagtcttgatttttttcccccttcaaacctattcctcatgttgtctctatttcagtaaacaatatcaacatccacccagttactcagtccaaaattctaggagtcatccttgattctgctctttctttttttttttttttttgagacggagtctcgctctgtcgcccaggccggactgcggactgcagtggcgcgatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctcttttttttttttgatacggagtctcattctcgtcatccaggctggagtgcagtggtgcaatcttggctcactgcaacctccgcctcccgggttcaagcaattcttctgccccaacctcctgagtagctgggcctggctaattttttgtatttttagtagagatggggtttcaccatgttggccaggctggtcctgaactcctgaccttgtgatccgcccacctcagcctcccaaagtgctgggattacaggcgtgagccactgcacccgccctgattctgctctttctctcatcatccctgatctgtcagcaagtcctgttaggccaaccacttctcagcatctgcactgccagtatgctagtccaagccacaaaacacctctcagaggtacgcaacaggactttgttgttgttgtgtgtgtgtgtgtttttttttttttacggtagaattattttataacttgaagtgtagggatgaccttccttttaaaattttatttattttcttaattttttattcccatagattttaggggaacaggtggtatttggtgacatgagtaagttctttaatggtgatttctgagattttggtgcacccatcacccgagcagtgtacactgaacccaatttgtagtcttttatccctcaccccctcccaccctttccctcaagtccccaaagtccattgtatcattctgatgcctttgcatcctcatagcttagctcccacttatgagtgagaacatacagtgtttggttttccattcctgagttacttcacttagaataatagtctctagttccatccaggttgctgtgaatgccattaagtcattcctttttatggctgagtagtattcctttgtatatatatgccacaatttctctattcactttctgattgatgggcatttgggctggttctatatttttgtaattgtgaattgtgctgctataagcatgcgtgtgcaagtatcattatgcaacgggacttcggatgacatattgaacaacttcctcactgatatccttgtgaaacgctacatatttcatgggtctgtttgttataccaacactcaattctgaatgatggaattatttcacatttagtctctttttcatctagccattatagtttagtttaaacaccaagttccattcctgctgcatgctgaaggatttgcagtacatcaggctatagtccatcaattcattccacaattgagtaagtaaggtatctatagtacctcaggccctgtgttaggcagggatggggtaacctagacagatttggtacctgtcctcatggagcttgactttagcggcagagacagatcttagataattgtaccagtacttaagtgttcagaaggacaagtatggaggtgggagccactccagtcctctacagtcacgtgctgcacaacaacgtttcaaccgacaacagagcacacatacagtggtgttcccataagattagaatgccatatttttactgtaccttttctatgtttagatatacaaatacttaccattgtgttccagtgatctacagtattcagtatagtaccatgctgtacagttttatagcccaggagcaataggctatataccgtatagcctaggtgtgtagtatgctacaccatctagatttgtgtaagaacactctctgatgttagcacaaataaatcgcccaatgacacatttctcagaacatatccctgttgttgagcgactcatgactgtacaatgggggaacagctcagcctgccttccccaaggaggcaacgccgatgcagggaaccgagggttgaacagaagtgggcaaggtgcagagaggaaaaaggctttccagatggagaagagcatgtgtgaaggccctcagtctggcaagagcttagtcctgtgtggcaggagctgaacgaggggttaggggagagtggcaaagggtccgggccatcagagaggtcaacaggggctggatcatgcaggattttgaatgttaacatcagagcgatagaaaacatgaagggtaaggtggtttgggttttgaatttttatcaaaatattgcaactactcggcaacaagttagatataacaaaagaggtcatcgtaaaaacagcagtctaccccttccccttcccttccctgactcagacatgacagcttttaactgtttctgattttagttcctttgatggttacctccaaaattaaatcatatgcttatacatctttcttgatttgccaactttagggaactgtgttaactccctgaaatgaaagagaatgacttagcttacgttacctccccatgttgaaattcatattcacatttctctgtaattttttttttgagatggagtctcactctgtcgcccaggctggagtgcagtgatgtgatctcggctcactgaaacctctgcctcccgggttcaagcaattctcgtgcctcagcctcctgagtagctgggactacaggcgcacaccagtgcactgggctaatttttgtatttttagtagaggcggggtttcaccatgttggccaggctggtcttaaactcctgacctcaggtgatctgcctgccttggcctcccaaagtgctgggattacaggtgtgagctaccatgccaagcccacatttctctgtaaattttaaacagtattttagtccatatgtcagttcccctctgtttaagataaggatattaataaccctacttttccttccactttccctccttaacttctgcgtcttaaaagctgtacttgaccatacccattcttgcatttgttaacatgtgtgttctgccctgcaaccacagccaagttgtagcttaattctaaagtcgaaaataacattatttacattattacacatgtgagtattgttcttggcgagaccaaataatgaatgtgcccaggattacatttccttctttacagatctggaccactcaaaggagaatgaccaatcaaggtcaaatggattcccttttcttagactctgtcacctgcttaaaatccttgctaggatttaatctacttcatattcaaaccttggcttgcttatatagctctttgttttgcccaccatttctagttgcctttttattttgtttactattcctccttgattatgttgtaaaatgctattagcagtgctgtttatttcgtacgattcggctttttccccactgaagacctttctcttggaaggcctctgcccttctgcaatctgggcaagtatctgctctttgatttaaggttgcatatacagctgtacctggaccttctcctcactgggctcttgggttggagcccgtgtcttaaaacccatatcttcctttcacatggtttactccctcgttttctggactgcatccttaaataatgtgctcagatagagtgcatggggagtaaactgtagtggataccgttgtcacctaccccatatccatttcttctttgcccattcctaacagaatcctgatattattcacctttctaccttattcccaacttcagaaaggatccttaagtcattccacacattgcattcctttggcaactgttactggtcaaggatggacatacgatctaagttggttcactcagactgaagggaaggacttccatggcacgttcagggaagactttctctttttctctcactggagtaagtgagaaaggtgttgctgggggctcttctgtaacctcagactgagggacaaagcctgaggataaagcctgctcaccaaggaaggcggagcagagaaacgggaagaacctgggtcttgatgccgttgcttagctggtgattgcactgtggctggggcctgtcctacctgagctagggactcagataggatggactttcttactgaatgagccagcttcagttttcttttctgttacttgtaaccaaaagcattgtaacagataggtcttctgagtcactgcatgcctgaaatacctttcttctactcttacacttgattggctgagtatagggttccaagttgaaaatcattttttctcctaactttggaggcatctcttctagtatgcagagtaacaaatgcaacaaatgcctgatgccaatcttattatggttcttttgtaggtgcccttcttttctcttccttccctggaagtttttaggatttcgtctccttatttttagtgtcctgaaatctcatgagaatatgtctagagttgtgtcttgttcactcgttgtactgtggtcattcaatctgaatacttttgtcaactcttttttttaaaaaaaaattactaatttacatgctttcattttctctatggggactactgtttaactttggacctcttatattggtcttctgtcttctctcatatttttcatttattgggcggtggggggtgctctgaattttggaagatctcctgcatttattttctttttccttttttctttttttttgaggcagagtcttgctctgtcacccaggctggagtgcagtagcctgatctcggctcactgcaacctctgccttccaggttcaagcaattctgcctctgcctcccacgtagctgggattacagacctgcaccaccacgcccggctaatttttgtatttttaatagagatggggtttcaccatgttgccaggctggtctcgaactcctgacctcaagtgatccgcccgcctcagcctcccaaagtggtgtgagccaccgcacccagcctcctgactttattttctatcccttctgttaaattctttatttcagccaaacctttttttttttttttttaacttactgtgaagcctgtgtgcctactgcctagattagacaattgttaacattttggcgtattttcctggtctgtatagatagggtgcatttttatacctttttgctcaccatttaaaaggaactcacagatgtcacgacatttcacccctaagtacttcagtatacatctcctaaaaataaggacattttccaatataagcacaataccccgatcacatctttaaaagttaacaataattctctaatgttatcaggcacccactttaaattcagatttcctccaaatgtctcttatcgctgttgaggggctccaaagcaattaagatttatacattgcatttgaatatgcttcctttgtctcttatttatttatttattttattttgagacagagtctcgctgtctcccaggctggagtgcagtggtgtgatctcagctcactgcaacctccgccttccaggttcaagcgattctcctgcctcagcctcccaaatagctgggattacaggtacgcaccaccacgcccagctaacttttttgtatttttagtagagacagggtttctactaaaccatgttggccaggctggttttgaactcctgacctcaagtgatctgcccgcctcggcctcccaaagttctaggattataggcgtgagccaccatgcccagcccctttgtctcttttaacaagaacagcctacccacctctccttcacttgtgatactgactttttgaagcagtcagcccaattgtcatctagaagggcccacattttaagatacatatttttagagatggcgtgtcactatgttgcctaggctggccttgaactcctggcctcaagtaatcctcctgcctcagcctcccaggtagctgggactacaggcttgtgccaccacgactagctggcccacattttagatgtctctcttttcttgtgatataatttaacttgtttgtccatatatattacttgtagacaagaagttaggtctacaggcatgttcaggttaaacattttgggcaagaatatttcataggcagtactgtgtacttcatatagcatcagctcaccaggcacttaatggttggttaccctgtggtttgtgatgctacgttttaacacttgattaaagaaggaggtgactgccaaatctccccattgtagacatacagttttcctgtggtaattgatatataatctgtgatgtgatgctttggcaccatacaaatatcctattgcccaacagccatttgcataattattttagcattcattgatccttgcctgaaaccattattacattgggggttgcaaaatgatagtttttttaattgtcacctcttctacatttagtactgtcattcctctgtaatgaattttccctcatcaaataaggaggcattatatttcctcctaaaaagacagtatagatgcttaatctttgcctttattacatttcagagtaaggagttggtagaataatcacctcaaatggtggcaaaatatttgctgttgtgtttccttttctctttcatgtcaatatggactcatagggatttatttattaaatgttttacaattcaaattgggtcaacaagagtcccttcatgttggttcctatattctcctggcataccctcattaattagtctttgagcaatttcttgttttctggcacaagatattccatcccaatatgtgcttttcgtgtcctagaactgattccaaggagctctggttccttatagtggcaacggtatttagaatccaacatgtgggtactaaatgtgctgattcttactggggtaacattatatctaggcactttcagaggacatcgctagaaaatatattcagtttttattttttatttttaatttttttgtagagacaaggtctcactatgttgcccaagctggtttcgaactgagctcaagcgatcctcccacctcagcctcccaaagtgctgggattacatctgtcagggcaaactgctggtaaatattttcacaaaagaaaaataaaaaaaccaaagtgctgggattacagatgtgagccactgtgccctccattttttttttaagtcataaatacataatgatgtcttctatggcaatttaacattacagggttcttccttaacttttttttttttttttcttttttttgaggcagggtcttgctctattgcccaggctggagtggtgcagtggtacaatcctaattcactgcagcttcaaatgcctaggcttcaaacaatcctcctccctcagcctcccgagtagctaagactacaggtgcatatcaccatgcccagctaatttttaaaaattttttgtagagatggggggtctcgttgcgttgcccaggctggtctcgaactcctggcctcaagtgatcctcccatctcgatttcccaaagtgctgggattacaggtgtgagccaccatgcctggccaacttttatttgatctgtatatatcttttccttacactgaaaatgttgggtcttactaatgttaacatagttacttatttgctttatcttgtaatagacataaaattacaaaattataataccaatattacgataaatagctgggcatggcggcgctcgcctgtagtcccagctactcaggaagctgaggtggagggactgcttgaacctaagagtttgaagctgcagtgagctgtggttgtgccactgtactcctacccggacaacagagtgagtggggggaaaaaaaagaaataatggaagatccagagaaagccccaaatatttaaaaattaaacaatacactttgcagcttcctcacctctctcagccttcatagaattgaagagagttagggccttgcactagattaggctttgccttaaggaaatgttgtgtttgatttgatcttttatccagaccattaaaacttccttaacgtttattagtaataaggctatttcactttcatatcatttgtgtgttcactggagtagcacttttagtttccttcaagaactttgattcacaacttggctaactttggtacaagaggcctagcttttggcttctcggctttcaacatgcctctcactaagcctgatcatttggtttttggtttaaagagaaagacatatgactcttccttttacttgaatgcttagaggccattgtagggttattaattggcctaatttcagtactgtcttgtccaagggaatagggaggcccaaggagagagagagagatgggggaacagctgattggtggagtagtcagaatatacacatttatcacttaagttttgccatcttttctttttctttttcttttttttttttgagacagtcttgctctgtcacccaggctggcatgcagtggcatgatctcagttcactgcaacctctgcctcctgggctcaagcaattctcctgcctcaacctcccgagtagctggtattacaagcgtgcgccaccatacccagctaatttttatattttttagtagagacagggtttgccatgttggccaggctggtctcgaattcctgacctcaagtgatccacccgccttggcctcccaaagtgcggggattacaggcgtaagccactgccgcctggccaagtttgccaccttttttattttttttattttttgagatggagtctcactccatcacccaggctggagtgcagtgatgcaatctcggctcactgcagtctctgcctcctggattcaagcgattctcctgcctcagcctcccgagtagctgggactacaggcatgtgccagcacgcccagcttgttttttgtatttttagtagagacggggtttcaccatgttggccaggctggtctccaactcctgacctcaggtgatctgcccggctcagcctcccaaagtgctgggattacaggcgtgagccaccccgcccggccaagtttgccatcttttatgggtgcagtttgtggtgccgcaaaatgatgatagtagtaacatcagagagcattgatcacagatcaccataacaaatataataatgagaaatttgaaacattgtgaaaattaccaaaatgtgacagagacatgaagtaagcacatgctattggaaaaatggcactggtaaacttgcttgatgcagggttgccacacaccttcaatttgttaaaaactcagtatctgcgaagtacagtaaagcaaagcacaatcaaatgaggtgcgcctgcatattacaaccaagaggcttttcgcagaaacacgagtgtgcttcaacattcaaaaatcagttggtgtaattcaccacattaagataataaaggaggccgggtgcggtggctcacacctgtaatcccagcactttcagaagccgaggtggacagatcacttgaggccaggagtttgagagcagcctggccaacatagtgaaatcctgtctctactaaaaatagaaaaattagccgggcagggtggcacgcacctttagtcccagctattcgggaggctgaggcaggtgaatccttgaaaccaagaggcggaggttgcagtaagctgagatcacgccaatgcattctagcctgggcaacagtgagacccagtatcaaaaaaaaaaaaaaaaaaaaaaaaagataataaaggagaaaaaccatatagtctattcaataaatacagaaaacgcatctgacaaaattcagtgccctttcatgataaaaattcagcagattagaaatagaggaagtgcatgtatgaaagagctacagatagattgtacttaattgtgaaatattgaacatgttaccccgaaaatcaggaaaaaggcaaagatgtccactctaaccacttctattcaacattatactagaggtcatagccagtataatgaggcaagaaaaaacataagaggcattaatatttaaaggaagtaaaactgtttctatttgtaggtaatgtcgaaaatgtgaaagaaactatcagaacctgctagaactaaaaagtgaattcagcaaggtctcagggtacgagatcattcaaaaactaatcagaaatgaaatttcaaatgcaatatcgttaggaataatttaataagaaatgtacaagatttacacgctgaaactgaaaatgttgctgaaagaaattaaagacctaaataaatggaatgttgtaccatgttcatcagctgaaagactaagtgtctttacagtgtcagttctcccttcattgaactgtagattcataaccccagtcataactgcagggttttttttgtagaaattgattgtaaaatgtatatggaagctgggcacggtggcttatgcctgtaaaccagcactttgggaggctgaggcagacagatgacttgaggtcaggaatttgagaccagcctggctaacatgacgaaaccccgtctctacaaaaaatacaaaaattagccagacatggtggcacacacctgtaatcccagctacttgggaggctgaggcatgagaatcacttgaacccggaggtggaggttgcagtgagccaagatcatgccactgcacgcccgcctgggcaacagagtgagactttgcctcaaataaataaataaataaaacgtatatggaaatgcaaaggacctagaacatccaaagtaaacttgaaagagaacaaaattaaggggcttatgtgatgtgactttatagtcatttgatttttaacagaggcaccagaacagtccggtgcgggaaaggaaagtcttttagcacgtgccggatgatggcaaatgacatccataccagacaaaaatgaaccttgaccttaccctaaatattagtttcttagagttgccacaaactaggtggcttaaaaccacagaaatttggctgggtgcggtggctgacgcctgtaatcccggcctttgggaggccgagtcgggcagatcacctgaggtcaggagtgcaagactagcctggccaacgtggtgaaactttgtctctactaaaaatacaaaaaacttagtcaggtgtagtggtgcacacatataatcccagctagccaggaggctgaggcaggagaattgcatgaacctgggaggttgcactgagccaagattgcaccactgcactccagcctgggtgacagagtgagactccgtctcaaaacaaaaccacagaaatttgctgtctcataattccagagtctagaagtccaaaatcaactgtcatcagggccatggtctctgtgaaacctgtaggggagtccttccttgcctcttcctagcttccagtggttggcaacctttggcattctttgatttgcagctgcattacttcaatatctgtcttcctcatcacacagcattctccatgtatgtctctgtctttacatggcctccttcttgtaagaacaacagtaatattggattggggcctgccctactccagtgtgacctcaccttaactaattacacctgcaacaacgctgtttccaactaaggtctcagtgtgaggtactgagggttaggacttcaacatatcttttttgggggacatagtccaacccatgacactacttcacaccatacataaaaattaattcatgagagattatagacctaaatgttttaaaagctaaaaatataaagcttctgcaagaaaacataggagaatatctgtgcagtccaaagaataaggttttttttaaacacaatttcactctgttgcccaggctggagtgcagtggtgcgatctcagctcactgcaacctctgcctcccgagttcaagcgattcccatgcctcagccttccaagtagctgggattacaggtgtgcgccaccatgcctggctaatttttgtatttttagtagaggcagggttttgccatgttggccaggctggtctcaaactcctgacctcaagtgatctgcctgcctcggcctcccaaagtgctgggattacaggtatgagccaccgtgccaggccaaaaaaagatttattaggatacatgaagcaatagctattaaaagaaaaaataaattggacttcattaaaatttaaaacttttggtcctcaaaagataccattaagaaaatgaaaagacagagctgggcgtggtgaggcttgcctgtagtcactactgggtacttgagaggctgaggcaggaggatcacttgagcccaggagttctaggccaacataggcaatatagtgagacagtgtctcttaaaaaaaaaaagaaaaagaaaaaacaaaagaaaataggctgagagctgtggctcatgcttgtaatcccagcactttgggagtacaaggcagatggattgcttgagctcaggagttcaagaccagcctgggcaacagtgaaatcccatctctacaaaagatacaaaaaattagccaaccatggtggcgtgcacccgtagtccatagtcccagctactcgggaagcagaggcaggaggattgcttgatcccaaggaggtcaaggctgcagtgagctgaggtcgcgccaccgcaccccagcctgggtgactgagtgagaccctgtctcaaagaaaatgaaaagacaagtccaccaagaaaacagttgagaccagtcatagaaaaaatagaaagtcatatctgacaaaggatttgtattcagaagaattcctataactcggtaataaaaagacaacctgatttttaaagggtgaaaatattttaatggatacttttttttttttttttgagacagagtctcactgtgtcacctaggctggagtgcagtggtgccatcatacatagctcactgcagactcgaactcctgggctcaagtggtcttcctgcctcagcctcctgcgtagctaggactacaagcacgtgccactatgcctggctaatttttaaattttttgtagacatgggctggtgtgtgtctgtgttgtctaggctggtcttgaactcctgggctcaagtgatcctcccacctctgccccccaaagtgctgggccaccacgcctggtgtggtgtcaccagagatgagccaccatgccctgcctgatacttttcttttatcatctgtttatttcttgtttatgggtgtttctgttctgattttatgactattctgtattctaagatttctctgagaatattatttgtttcctctaaggacagacttggtctctcttccatggggctggttcttgagccgccagggatggggggaggacctgggtagctgctgcgctgccccttctctgctgtggtggagtggcccgttgcctgcggggtctgtctctgaagggtggtttggagaagttctgtggaggcgaggcaggggtcagctcttgccccatggaccctcagagactgggaaaaggtaggcatcacctgggctgctgccagccacatcaagagcctttggggtgggtggggtgggggccggggaagggaaggttctagctgttgatttagaaaagacccattgatttcttgcctgagggaagaagtggcaccttgccactccaagtttgctctgctcaccagccccaacagcatcagcctcacctgggagcttattgaaggtgccctgccccaaagcttgtgggtcgggatctggcagtcagcagcccccaggtgttgcacacatgacagcactgcttgcccctcctctcgtctggtctggtctggtctggtctggtctggtctgagagcttctttggggctctgacaggtatacaggctctcatctgctctacagctctcttgtagtacattcctctctgttccattagtcaacatgttcttgcctacttccagcatctagaaatttgctgagtgtatcttatccgttcagaggtcctctcctgctattgcctctgttagaaatttcttccctttcatatgtctgtacttcggtttctttgaggtttgaagggtcaagtggcaattacatgtaggcagttggccatcctctggtgaaggctttaaagcccaggaataacaagatccattatgtctaaaactagcaaaaaccctacctgtcacatggtgaactgaattagaggtgatggggacagaagccagattggagtgagtggaaggtgagggagtggagattgggtatagacaactctctttaagaagttttgttgtgatggtgaccagaaaaataggagtggggtagagggggatgagggtgtttttcacgtgggtgaatatgagagcatgtttacatccttctgggaatggcccaggagagaggggagcgtgagaaggaggaaatggggacctggaggagcagactccttgtgtggaggggggaagcggcatctagagctgttgcaggaggtgggctttgagtaaatgcttcctctttggtaaagacggggaacgggaacggtagaagttgcacggaccctttgttaaagctcagaagctgagcgagaattagagcttaagtttatggagtagtcagaataaagtacccctaactgtattcttgcacagtgcaggaagccaggggtctgaaatcaagatgttgcagggctccattccccccagagcctctagcatggatccttccttgcctcttccagcttttggtggctgcctggcagtcctagactttccttggcttgcagttgcattgctccattctctgcttgtgtcttcacatggccttctctgtgtccccgtattcttctctggatgcttgtcactgtattaggcccaccctaaatccaggatgatctcatatcaagatccttcacttaattacagaagcaaagaccttccaaataaggtcagagccacagggtctgggggttaagacatacacctaactattcggggctaccatcgaacccctgtagaagcctgtccatttccaggatagcagagcccaaggaagggccagaagtccccccaaaacagttgtttgcattcaccagattctaagctataagcagatgggcagtggcagtcggtcctaatccatataccattggcaacaatagtttagttcactgtagacataatgagatgcttatcttctgctaagtagtcctcatggtaacagccatattactcctggctttgagtgacagcgctgtgctcttgtctggtgcccatatacttcagcagctggaaacaagacagtgctcatgattcaccggaaagtttctgtagttaaaatcaagtgatcccttgagtctattctaatatttgtctgtaccatgttctgtgacgagacatggaaacaaaacattaagaagtgaaagtatctttgattatgctcttgaagacaactttttgtttgtttgttttgtttgagacggagtttcactcttgttgcccaggctggagtgcaatggtgtgatctcggctcactgcaacctccgcattcccgggttcaagcgattctcctgcctcagcctcccaagtagccaggattacaggcatgcaccaccacgcctggctaattttttttattttagtagagacggggtttcaccatgctagtcagactggtctcaaactcctgacctcaggtgatccgcctgcctctgcctcccaaagtgccgggattacaggtgtgagccaccgtgcctggccgaagacaactttttaaagatgcatatgctctgggctgggtgtggtggctcacacctgtaatcccagcactttgggaggccaaggcgggcagatcacctgaggtcaggggttcaagaccagcctggccaacatggtgaaacaccgtctctactaaaagtataaaaattagccgggtgtggtggcgggtgcctgtaatcacagctactcaggaggctgaggcaggagaatcgcttgaaccccagaggcggaggttgcagtgaattgagactgtgccactgcactccagcctgggcgacagagtgagacttggtctcaataaataaaataaaataaagatgcatatatgctctgaaggctggctacattttattttttctcaaacaacttttacagtggatagtgctgtaaaagttgtttagctctggtcattttatcttttttgtgatctgcaaaaggagatccttttccttttcactgcctctaatacccaactccaatactcctttgacctcacaggcacttagaatccatcagtggctccatcttttctcagacttcacctccttcgtatccttattcctctcctttgtagcttcagtgccagtcagacgtcgttactccctggcacactacctcagcccttcggcactttcttgctttgttatattcagtcgacaaagccccagcctcatgaaattcagtcatgtctgccccatgcctgctccgtcctgaagctgaatgtgactccttcattgattccccctttaagttcatgtctaccccaggtaaacttcttgccgccaagcccacctgcatactgcagttccccggtctctcctagcccctcccaccctcctcatcagctgtcacacctccttgcagctgatatcttagttcccagagagcacagaagcaagctcaagagagtgtctacaggccagcgtctactccttcgctctgcctccctcatgctgtcacggagcgcctgtcccaggccctcactcctgttctaaggcatctctccagtcctctactgcactctcccccatcagagattcctccctcgcctgccctagaaacttgttgctacttctcccaccttgacaaaagctgctcccaaccccccacctgtctagcatctctgttttcctttaccagcaagactccagtccctgtctccacaccctcttcaaccttctccagttgttcctttgctgccacagctctgccaagctgctccatgaggtctccagtgatgaccttcatgttgttaaatctgggagctgcttgtcacttcttttcccagagctgtcgtcgtcagttaaccccaatacccatacgagacaatcctttccctcccttgagtctctgcactgatgtgcaccttctcagtgcaaaccacagcttttgtctctttctagctgaatacatgactgactgtgcttatcttagctgtcacccctgctggagcagaagctccacaggacaggattgtctccttgattcacagatgtagctcaagctcctagaacagtgcctggtgtctgtgggtcctcaggaagtcctaggtgagtgtgtgaatgtctgtcctcctcggtcttttctgtttcgcatgtgatgttggaaggcctcaggttcaggcttttcttctccaccctcactcccgaagtgattccgtccagcctcatggctcccaaatttatgtctccaggctgactgggtcacgggaactccttatcctccctagaccttctctttccctggtcttctcctttccagtaaacagcaactccaactcctgctcctcaggccagaaacctggcgctggttacctcatttgttcacaaatactgttactccacctgcaagatggatacaaaatctcatgagttcccctgcctccatggcccccaccctggtccaggtgtccagcttccctgcctctgcccttgccccctggttctttgtttagtcctgcaatattgtgctcttctgttcagaaccctccagtgggtccctgcttgctcagagtcacagcccaacaggatcacctctcttgccactctcccaccactcatgcactgcggcctcactggcctcctggctcctccctggaccctccaagtatgcccctgcctcaaggccttgacctctcctctgccctctgtcccaggtatcacacatgtctgctcaagtgtcaccttcccaatgtggccttccccgagcacacccatgtctgtaagtcaggcagcctgcctctgccccaccagttccccctgcctagcataggacttgtcaccatctgccacaagctgtgttactgcttggttttgtttgtgctctcccactcccttcccctccctccctctccccacccctatagaatctgagtcccatgaggacagagatttttttttttgcctcttcctcaatatatccccagtgcctagaatcatgcatattttaatttattgagtgaattaacaaataaattctgcagtgggacattgctctaaggttttgtcttataagagggacagaagaacatgcagcctgctctgctgttggctccttagcttctccatggctaacaggaacaatattgtttatgagataatcaaagccatagtcatgagttagaaggtacatataaaggcaaatatgtggagattgagttactttggcgggggcggaggggtgtgtagttatctgaaaacatggaacaaatcaatgagagtctaaatagcacccacatatttgcccctcttttaaaacatacctcctttatgagtgtagaatttaacagcacagtttcccagtgcagctttgcgaaacaagagaaatgaattttaaaggctgtcaggtgcctttgcaatctgtggcttagtatttgtgtaacaacatttgtgttttgccaacagatgtactgcttaaagtacccatgagaatggcctctgtggttttctactttctcggatggaaccttaggaactgattattgagaagaggctgatactgcccacctcagctcccaggcaggcttcagggccttggttactactcctttgggccctcactgacccttgcagacgtcttttgcaacctctgtagccagaagagacaactgctttctggcatgttgctctttccctaatggctttatgagcttcttgaacaccaaagcatgtgtgacttcctcacgccttcccctgtatagtatagcacccctaactgtatgtgtaaggagaaggagtgagcaattgatggcgtccccctggatctccaagggaatgggaaggggcagggtttctggattcagtcatgtggaatctggtcgttggtgtctaaatgtgcctgttacttgtgcccaatgtccaggttcaccaggaggcttagcctgctcatttccctgctagtagctatattttgggagagcattttttatgctctaattgaactttgtgggtctcagcaatttgaacaatgttttgtttttcttctggtcaggttacaaaggaaagaaaaggaatctggtgttgtaggaggtggtgtgttgtgtaattacttgttttttttttttaagtttttttatatttttgcaacaaggcaagttttctttgaataaataatgctgggagcttatcacatagaaggcatatgtgttgtactcagtacattctgaattatctgggtttatttttatctcttgaattcacttataaacaattcaaaggctgcttttttagctaacagaaataggaagagaatctcagaatctgttttgtcattttttcaatgggttgagttatagtgattatgctaactcggtggaaaagcagtgtagtgagtaaaccccacatacggcatatcatgaacattttgttgcttttttggcttctgaccatcttcatacctttttttgtgttaaaagtctccccattgtgtatatcttagtaagaggcaggtggaccctagtttctacctaagaaaacctgaagatggggttgggggcctgtggtgtacttccttctcatgctgtccatgaccactgcagtggctttgtaaggatccaggacccagggcccctcagtgggtgtcttccatttctcaagattgcctcttggttgtgagatgacggttgctgctctagtcattgcatccactcctccaggtaggaagaaagaggtcataggggaaaggcaaaatggcacttgacatcttaacttctaggcccattcaatatttccatttccatcttcacacccatcatcttgtcctagggaacaaacagcaccagcagctcagtagctataacagcaattattatttctcacacatgggtctgggtcagctgcaagatgggattcagatctgttctcaagcctgtcgttccaggacccaggagggagaagcagctgccaggggaagtctcttcgtaggcggaggtcaggagtccaagaggagtgagcagagtcacagaagcctcttaaagcctcttcttcccccatcccatcaacacgtgagcaagcccagagtcagtgggtgggaggtgtgctccgcccatagtcagtagaacaagagcaagcttgaaagagaacgatgaacaggagtgcactcggccactgtctccttagccataacgtagtcccatggtctgctgggaagcggggaataactctccttagctgagcgcagggtctcattagtaaggcagatggagaacatggatgttgggggacaactggcagtgcctgccacaggggaatggatatattccctccccttgctctctggaaactaggggatggcgatgaagcctaggtttggccaaacccattctgccttcagggactttgactcttgagggacagtgagggattagtcatggtggtggcagttgagtcacaaaaccagcagtggtggctaatgtccagtgatgacatgcaacagtgcccagggtgggtgtcccaaccagcaggtccctgcagtataaccttggctgtgtttgcagtggtgcagcctctattcctgctgcttttctgagcctagttctctagttctctctccatttccagatctgctgcccaagaactcctttgtgattgaatttaaccagagttgatttctgttgcttgaaactcaggaccttgatgcagtgtgcagggtctgggcaaggtaaaaacacactttcatgatttcgcctcaagtatagtagatgagcttaggctttttgagccaggtagccttgggattaattctcagctcttgcacctagcaggtgacctcagcaatcaagtcacttgccctccttgagcctcagtgttgccctcagttaaacattgctctcgtgtgttgctgagcattcagtgagattgtatataaagtgatcattgtgaaggtattgggacataatttgggaaagcgtcctggtctaagcttttgattggctctccatcatttgggtaatgggatagtgatttaggagtatcatagcagctcaaggggcccttctggaaagggtatgaggaaggtcagggacaagtctgaaatgaatcatcctaggcttaatgcctgtgactgggcagtgggtacaattatctcaggctagtcagtagtcatttattgtgagaatacatgggcagattttttaatttccttctcagtctagacttgaatgcaaacagttcttattgctaacttaccactagtcaccactaatgaacaaagactatgaacaggaaattcataaaagaagagatacagatggccaatgaagataggaaaagagttctgcctgctggtaatcaaagagatgcaaacgagaacaaaaatgatgccttttcacctaccaaatttgtcaagattaaaaagaaagcaaagagccagcgtcagctgatgttcatacctgcacctgctcggtagcttgctaatgttctgcctgctccacacgccaggccagcctccacggcgcagccaggtgaggcctttccttgtatacaggcacgtttggattcactgttgcataagtgagacatgtgcatgcttcacaattcaggaagtgcaaactccagagtgatgcaaggtctgagtgtccctgctgccctggtctcccagctgcctaggcctctcttcagggaacggctgcatccagggtcttgtctgtgtcttttgaggtgttctatgtacacgcagacacatctaaacctatttttattttccctgcacctgcttgggctactgtaagctgttaaatttttttttctaggaatttgtccattttgtctgactagcataaagttgttcatgttatagtttatacatttgcaacatctgtaattatgtctgctttttcattcctagtgtttgttgtttacttgtaccttctcccgtttttccttgtcttggtaaaagctcattaggttcattggtcttacaagaagcagacatgtaggcattattgccctgtattactctgtgtctcttttctagttcattaaattctgcttttgcttttatctttattattttttctatggtcttagagtacattctctgtgttttgttgttgttgttgttgttgtttgttttttgttttgagagagagagtcttgctctgtcgcccaggctggagtgcagtagtgcaatctcagctcactgcaacctccacctcctgggttcaagtgattctcgtgcctcaacctcccgagtagctgagatttacaggcatttgccccacacccggcaaattttttgtatttttagtagagatggggttttggcatgttgaccaggcgggtctcgaactgctgacgccaggtgctccacccgccttggcctcccaaagtgctgggattacaggcatgagccaccacgcctggccctaacttcttaagttataaatttggttcattgatttttctacccttttttcaaatgtaaacatttaaggctaaccctctggaactacttcaactgtatctagcaagttctgatagtattgtcactttaagttagcccaaagatattttaaattttctttgtttcttcctttgactcacatattattttaaaatgtgtttttcaatttccaagcacatggctttgggtttgttttttttttttcctagttgctctagaaaaaaaaattgactgcatgaggtggctcatgcctgtaatcccagcactttgggaggccgaggcgggcagatcacctgaggtcaggagttcgagaccagcctggccaacatgccaaaacctcgtctctactaaaaatacaaaattagccgggcatggtggcacacacctgtagttccagctactcgggaggctgaggcaggagaatcacttgaaccgggaggcagtggtcacagtgagccaagattgtgccagtgtactccagcctgggcaacaagagcaatactccgtctcaaaaaaaaaaaagaaaaaaagaaaaaatcaacttctaactaaatggcactgtgatcaaagaacttggtctgtgtgacaccagttcttgcagttggttgagaagtgctccatgacacattatccacaaccagtggacagaatatgtcaccaccaagcatgggtgcaggattctacatatattcattacctctgtcttatccgtttgttgtgaaagtattttctcttcttactgtcattttgtttacttgatttatcaactgatggaatacgtgttaaaacctactgtggtgatggacacatcagtttctccacagagtttggtcattttcattttattatttattttgaggccacattttcagttttagatacagtttcacattcctggtgtattgaaccctttggtattatgaagcgaccatactaatatgttatttttttttaaattattatttattttatttatttttctttcttttttttttttttgagacagggtctccctctgtcacccagtctggagtgcagtggtgcaatctcagctcactgcaacctccgcctcctgggctcaagtggtcctcccacctcagcctcctgagtagctgggattacaggcttgcaccagcgcgcctggctaagtttttgtatttttagtagagacagggttttgccatgttgcccagactggtctcaaactcctgggctcaagcagttcaccagccttggcctctaaaagtgttgggattacaggtgtgagccaccacgcccggccatcccagttttttattttcctcctttctgtgtctttatgcatcagtgaggtggagcttttgaaaatgtcagatagctagattttttttttttgagacggagttttgctcttgttgcccaggctggagtgcaatggcgtgatctcggctcactgcaacctccacctcccaggttcaaaacaattctcctgccgcagcctcctgagtagctgggactacaggcacgtgccaccacacccggctaattttgtatttttagtagagatgtggtttcaccatgttggccaggctggtctcaaactcctcacctcagctgatcacccgcctcagcctcccaaagtgttggaattacagacgtgagccaccatgcccagctgatagctagattttttttttttttttttttttgagacggagtcttgctctgtcgcccaggctggagtgcggtggcgcgatctcggctcactgcaagctccgccccccgggttcatgccattctcctgcttcagcctccagagtagctgggactacaggtgcccgccaccacgcgtggctgattttttttttttttttttttttgtatttttagtagagacggggtttcaccgtgtcagccaggatggtctcgatctcctgacctcgtgatccgcccgcctcagcctcccaaagtgctgggattacaggcgtgagccaccgcacccggcctcgagattttttaaaaaatccattgtctgtttcgtcctttaacatctatttgatttctgatgtatttagattcatttatagcatatttgtgcattctatttttccatattttctgttcttttaaattttccttctcctttcttgccttctcttagacttttaaaaaaattgtagtaaaatacacatcacctaaaatttaccatttttaaatgtacagttcagtggcattaaatacaaattggaggccaggcatggtggctcatgcctggaatcccagcactttgagaggctgaggtgggaggattgcttgaacctggaggtcgaggttgcagtgaggtgtgatcacactactgctatagcccaggcaacagagtgagaacctatctaaaaaaacaaacaaacaaacaaacaaacagattggcatcacacagtgtgtgtgctgctgtgctgtgctgttatcatttaacattaaaacataaacatcagcactgttatggactgaatgtttgtgtcccccaaaattccagtgttgaagctcaaacctccaatgtgatgttatttggagatggggtatttgagaggtggttaggtttagatgaaatcaggagggagggtgggtttcgcatgatgagattagtgtccttataacaagagacagcagagagcttgctttctccaccatgtgagtatgcaatgagaaggcagccatctccaagtcagaaagagagccctcaccaggggctgaatgtgctgacaccttgatcttggacttctagcctccagaactgtgagaaatttcagttgaataggccccccagtctgtactattttgttatagcttgagcagactaatacacccatgttatgaaaagctataaacatccctttaaaggccacctaacgcgtcgtattacctcatgcatcttctctgctgagctttccaaaagagtggcttaggctgggcctggtggctcatgcctgtaatcccagcactttgggaggccaaggcaggtggatcacctgaggtcaggagttcaagaccagcctgaccaacatggagaaatcccgtccctactaaaaatacaaaattagctgggcgtggtggcgcatgcctgtaatcccagctacttgggaggctgagccaggagaatcacttgaacctgggagatggagggtgcagtgagccgagatcgtgccattgcattccagcccggccaacaagagcgaaactccatctcaaaaaaaaagagtggctggccgggcgcagtggctcacgcctgtaatccccgcactgtgggaggccgaggtgggtggatcacgaggtcaggagttcaaaaccagcctggccgagatggtgaaaccccgtctctactaaaaatagaaaaactagccaggcgcagtggcaggcgcctgtaatcccagctacttgggtggctgaggcaggagaatcgcttgaacctggggggcggaggttgcagtgagccaagatggtgccactgcactccagcctgggtgacacagtgagaccccgtctcaaaaaaaaaaaaaaaaaaaaaaaaagtggcgtatgttcccggtctccacctctcattcgccagcccctgtgaccaaacccctgggattagatctccatcgggtccctcccctcaccctaacctcacatgcagtggttcctgagaagctgctgtttatctgatcacgggatccagcaggatctgagggctcattcactgaatctgtactacccaacaaggcaggcttgtccttacccacacttttcaggtgaaaacttaatcagattcaagcgtttatcttagtggcctcttcgtggtgtgtgatttccttcttgcagctctttactggctaaaactcttcactgggagttaaaccaggtgtggtccttgaccctcatcattttgtcccatctcctatgctgggctctgtatccttgtctccaagcagtctcgtgtgacagggaagttacctattattgtatggtcccctcttcttgtcacctctggtgtggcacttgttccatttcttgttcaatgaatgtgatttgtgaatgtgccacatctgtgggaggaaggcagttcgcagcaagagttgtagttcccttgctttgccctgagggccaggactttacactagatttttttgttgcattcctgcactcataaagtacacgtaaacttagaggtggtgtgttaaatgctagaacttaaaactgagttcagctaggctcaagtgccccacaatttttgtcccaccagacaatttcatgaatatctacagattgttccctcaatatgcctcaatattgaggcatattgatttggggagcacagacaagtcaaggttgatgtgcatccgctgaacatgatcttaagttgttgaagtaggtattattaatgaacgaacgtctattttagctccaagagcccctggtcttccagaagagactcccaatgatcttccagaagcagctgggcttcttttggtcctcccccacccaggtgcagtcccgttctccctgcctgggtgagtttgattcctctgccgtggaataggctaggctgctacctcttgagcctcttccaccaggccatccattaggtggcgacagagagcactaaaaggaactactatggaaataaaacttgttttgcttcttggggggaaaaaaaaagaaaaaggcttgtggggcgtgtgtgcattttagtcagattttactgtgcaaaacatttgagagatttctgccctctttctcccttccattcttctcaacccactgggcgccctaccacccctgtctccttcaagataaggtagatcagaagaccaaatagacaaatgccatgtccactgttttctgtcacagttgatagccataccagtcacccaagctggaaacccaacaggcccctgcccttcactgcccacatccaagggagccaccaagtcccacaaattgttcctttaactgtttgtccctcttttgtcttctgtcatcccttctaccgctgtcctggttcaatccctcatcttgctctgggactcccatgataacttatgatctttcctccacctctctatcttccacacaatccctatcatcaatctcattcccctgctttaaacccaagagtggcaccctgtgtttgagtgacatcagggcccctcatgtggctcctgcttctctttgtggccccttctgttgctgctgcttttcttatggacatagccctcagcagtccaggactgcttgtagttcctcccaggtaccatgtttcttgcactcctggcctttgtcattggctcccctgcccaagtccccttctcttctcctttccttcccctgtggccttgccttgtcgtgcttatccttgaagaccctgtcaggtatctcttccccaaagagccctgcctaaccaccgcccccctcccccccgcgacacacacacctgggttaggccctgcctctccacgcctgtgcctcctgccaagtcctcagaggtctctgatcccatgtgcctccaggcatggcatagggggactgtgacacagcctctcggcccacagacccctgattgtgggcttgctcactgccccagtcagtcctcttattgaggattccgtgccagttcctgactccagcacacacacgcatgtaggccgccctcctagtgcctggctccttccctgtctcttctgccactcattcccatggtcgtatcctggagttggtcatctctggaactccacccacggagttctaacttagctctgcctatgatgaggacttactgtcttcccagcttgcagtgtcaaccactgtttgatgcccctgggactccattggtcttccctcctcttgtgaactgtgcccatcaccagacgaacttgttttagaatttaccatcgtaactgagctcccttcagcgcatacctccttggctcctgctcagtctctgtttctccttttagccaaactctctaagagttctctccactcatgggccctcttccttgcctgctgctccttgctcagcttgctccatgaacacttgcttttccacattccatgaaataatcttaacagtcatcagtggctgtcactccttctcagccctttccttgtgtctcttctggtacctcatactctccaggtggccatctcacctcacatcttgaaccctctgggtttgggagaattctcacctcacgagttgatgggaggcctggcgacctctgattgtagtcactgcaaatgccagatgcttatttgcctagcttccctttcggtcagggcagcagttggcaaacggtatctcaagggccaagtccggcccactgcctgttttcgtaaatgaagctttaccaggacccagttccaccccgtcctttgtgcattgtccaagactgctctcctgtacaacagcaggtgggctggttgtgacagatactgtctggcccacaaggtggaaaatactatctggccccttacagaaagaaattacctgagttctacacgagggtgtaggtatgtaccctggcctctgccagtcagactcacatgctaggaggagcagggccaggcaggagagccgtgtctcctggcattggggctgcaggaaagacgagctcctaggccacagtgccagtggccagtgctgctgccttgcagggtcgcacaggcagtgctggctgtttggactggcttggcagaaggatttgaagtattgttcctagccaactggactcaaacctgttcctccaaccctctagggattctcttatcacccagtagccttttccccctagttttaaaaattgcagtaaaatacacaaaagataaaatgtactgccttaaccatttttaagtgtacaattctgtggtattgagcacatttatattgtgcaaccatcaccacatgcatcttcaatagcttttcatcagtccttgtctgcataaatcagctagagttggtttctattgattgccaccaataatcttgacagatatgtctgatcttccttctctgcactgactcctctttctctgtctcctctgctgattctttctcctcatcacaactccaaatagcagggggagggttgtttacacttatattcagcacgccctcacgcactcgcctggctcttcagacctctcccctgaactccagattcatacatccagctgccctttaggcctctagaaagctaaatacctcagtatcaaaaacatgagaaacggaagccagagtcctggatctctcgccctttcgctgtcccggtgcccatgcccttcagggatggcacctagaccagctccctgcatccctgcctagactctgcagtagtctcacgtggcagacccggaggtcactctcctctctggatgccctgcggacactccggttagcctcagctgcaagagcctcctcacccaaggtcacgccatttccaggacagcaccctggtgactgagcgaggtaagggtacaaggcccttatagggccttctctttgacttcttcccacctccctttatggatgtcagttcctgatgaacatcttacacctcaaaccgtgacccaacatctgcttctgcagagcccccctgtggcatcttgtgccctcctgccccactccctctactctatatcttcccatagttagaatgggctttttttttttttttttgagataaggtctccctttgtcacccaggctggaatgcaatggcacagtcacgactcactgcagcctcaacctcctgggctcaagcagtcctcccacctcagcctcccaagtagctgagactacaggtatgcaccaccacacctggctaatttttatattttttgtagagactggggtctccctatgttgcccgggctggtctcgaactcccaggctcaagcaatcctcccgccttggcctcccaaaatgcaggattacaggcgtgtaccagtgtgcccagcctcagatgggctctttgaaaaatgtttattagatcaggttactcccttgagaaaaaccctctcagaataaaacccgaagtccattacttgaaagcagagccagcttcatgggcctttgtaactgcccatgggcttgctggaacccaggcttggtttaatactctactctcaccatctcaaaattcttaatttttgaacaagaggccctgcattttcattttgcaccaggctccacaaattgtgtaactgggcctgcctcagcagccacatggaacatgatccctccttgcctatttgagctcattctctaccattctctcccttgctcacctggctcccactgctcttgctcttcctggaacttgccataatgttgctagagtcagagccttggctcttgctgctcctcattggctggacccctctttacttgacctgctccctcaccactcacttccttcagatctgtgttcagatttcgtcttctcagagaggcttttggcccctgtccatctctctgaatttacctctgacctctcccccaccaccactgcgctaagctgcctcagaactttgtagacattctgtctggtcttctgatgtttcccccttggaagaatcccaaggtgcctgaagaatgctttctttatccttgaagttgagtaggttgactagagtctggcttgctattgagcattctttatcaaattgtcctgggaacatggtgtattctttcagtctgcagatgtagtcgttgctgtttcaggtcagctctcttatggatctttgacagcatcttctgttccatttgttgagttctgtacttcagggacacaaattcctcatgttggattgtctttgtctctcttccaatgctattagctttgccgtaattggtttagcttttgtctttttcatctgcattcactttgtctaatttgattttcagctatgtatattctgtttctggctgtttttcaatgtatttattagtttcataatgatgtgttttggtctgcagtttgtttctctaggttggaaatttgtcttttcatcttattctgttttatcatcccatctttgaactcttttattgggaacatgttcttatgaagttgtggggaatttttttcccttccttgtgtattctcttcttggtgggagactttgcctttctcgtgccatctccctccctgggcctcttttttttcttctggccataatatgtttgcctagttaccatgtcacttcttttcgtcttggctcaggcttggatggctctgcatagtcgttctgtttgctttgagacagtggaggaattcttggctctctcttcccagtttcttggcatcttctcttgctgttttcccctctgagctatcgcgtgcaggcttgttatcttgtatccggagagaatttgcacgctggagggagctgcagccatgtagtcttcagccctatctggattcttctctttgttctaagaactgtgttggatgtcttactaaggctcactctagctgcacgagggatgtgtgtgccatttccatggggatagggggcacctcagtctctgggtggttccataatctgtgtatacctaagagcagttgcttcccacagagctgggctggctcactgggcactttgccatttctcctgcacctcccagctggagtttctgggtctaaaaggaaaaagtgaaggactcccacttggttgcttctctccagcttactgactgcaaattcccagggcgttgcccgctccctagggtggtttctgggggacggggcaggagcctggctttgctgctgctttgtcctctggagtcttttctcagactgctttgaattacacccctttcctttgtgtgctgaaatcttcccttcacactctccttccctgcctttcttttgtgtcttatcttactaggactggaagagggcagttgtgcaggaggtctgcatctaattccctaatccatgtgagagtgctcctgttgtgtgctttgtgacatgatggtgagaaatactccctagagcagtggctaccagaaggaagccatccccccccctgcacacacacacacacacacacacacacacacacacacacacacacactccttctggctgtcctcagatgcctattctaggtaaatgtcagattccaaagaaaatccagttgagatcttttttctttttttgagacgagagtcttgctgtgttgcccaggctggagtgcagtggcacaatctcggctcactgtaacctccgcctcctgggttcaagcgattctcctgcctcagcctcccaagtagctgggactacaggcgcgcaccaccacaccaggctaaaatttttttgtatttttagtagagacagggtttcactgtgttggccaggctggtctcgaactcctgacctcgtgttctgcccgcctcagcctcccagagtgctgggattacaggcttgagccatcgcgcccggcctccagttgggatcttgactggaatgactggtgttcaatcattatagtttccacctaatttgtatttgtacacaggacagttactaatttgttggtacttgtttgatccccagtccctagagttgtttatggggtggagcttcagtccctgctgcttcccctgtggcagcagctggagtcagggtggggacccagggtgctgctggcagattcttgagacaggtagaatctcctctatattggtgtctctctctgtcccagcagtgcccaggaaaacctggccagcctgtcactgacctctccacctagggcactggtggttcaggtccttctatttgccaccggcaaaccgtacttctgccagtctggctcttaggcccagtttctctgatcttgcagattttcttgggctctgctacggaatcctcatacctccggcaggtccctcctttgcccatgtgtttaactgtggtggaatcgtgtgagagctgcttctctcgcatggatcccagccacaccacattctacagcggttcctctgaaggcattgatagagatatttcctcctgttttgcatttcgttggtcatttcagtagaatcagggtgaaataaacatgggggctcagatgtcagcattacgaaccaagtacgtcaggcaggctgatgtggactgacctacactagtgagacgcaagatgacgaaaacaagggcactcactccaagttactgatgagatgtttggatcaaatgagccagtccttaagcagagttctctagtaaaagagatctcctttctgccctttcttgttccccaaaatgtgttgccttcatggtgaaaatttattttggcagattttctcttctttgataaaagcagccaacactttgttaaaagtctgtgaaacttatttacatgaagtatgtaaaggtaagaaaaaaacattatcaacaagaaatggagaaagccagcagctgaggacagaaaagtcatgcacagtgtcagtgtctatggaaacaggccacttggaccttgaggactaggtatttggaattggaggtgagcttggcctggtgagtctctaaccacttgtgtgtaggatcagtgtgagaaccctgctagaatatagtggcagagatgcaaggggaaatcattggagaagttaccagggaatgatgagctaatctgaaaaaaatacatgtttctaagttgggcgtggtagctcatctgtagtcccagctacttgagagcctgaggcaggaggatcgcttgagcccagcctgggcagcacagcgagaccctatctccctaaaaaaaactttttcgttgtttagttttgggatttttttttttcctggtcttttttccccctttttgtgaataacgggatctcactatgttgcccaggcagatctcgaactcctgggcccaagcaatcctcctgcctctgccttcctaagattacaggtatgagccactgtgttaagcaaaaaaacttttttaaatgaaaatcattttttaaaagacaggctttccaggggagggtattattccacttatatgaagtgtcaacagtaggcagatttgtggagacaaatagattagtggttaccaggggctgagaggagtgggagtggggagcaactgcttaatgggtaaagggttgtctttggaactagagagtagtgatggtcgcatgacattgtgaatgtactaaatgctattaatgataaattttatgttatgtgtattttaccacaattaaaaaaaaaagatcaaatgtcctcagaatagccaacaaccttccacttggctaaatgcctactcattaaacttcttgaactaaattcctttctgattgtcatggttattgtgtcctgggcttcagagtttcacattcaggttggcttggtccagtctgtcatgtatcactataggtccccacattggcctcttcctcagacggacagcccatctatctgccggggctctgtgccacagccagatagacttgctctgagacagctgtgtgggctctgagcactggccaggcatcacaaaacctatctttatgatttagaataattggtggtcagctgctgttttaatgttgttgttttttttaatttagatataattcacataccatgaaatttactcatttaaagtgtacaattcattcttcagtataattcataggctcacagaaaaaattgtttaaaaataaaatgtgcaattcagtgtcttttagtacattcacagagttgtgcaaccatcgcctctgtgtcattccagaacactttcagcacccaaaagaaaccccagacacaggagcagtcacctcttattacccgcagcccctggcaacaactcatccacttcctgtctctatggatttgcctattctggacatttcctataaatggaattatgcactatttggccttttgtgtctggcctctttcactgagcgtaatgtcctcaaggttcatctgcattgtagcatgtgtcagaatttctttcctttttgaggctgaatgatattatatcctatagataatgaggttttgattatccacccatcccttgggaatgcatatttgggttgcccccaccatttggctgttgtaaactgtgctgccatgaacactggtgtacggatatctgtttggttactggttttggttttttgtttgtttgttttggttttttgagacaaggtcttgctctgtcgcccaggctggattacagtggcacgatctctgctcactgcaacctccacctcccaggttcaagcaattctcctgcctcagtctcctgagtagctgggactacaggtagcactcaccaccatgcccggctaaatttttttgtatttttagtagagacaaggtttcgccatattggccaggctggtctcaaactcctgacctcaggtgatccacccacctcagcctcccaaagtgctgggattacagacgtgagccaccgcacccggcatagttgtggctttttgagagtgtatggctaggagtaaaattgccaggtcatatggtaactccatgtttaacatttgagaaactgccaaactgttctccacagcaggaattttttaacctgtatgtggtgggcttgtgtttcggttttcattttacacatctataaagatgagatttgctgtatggcactggttgcctgtatttggggagggttctgcttttggttggcaagaactgcattttatttaagcttagcaaaacataactggtttctcgcatcttctcaaaagtggaggattaagaaatggactgcgaattcagagcagggcagctgaacctcaggctccacccttgtagccttcaagctgaacctcattctctcttgctccctggagaccactgagacactctgcctgtgccagtttgatttctcacatttttaaagggccaaagcttgtgtctcaaagtgctatagcctttattgattcatgcagagaagcctccttgattccgtaattctgcagctaatactggaagtagaaagaattggaaacaccatctggatgacactttagggtggaagcagccagtacaagggggggctcattatttcctctggtcccagactgttcacctggagctgtagccaccaccctgcccttaggttaactgcctcgagtggtagtttagctctttgtgctgtgccgagggataactggaagtgaaaggtgctgagaaatgccatctcctgaaagtggcgagcatgagtgaatttacgaaaggttgggatattgctggggctctggaagtttctctggagctcactccaggggacagggagggggctggattccaattcaagtgaaaaatacctttcatctgccttgttcacctggcttttttgcctttttgtaaaatctgaaaacctcagggattgagtagtctttccttaactgcagttgcctgtctggccacacctgccagctgttgcttgtacccctgtaatttgcacggccttccgggcctttctcacaagatcactgcaggtcacattcatgaggaaaatgcaggcagttcctgccatcagacccctcaggatgtcatggtttggcctgaaaacaagattcctgcaactctaattttcctttgctagatcaaatgaaggatttgatctaatgtttgcattctagcagcaaaatcattgaatattttatttcttaagagccttacttcatattttgtaggtattttaagattttgtaaaggcctttctgcttcaacgtgtgatgtgtgcattcttagaaaaagatcttgtgttctgtaaatcacacaataaaaacatgagttcgtgcaggaaaaactggggcggggtggatcactccaaacttgtgtggtgtggtaactggagctcactgatgaaaccatgaacagttctggctgaaagaaccccacagtacactgaggtctgttggcatcgccgccagcaccgccccggtccctttgtgcgcgccaccacacctggctaattttttatttttagtagagagggggtttcaccatgttggtcaggatggcctcgaactgacctcgtgatccgcccacctcagcctcccaaagtgctgggattacaggtgtgagcctccgtgcccagccttcagctttttttcttaatgtctttgtgtaatatgaaggcattctctttaattgttaaaaagcttgcctaccactgcttcaaaatattactgtcagttggcatagcttctgattatattgatgtcatctcccttcttttaaacatgttaccatattggcactgtatttcccctagcccattgatcacttgagagttagtcatagtcctcgtgctgtttcactcctaaacgtttaagcatgcctttcctaagagcagacagtacagttaagacactcaggaagtttagcaatgagctaacacagaaccttacatttctccacataccccataaatgccttttttagagcctttgagcctggaatgcagagtccaggactgtgtgttgtattcgattgtgtcatcccttcagtctcctttatcagaaatgttcccccacccccttgttttctctcatcatcttgagtccagaccgtggttgcatggcacgccctctctggactcttcctgctgtctcctcacggtaagcttcagtctcctactcgtgatgctggttcatctcagcagcactgaggggcctgagctcagtttggtcgtgtgttaaggtggtgcctgccagatttctccacagaaaagggccccgtacttttatttgctcttcagcctgtgtattccttcctttcttgccagcttgtgggtggcttctctagcagcttctgtaagatactcagtttggcagttgtagttgtttcagcaggagaggtgtctgcatacctgaccaccacatggctagaagtcgatccatcctctggcgtaaccatcctccatgctactgtccctggggcactgaggccctcctcagtgacttcctccacctcatcttccgccatctccaagccaccagtgtccaacggactactgatatgtcccaaactcatcatttgtttattcaccaattcagagcccacctttttttcagcactgagctagcctctccttgctagaagcttacggtcgaaggtctccagccatcagaagaagcacgtggagcgctgcgtccgtgttgtggttattcatccagcatgtgttgagtaagggttgcacctgtgcctggcattatgcattgagcggggagatgggggttggcacgcacagtggggtgttctaagtacactgagggctcgggtgccctggctcatagagcagggagggaggcaggagcagggaaggtgtctcagaagtgccatctttttttttttttttttgggaagtggaatcttgttctatcgcctggtctggagtgcaatggcactatctcaactcactgcagcctccgcctcccaggttcaagcgattctcatgcctcagtccccgagtagctgggaccacaggcgcacaccaccacacccggcaaatattttgtatttttagtagaggcggagttttgccatgttggccaggctggtcttaaactcctggcctcaagtgatctgctcacctcggcctcctaaggtgttgggattacaggcatgagccactgcgcccggtctagaagtgccatcctaactgaacctgaaagatgaaagttctccagatgaacctgaaagttctccaaatgaaaaggtgggagggggtgacagggttaggcccagagcctctggtgacacagggtgggcatcattggtcactttttcctcgagggaggggcgtcacacgggtgatagggtgggagctataaccatgttgatagtgccgcctctgcccatctggcctggcatgccctgagccctctgtcccacctgtggaactcataagccctgacagcccactcactcctgattcattatccacacccctgtgcttccgctgtgcctggagcaagctttcttcagggggaagggaggctggaactatgttgtagttacctatttgtcctcccttccaaactgtgagttcttggaggtggaaggatgctgcaggatctggctcaggacgaaggcagttggtgaacagacacgtgtgtttttgactcacggtgatctcagacaagttcctctgtctagtcgaacttctttttttccatctgtaacactcaggagttgaataggtggtttttctgaggatacttcaactgtaaaatgtatgaacttgtgaactagctatttagttctcctcataatcaagattgtgtgtgtgtggggggttctgattagagggaggatgaagagaggtgtatggggttttttttgttttgttttctgtttgtttgtttgtttttgagatggagtctcactctgtcacccaggctggagtgcagtggcacgatttcggttcactgcaacctctgcctcctgggttcaagtgattctcctgcctcagcctcctgagtaactgggattacaggcatgcaccaccatgcccagctaatttttgtatttttaatagagatggggttttcgccatgttggccaggctggtctcgaactcctgacctcaggtgatccacctgcctcggcctcccaaagtgctgggattataggcatgagccaccacacctggcaggtttctttgaaaaagtttgtgtttcggcaaacaccataaaccccctgggggacagccttggggagtcacctggcaccctagcccagcctccctcccttgggtcctgcagtgaaggcttagtgagggtgtgcaaatgcccaggtcaccctgggactgggcaggccctctgggctaagggtaaactcatttggaatacctgttttctatcattgttttttatttgttaaatttaaagggtacaagtgcagttttgttgcgtggatatattgtatagtagtgaagtctgagctttcagtgtaaccatcacctgaatagtggacattgtacccgttaagtaatgtctcatccctcaccccctcccacccttcccagtctctccagtgtctgccattcctcactctgtccatgtgcacatgctattcagctcctgcttctaagtgagaacgtacggtatttgactttctgtgtctgagctgtgtcactgaagacaatggactccagctccatccacgttttttatcatttttacctgcactccacacccagcacaatccaggcttctttgtgggttttttgaaatttgtctttaattataaaagtagcagccagcaaattaacaaacacccatgtgcctttcattgcacagaattgaaaatcatcatactatatttgcttcaagtaatttccattagaaagaactagaatattacagtagagttaaagaccctttatttcccatcttcagtgctcttaaaagttcatttagggccaggcatggtggctcacacctataatcccagcactttgagaggcccaggtgggtggatcacctgaggtcaggagttcaagaccagcctggccaacatggcgaaaccccatctctactaaaaatacaaaaattagctgggcgtggtggtgcgcatctgtaatctcagctactcgggaggctgaggcaggagaatcgcttgaactcaggagggaggcagagcctgtatgcagtaagccgagattgcgccaccacaccccagcatgggtgacagagcaagactccgtctcaaaaaaaaaaaaaaaaaagttcattcattgtacacttagaaatagttaaaaaggtaaactttgttttgtgtgtgtgtgtatatatatatatatatatatatatatatatatatatatatatgtatttttttttgagacatatatgtgtctggtttgttcgcccaggcaggagtgcagtggcatgatcaacggctcactgcagcctcaacttcctaggctcaagtgatcctcctgcctcagcctcccgagtagctaggattacaggcacacaccaccatgcccagctaattttttttttttttttttttttttgtagagacagggttttgctatgttgcccaggctggtctcaaactcctgagctcaagcgatccacctgcctcacctcccaaagtgctgggattacaagtgtaagccaccacacctgacctgttttgtatattttaccacaataaaaagcctttaaaaccccaagcagacagttcattttcattcaggcccaactcagaatctgatcacagcggggtttcccccctttctagcgagtagctgaagaactgttttctctccttgatggtataactgtctctgtgggtgttgctcccctgccgctccagtggttttgtttttgtttttgtttttttgagacggagtcttgcgatctcagctcactgcgacctctgcctcctgggttcaggcgattcttctccctcagccttccatgtagctgggacttacaggcacctgccaccacgcccggctcatttttgtatttttagtagagacggagtttcaccatgttggccaggttgggctcgaactccagacctcaggtgatccacctgcctcagcctcccacagtgctgggattacaggtgagagccactgcacccagccggcccctcagtcttttccttctcaatcagtggcaccaccatcttcccaggctttggacatggtccctgactcacccttgcccctcacccccacactaatccacctgcgagctctgttgcttcaccacctagaccagccccaaatcctcaactgcccccaccctgggccacacctggaccactgctagaggcctctcatgggccctccctgtttttctcttgcactccccgggctttctggcacaagatgccccagaagcagaatcacatatctctcctgggagccaatctagtgtgtttactgcccctggagtgttattgttggccttagaatatgtcccactacaggtttgcagagcactgtagtcaaaagtcatttgaaataaatcttttctctgtggtatattgtcaatttgatatagaattaaatttgtttcttttcttttttcttttctttttttttttttttaagagacagggtcttggccaggcgtggtgtctcatgcctgtaatcccggcactttgggaagccaaggtgggtggatcgcctgaggtcaggaattcaagaccaacctggccagcatggtgaaaccccgtctctgctaaaaatacaaaaattagccgggcgtgatggcaggtacctgtaatcccagctactcgggaagctgaggcaggagaaggcttgaactcaggagtcggaggttgcagtgagccaagatcacgccatggcactctagcaagactctgtctcaaaaaaaaaaaaagagagagagagagacagggtcttgctctgtcactcaggctggagtgcagtgatgtagtcatggctcactgcagcctcatactcctgacctcaggtgatcgacccgcctcggcctcccaaagtgctgggatcgtaggctgaagccaccatgcctggcccgaactcatttgtttttatttgcattaagtgtaataaggttttgttacttttagtttgaattttattttgggtaatataaacatttacatgattcagaagtcagaattacactgaggcatgttcagctaggcctcactcctgtgcctgtacccttacctttttccccctaccccatgcagggaatcaatttcattagttcctggtgtgtccttccttaatacccccccttctttctttggtagaatgcagtagatatgtttgcgctttgctccctttgcttcacagtggatcctggaaatgactccatcgcagttcttagagctcttgtttagtccctttggatctgcacagtactccagtgtgtgggcgcaccataagtttattcagcaagtgccctggtgatagggatcgggggtattggaagcctttggctggtaaaaataatgttgtagcaaataacatcatgcatatgttctttgagatttctggaggtgtctctttagcatagatttctagaaggcattccttacgtcacgtttaggtttatagtttgacctcatggtgattaaggtatttgggaaatgcaaatgagagtttcgaagaagccagatctttcccattagttcactgtttttctctgacattaggaccgtccgggttctagggagcagccctggcgttaggcagtgccatgatggattgtgtagaagtagcgattcccatctgtctgctttcttggcccactctgctggtggctccccttccctccctcctttatggggagctggggagctgcctaggggtccattctcaaaggctgatctctggtgggcaacaggccacacctagctttccagggttcttcgtcatttcccattgagagctgtaagactcagagacatgaaaaggaagctctggctgggcacggtggctcacgcctgtaatcccagcactttgggaggctgaggcgggtcgatcacctgaggtcaggagttcgagaccagcctgcccaacatggtgaaaccccgtctccactaaacatacaaaaattagcctggcgtggtagcacacgcctgtgatcccagctactccggaggctgaggcaggagaataacttgaacccggcaggcggaggttgcgatgagccgatattatgccatcggcaacagagcgagactccatctcaaaaaaaaaacaaaaaacaaaacaaggcgagctctgtgctgggacagattagggacccctctttacagcaagaaagactgctctgtgggttgtaggatgcctttgtgtatgcagtggctctaggtgactctggcagccacactctgggccctaaacttctggaggaagatacaggatagggaggaactcaggggtgagtcatggtggggacaagacattccctcactctaagaccttgtcactagattggaacatctcttgcctccctacacctgacctgatggttctggagagatacgtccttgcagcttctgagtcccagcactaagcagcctttggtaacttccctacatcatttgagttctggtttcctaaggatgcttgccagtgagtgccatggtgccctcattgcacagtctgtgcagtgtagacaagaggggaagtctcttggggtagaccagccgcaaggcggtgactagcactgatgtgaaccacatgggacaggggagttgtggggctgagaacacggagggtgggagtagtcatgctcttttccagaatgaactgctaacgaagggactcgcaggtggctgctgcttctttccaagctgcccctgttgttgcagaggctctggagtcctaggaggtttcacggtggcatactcgacagagtactagagcatcatggccagatagtgatgctggggtgtggggcctcacggtggccatttctgacgagaccccaccgggccaaagtgatgtgtagagaaggagctgcttcggtcaccagaaaagaacggggaagcctcccacactagaataggtagggtgctcttctccaccggcaggaaggggatgtatggctctgcctggaccacacctttttccttgctcttccctccgcatctgctgtggccgaggccattcctcatcagggaacatgtgttagaggctcacgccacctgggaccacttgtcttatcacccccaggaccctaggcggtagtttcctgtggcctgagttagctgatatttatatagtgccattgtgccttttctcctgtgatgctcacagtaaggatgcctagatggggttacctgttgtcaagataaggaaactgaagcacagaatgctgaggtcatttgctgggttcatgtttggaaagcggcaaaggatttcagtgcaggttggctggctccaaacctgtgtgtgctttccatgacactgtactgtgtgcctcattgagcctcattctagaaaaccaaaaacacacccaaggcccggccttcacaaaggagacccctcccccatttggctccctttccagcagtcgacggcctcttgtcagccatcgagcccagagtcccttgaagtgcgactcatgctggggtggtatgctcaggagccgcagtgtttccgctcagaggaaagggctctgattctcctgcagtgctaggagacttgtgggtggccacagtgcaggtcaggcacaccggccagcaccacccacagcccaaattcctaaagaaatatttgggtcccagcttggcccgagtctctgttgtcctggggaaggacatcaagatctgagtgtatgatggcctggggccttgcatgtggtgggggtccaagcctgcctctgctcacttgttctgcagactggcatgttctctgtgatacttacatacttgtttaacacttcag

SEQ ID NO: 96 - DNA, 4582 bp, Homo sapiens
  source 1..4582: mol_type = genomic DNA
gtactaaaaactgttggggggaatttcaaaagtatttactagtcacttacatttagaaaatgtagtaaaatgatgacagacattgagcaaattaatacatctcctggtaactggtatgtagccactgacttggcaaatgcctttctctccattcctgcccataaggcccaccagaagcaatttgccttcagctggcaaggccagcaatatacctttactgtcctactgcaggggtttattaactctctggctttgtcataatcttattcggagagaccttgatcacttttcacttctgcaagatatcacactggtccattaattgatgacattatactgattaaatccagtgagcaagaagtagcaaacatactggacttattggtgagacagttgcatgccagaggatgggaaataaatctgactaaaattcagggaccttctccctcagtaaggggtccagtggtgtgggacctgttgagatattccttctaaggataatcttagaaggataaattaatgaatttgtctcctactaaaaccaagaaagaggaacaatgcctagtgggcctatttggatttttggaagcaacacattcctcatttggaatgtgttactctgtgttactctggcctatttatcgagtgacccaaaagactgccagttttgagtggggtccagaataggagaaggctctgcaacaggtccaggctgctgtgcaagctactctgccacttgggccatatgacccagcagatccaatggtgcttgaggtgtcagtggcagatagcaatgatgtttggagcctttggcaggcccccataggtgagtcacagcagaggcctctaagattttggaggaagggcctgccatcttctgcagataactactctccttttgagagacagctcttggcctgttactggactttggtggaaactgaatgtttgactatgggtcatcaagtcaccatgcgaccagaactgcctatcatgaactgggtgctttctgacccatctaactataaagtgggtcttgcacagcagcattccatcatcaaatggaagtggtatatatgtggtccagcttgagcaggtcctgaaggcacaagtaagttacatgagaaagtagctcaaatgcccatggtctccactcctgccaccctgccttctctccctcagcctttatatatatatatgtaagggggagtttattaagtgttaactcacatgatcacaaggtcccacaataggtcttctgcaggctgaggagcaaggagagccagtccgagttcccaaactgaagtatttggagtccaatgttcaagggcaggaagcatccaccacgggagaaagatgtaggcttggaggttagatcagtctctctattcacatttttttgcctgcttatattctagccacgcctggcagctgattagatggtgcccacccagattaagggtgggtctagccctttcctagcccactgattcaaatgttaatctcctttgacaacaccctcacagacacactcagggtcaatactttgtatccttcaaccaagttgacatggagtattaaccataacacatatagtccaattaattatgatagaaataaaaataaaatataattaatctttcagacttttaaaagtgtcagttcagaactaaaactgattatgcctctggaactatgaagattactttcaaagatcttattgtactctttattgagatttgactaatattttgtgggaaagatagcccacatgggattggtgaaaagtgttttgaaaaagaaatcaaatagcaatataaactcaattcataagtaaggttattttcgtttatttttgttgtctttttttaactctctactaatatgttacttagtcacagaatattagacttagacaggaaaatagtttgcaggagataaattacactgacattttccatagaatgataatacaaaaaaatttgactagaaagtacattgtaataattttatatgaaaagccttctctactacatatgtattgatcatctaccagatgctaggctctgagttgagtaggatacaattttgtcctcgaggttacaatctcctaacaaagagagatttacttacttgtaattacatcgtatgaaatttactatgtaaattattactatttcgtacatagtatgaaaattactataactaaattactataactttatactatactataactatagtataaaattactataactaaaatatggacaaagagggcacctcacttgttacaagaaacccagaaacttatatttgttgatccttaaaacttatgtttgtttcagaagcacagtgccattcactttctagtaaaatcactctctgaagtggatggaggagagctgcaactagattcaagcagtacggtgaagaaaaacaatgagaaacaacgaagaccttaactagggcaatgtcagggtctcaagagaaaccaaatctcagctaggattttgaagaaaatttaatggagggactacttacagatatgtaggcaggattgctagaaccactaaggaataatgaggcctccaggaattaaatttttaagaatttcaaaagccagttgtttttcatggtgtgaaatggtgtctcatttgtttaagttccttgtagattctagagagtagaccttttactattgcctaaaaccaaaagtgataagtactaaaaacttatcactccctatatttatatattttattatctgctttttaggttatttccatctattttttctatatggtagtgatactgtataattgtgtggctattgtgtgtctttttttctgctttgcatttagtaatgtcatgttaatagggtgaaattggctatggttggaatattcacaacataaaaatcagcaaacactaaaaattagggattgagttattgttttcagaaaatttgatgaaaaatgtaaataatcagaacaaagttctctgagggaaataatgtaacgatgaatattaaatttaaaagtttctgatatctgtaggcattacattaggaagaccccccaacatttgaggaaacattcttttagtattcaaaaaaatattattttttgtttgtttttttaacttttattttaagttcaggggtacatgtgtagatttgttatataggtaaacttgtgttgttaagcctagtacccattagttgtttttctgacctccctcctcctgctcctctaccctctgataggccccagtgtgtgttgtttccctctttgccttgtttgtgtccatgtgttctcataatttagctcccaattataagaaagaacatgtggtatttggttttctgttcctgtattagtttgctaagggtaatggcttccagcttcatccatgttcctgcaaaggacacgatctcattctttttttctggctgcatagtattctttagtgtgtgtgtatcacattttctttatccagtctatcactgatgggcatttaggttgattccatgtctttgctgtggtgaatagtgctacaatgaacatacatgtgaatgtgtatttttttttttttttttgaaacagagtctcgctctttcatccatgctggagtgcagtggtatgatcttggctcactacaacctccacctcctgggttcaagtgagtcttctgcctcagccatatgagtatctggtactacaggcacgtgccaccatacctggccaatttttgtatttttagtagagatgggtttcaccatgttggccaggctggtctcgaactcatgacctcaagtgatccacccgcctctgcctcccaaagtgctagaattacaggcatgaaccaccacgcccagctgcaagcatgtttttataatagaaagatttctgttcatttgggtatatgtacggtaatgggattgctgggttgggaggtatttctgttttgaggtctgtgcggaatcaccacactgtcgtctacaatggttgaactaatttacactctcaccaacactgtataaacgttccattttctccacaaccttgctagcatctgttattttttgactttttaataatagccattctgactggtgtgaaatggtgtctcattggggtttttatttgcatttctctaacaatcagtgatttggagctttttaaaaatacgattgttggccacatgtatgtcttttttggaaagtgtctgttcatgtcttttgcctgctttttaatgtttttttgtaaatttgtttaagttttttatagatgcaggtattagacctttgtcagattcacagtttgcaaaagttttctcccattctgtaggttatctgtttactgtgttgatagtatccttttcagtgcagatgctttttagtttaattatatctcatttgtcaatttttgcttttgttgtaattgcttttggcatcttcatcatgaagtctttgcccattagtatgttctgaatggtattgcctagattgtcttccagggtttttatagtcattatctagtaataaacaatgatttatctttactttctgactgtttag

SEQ ID NO: 97 - DNA, 5343 bp, Homo sapiens
  source 1..5343: mol_type = genomic DNA
gtaagtttggagaactttttattagctgtttctttcaaagcaaaacaaaaatcttttgctgtttgttaagaatatcttcacttcagcctatttgaccttcactgtaaaatcattctactaattctggcacaaaatagctttcatttcaattaaccctggaattaagttacattgaaacattctctgtgttcctttggtttgatttatcccaaaggcaatttgtgggcatttgttgcattggatatccttggtctaattttattattgttactttttaaattataaatgaatgcaaagaaacttaatttcaaggccttaggaaacgctgactgtcttcattcttgcttcttgtttgaaggtaatgtgagtggtttcttttcccagagatgacagtgtttcttaattgttagaagtatatggtgggaaagagtcactttctaaatcttacctaaaagttgctaaattttatttttttactcttcatatttttatctaggcagtctcaggcataatttagatatttgtgcatagattatagaaattttaatggtaaaactacttttacctcaaaaaaataagaggtaaatgataagatagtacttttgagataaaagaaaactgagttcatatttgtagaaaaacacatcattctgcaaacataatgtgaatatactatctgcttctatgaacttgccttgatttatttaaaaggaagaaaattatgagagtcgtaattattttcttccagtgaatggaatttgtccaaaatataatatgcattcattttacatttgccattatctgtcacagtgacttatcaggctgagccctgtctttgttcatataatccaaatgattgtagagtaagatgtaaagaaaactaagtaggtagttttcttaaaagggtgtaatttagaatacagtgttcatctggtttcatctttcatgccttatctaaactttacatataataaaagctttatggctgggcacagtggctcatacctgtaatccgggcactttgggagaccaaggtgggagtatctcttgagcccaagagttaaagaccagcttgggcaacatagcgagtcgtctctacaaataatttttttttttttttaattagccaggcgtggtggtgtactcctgtagtcccagctactcgggaggctgaggcaggaggattgcttgagcccaggtggttgaggctgcagtgagctgtgattgtatcactgtactccaccatgagtgacagagtaagaccctgtctcacaaaaaaaaaaaaaaaaaaagaaaacgaaaaagctttacatataagtttctaagctgtacatataaattatctaagctttaaatatagatttttaaaattcaaatcaaaatttaaatttatagacatatacttttgttgtgtccattgaagattttatttttgattatattaagtaaatttgcctagctatgatcaaattgattggattataaagacgtttctaatgcttcagccttctaattctcagcatatgtgagtttaacataatgtacaccatcattgttgaaattaatttgctgcttctaacactcttgttcagtgttatactaatgccattttgtagtgtatcacataattaaaattcaggctttctgtgtttctctagagcatgttttctagcctttctaacactgctttatttattaagattatgtctaaaattgtttcttgaaatgtttttttttctactagagttattttcaaaaaatttttttttaatttctgggtaacaccaagttttggaatgtatttctcagcacaggtaatacgagctcctcatggaaacaaggggaatctaattggtaattcgagatattttagagtacattccaaagtatgaagacagtatactcataaatttaaaatgttgttttatggagttgtgtgctttaacaaaacctaatgatatttaagagcaagctgactttctttttgggtgtatatgtcatggattggaatatgtaaaatatagagagaagatctggcttctagtatatagctgtgtagtcacattacaaataactgtttattattctcaaatatatagtgtataatgaggtttactttgaaagttaactgtctgcctaactcagggagaatgcagtaactaagcatatatgggtagtaatgctcttgctgaagtgtagtttatgactacatgcattcgcgttatgtagtcagcttttaccaagggaagaaagggtacatttggctgataactggtctcaacacacagactggcccaagtttgaccttttatgcagaatgtcttttggatccaaattagatttttatggattaaaaaaaacactagagcatgtatgtattatgaggtaaaattacattgatgtcaattagtggtgaatgaaaaaaaaacagtccttttataagttgacttacgaaacttgttatgtagcatttttattggtttttaaaatcagtttttagttccaaaattatattgattctgccatcagtgatacatatatttatatgatacatgagacagtatgtgttcctgaggtgtcgatattttgggttttgacatgaattatttttaaagatgtggaagatggtaaaagtgtagtacttttcataaagtttacaatatgcttttgggaaatcactcagtttttcattaaattctgaggctgagtaccattaaatcaggtgtaaatatgagtcacattttaaaacttctttgtcctagagaaaaccggtaaatagctactttcaaagaagtattttgtctaattgatgataaccattacaaatttccttgttccttctccactcccagtgcttcattttactagcataaaaaataaaacagtattttgaaagctctccatgtgtttcacagcaggttaacattttataaactaactggttctttgaaaattaaactatgggttttagttttgtaaaaacttttagaattttaatgagttaaacgtatgagatgctaattcttttaaaataatctattttaaaataattataaagcagtttttaatccttttccctcctgctaactcactccttaaaggctttaaaatgttataggtttcttttgtctgcctttatttatttatttatttatttattttgagacagtctctctgtcacccagattggagtgcagtggcacgatggctcactgcaacctccacctcctgggtttaagcgattctcctgccttagccttccaagtagctgggattacaggtgtggctccaccatgtccagctaatttttgtatttttagtagagatggggttttgccatgttggccaggctggtttcgaactcctagcctcaagtgatctgcccgcctcggcctcccagagtgctgggattacaggcatgagccaccacgcccagccagagaattgtctaagattaaaatttgggagttttagaaaaccactcagtagcaatgatggtctatgaatattctaaaattatgtgaagaattttgtgtgtgtgaatgcatacattcatttttctaacctttatcagatttcaaagaggttcctcgtccccagaaggttcaacaccgtactggaatagtcaaagcactggaattttttcttaattttacatctttctatagttttagctaaaacttctgtatctaattctaaatgtatatatttgagctaaaaataaatggtatttaggttttaaagccattctaataaagcagctatatttagtcaccttcaccagtttccccttatttaagggttaaggttgttcttcatgcaataaacactgtaacataaagaaagcttcctgaactatgtgtagtgtaactgaagatggaactatattagttacaactgacctctttttatcacctcttacaaatattttctctaaaatctagtttttactaacttcctgttagagattatagaaagctattttgaggttataagcagtgataacacatttaaaatgtggactgcatgaagcactacattgaacaagatgaagtgaaataatccccattttttccagagttaatctggagtcagcctgtcataatttgtgtcataatttcctgtcataaattatgacaggaaatatttattgaagcattgtgaaaaaaatagctacgtgatattccgcatgtaaatctgggtcccctcccaccaatatcctttgaaatgaaggtttatccttgacatcacagaatattgagtggaatgctacagttttgtagtcactgctactttaaacagcagtttagccgcactaagcaagaatagctgtagagattaaaatgttacattaagtgttctttaaaaatgaacatatatagtatatataaaaatgtaaactgcaaaatataattttcatctatgacatgatttaaagcaggggactctggaaagggatgggagctgaaccagttttatagcactcttcccgagctaaggtacctttttatcttaatgtagaatgttttataaagggaaaatcatccattttaaatattgggttcacattgcttttcaggctggacaaccatttcttgagttcttaaattatttttatttgacagaattataaattgaggtagacataggggttctctcttctggtgagatccttttttcttttaggtccccaagaattcccatccctccatggtttaaataataggtaggttcttgtattataaaggaagctgtgaagaaaaggcactggcagtaacattacttgtaagtaagtttttttttttctcagtaagaatctaatattttattttgtatatggcaagcatttttttcttaaattcaattgtaactggtacacaacaaaatgtaaatatgtactatcaggtataggatgttttgggggtgtgctgttgaaaatttagtttcacgttataaagttgaccacactttcatgtctgttaatcttagtaaattatgatcatctttgtgtgaaaaatttggtctgctttcattactcatcaaacatgcagtataagtgatgatacagtgaagatcttttttcaggtttcttctacccatctcatccatgaggtttttctttcctctgagataccttaattgtactttaatatgatataagactagaattgagaggaaactttattttctcatgttttgggagaagaaaaaaatagaaatatgtcattcatgaggactgattgattcagagtttttatgcaaagtttgacctttgaactctttgttttcatgtctttatattaattcaaaccttatactcaattctcaactccttgtttttag

SEQ ID NO: 98 - DNA, 2302 bp, Homo sapiens
  source 1..2302: mol_type = genomic DNA
gtaagtctaaatttctttataatttgtagctatttgagagggatagagcatatttttaaatattgtgaatctaaattgttgatttactttaatatgtttctattagcagtaggatttggtgtatagaatgtaggtctgaggattaaaacaactgggttgcattcttgtcatggccattgacttcctgggtaaccttgagcaagccatttgtctgttcatcagtttcttcattagtaaaatagagataacaatactttcttctacccctcctccatagggtatcttaagaacatttattaaagccctttgataaagaaaaataatatagaagaattctgtgctctttgcatttttttaattgttctttttcattgcaaagctttgtcactacaggaagctgccacatctggttaaaacaatgatcagtctacactgacttatttatataaaagcaaatagtaagcaacccagaaggaacaatttggatatatacctgttttataatgtttttccaggaaggattgatgtaataaaaacatgttttgcaattgttaggcaggtctatgtggcttatatctaggaaggaattagaatatgaggaaataggaggtgaatggcattaaagtacctgaattgaatgcacttcaaaaaaatacaagaacagtctgtccaggtttttggtttttgttgttgttttttttggtacaaatacagttggccttccatatccatgggtttcacatctgtggatttaaccaccaaggatcaaaaatactgagaaaaaaaaattacacctgtactaaatatgtacagactttttttgttattattctctaaacaatacaacagcaatttacatagcatttacattgtattagatataaataatctagagaagatttaaagtatacgagaggatatgagtagattatatgcaaatactaccccattttatatcagggacttgagaatccacggattttggtatccctgggaggttctggagccaatcccccatggataccgagcaatgactgtacacgtaaagctacccaatgagattaaaaacttatttggaaattttattttggtgttatgattaaggtttatactttaatctgcatgagtagttatttatattagtcttttgaacaaaaatgagtaagaaaagattctaacttacccataccttattaaatcatgtttatgatttctgtaaataaattgaaaccttatcattttattcctcctccatccctttttgaaaattacatatagcacatagagtaaaaattcagacatcatttactaaggagttaaattgatgcaatattaacttcaagccaatgtgtaccttcagatattcagtctggacataatttatacggagtggcaaaactaatagtgttacaagtatttcagagtacaaaaagatgaagttttaacttaagcagcgctattcagaaaatattgcctctagaccagttaataaaagacatcttgcctgggccatagttatcctgagtgaccttgggctagttatctgatcactctatgctttgagtttagtttgttgtttgttaccaataatacttgctatcatcagagatcttcattttttcctcaaataaacattatatacaaataaacatggatgatatattgctacttattaacccgtggttataggattcagcattgtggccttattataatgccatatgaaaaagaaatggaagatatttttagctctggtttattatattgtttcatcaaatgaatatattttaattttttttttaaaataatgtcaatgtagtaccttctgctggggatctgaaaaatgtttgcagacattatttcttaaatcctgaaaacatccctgtgaggtaggtgggtggtaaatattattatccccattttacagatggagaattgaggcacagagagattatgtgactcacccaaggtcacactacaagtcagtggtggagccaggaatagaacccaagactcctgactcctaatccactcccctagccactaggccctgctccctcctcaaggtttcctcttgtgtgaaattctcctttgaaatgcaatttcttgtttttaattcatggggaaagaagtacctgctctaatgcttctctaggtaaggccaccagcatattcttccagtcattttaagttttaattttttgaaataaggagccgtttatataatttattaacatatttattaaatgttttatttaattttaatatgaatatatgatgagatttttcccctctcccatag

SEQ ID NO: 99 - DNA, 908 bp, Homo sapiens
  source 1..908: mol_type = genomic DNA
gtatgtaatatattatcattaaggtgataaaatagttctaatatttgtcatataacctagtatttccatttcaaaatttgaatgatacctaccgtatatcattatactgggtactgagtacaacatggctcctgcacatacagagcttagtctagagcaggattggtcaagtgtgaccagtagcctgaaccacaaagtgagaatggtttttacatttataaagagttatttaaaaaaaaaaaaatgtgatagagactgtatgtggcccacagagcctaaaatatttattctctgttcctttataatgaaaagttggctgacccctgaccttgaggtttaggttcttaatgaaatatttcagttttaggttaatactgctcacactaaaatttttttttttttagataatgagcctgtatttattagtacttgactctttttccctctgatacttgtacaaagttttgtgtctgaaatttaatattgccttgatgttattaaaatattccacattctggaaatttgccttgttattgatttgattgtaatttatgtaagctgcatgtgtctaaggataacacagatgacaataaactctgccctcaagtcatttaccacctggtagagtattcatagctccttttgtagaaaaaagcaaacaaaaatggagcatactagtaatacaaattttcttattcattgccatgcttaggctgttgattcttttggatacaatttcaattcttctaagatataccaagaagaaaacaggaaagtgcagaagaattatgcttttgaattccaacactttacctgtcagtaatttatgtctcttattggttctcttttaagatttctataaagcctctcctgtcattcaaaagataaattgtatactctatttttag

SEQ ID NO: 100 - DNA, 1384 bp, Homo sapiens
  source 1..1384: mol_type = genomic DNA
gtattactcagttcctgatcttttcaccttctaaagagaagctacttttcacgccagaggccacatccctctttcccttgagttttcttaagaatactattctactgaaatggctgatggccataaggaatcttggaggaaaagtagagccttatcctaataataaggcaaggcatgtattgcagctgtcaatatggtctttttaaaagatcatcacatcctatgctgtaggtgtccaatcaggtatataagtgtttcatcgttaagtaaacttgtaaaaccggagagtacaatatcaagtcaacatatgatctgaaggaacatagatactgtcctataaaagttgagactggccaggtgctgtggctcacgcctgtaatcccaacactttgggaggccgaggcgggaagataacttgaggttgagagttcgagaccagcctcgccaacatggtgaaacctcatctctactaacaatacagaaattacctgagtgtggtggcatgcgcctataattccagctaatcgggcagaggcacaagaatcacttgaacccttgaggcagaggttgtagtgagccgaaatcatgccactgccctccagcctgggtgacagaatgagactctgttgcaaaagaaaaaaattgagactgctggctgggcgttgtggctcatgccactcagctctttgggaggctgaggtgggaggatcatatgagaacaggatttcgagaccaacctgtgaaatacagtgagaccttgtctctacttaaaaaaaaaaaaaaaaaaatcgagactgctgtggttagcgggaagatttacttgcttatttcttgagaccatcagctacttaatcttaggacaatttttatgaatatcggccttcaggaaacaaaagatttaaaaccatttacttgcaaagcatcagtgcaatcattgatattatcttcgggtttccaactcaggttaaaagagagaagtcaggtcagcatcacacattatgatgcagaatgtttctttccaggacaatttgaatagaatgcccaagaggggcattatttaggaaacactgatcttggaaggacaaataagtaatcaaataaacttaagaatgttttctctcccttagtgaaaccttaaaatggaacagctcagaaagttccagtggaacaaacagcctcagagcagttagtggcagggcatgaggcgcccactacccgcccaatcacagcagggttagaactaacattgcatgcagtccgcccgagtgattggctgaacatctgtaagtgcttaatggctagacaaatagcagcccagagggagggggtcaaatggaagagacatcaataatacagatgtgggacattattttttctttgcaag

SEQ ID NO: 101 - DNA, 5409 bp, Homo sapiens
  source 1..5409: mol_type = genomic DNA
gtgatggatggtttaagggggctaccgatacattcacactaatcagccatttctgccaagatcatgtcacctcaatctgttcatggactccaaatacaagaaattaatttgacaaagtgaaaatataaaagatgcatcatataaatatgtaacttttctggagtgggtagtataggtaaagccaaaagaaacaaattcaagcagaggaattttggtttctgaaaattaggttgtctgtagggtccctgtatttatacttagaacaaaattaggaatttctgtttatgtggtccagttattgagtcaccctaagtttgtaggcatcttacctacctacttgctccccaagtttttatttctaaaatgaaaagcattgctgtagatgaccagtttacactaaagaataacatttatttatttgttttagctaaagtatatggacagggaacattcatattcttgtagaagaaaattattttgacttttgggcaaaagcatgtagttcttatacactttgacaaactcattgcgtacatttttcacattaatcaaagtcagcacaaataaattttcaccttggaccacggagggtttgaacactggaaatttgatataattctggttgctaaagaacaagttctaataaaagcttaagtgtataccaatatgtggctgttggtgcaatcagcaggtccgtaaaaatatgattttaatggttaggtaatcccacaacggagatcccaaagttcatgtttggaagagacttttgggtcaaagtgaaatcagtgtaatgaatttaaaattatactctgagatcttgaaatcagctaattatgttacatcttattagctcagaaaagttttgaagttatatacaaatgctagtcaggaaaaaagattcagtcatgtaattcttgtacattctactatttaaatcaaccaatattatagattatgatttagtgcagtaattctgctggctaaccttatctcatttggtggtggttagtacttcagagtactcaccatagtttcatttatgttttcagcatcacttcctggtttttctcaattccatggctgtggaatcaattcatatgtatatttagcttcggtgagcaaaaacatagctagaaaaagaaaagaagtgagtttcctacctggttaaattaaagtcgatgtgttaagccaaggaggacttcttttgaatggtactttaacaatccctgttctgtatactgtgaatatatcatttaaatagcctaataaattggatgcttaggctgagccacctatactttagttttgttatggaaagaagggagaggagcaagtatgttcttatatgttacttagaaataagaatgtagctgtagttacacattgttcttaagtttttttcgtaagacaacttgaaatgagtcccataggcctgctatttaacattctaagatatgacttaaggttaatgatgagcttttgaatctgacaattcaagagatatccataatgaatactgattcattttctacattgctgaaagctaatgttcattttaagcctactttagtagcctttatttgggcttagagatgttattcctctttctgatatttattgggttatctgtttaacccttttatatctccctttcccgatttgtaaattagagactggcaagactttttaccctgagtagagcaccaaacatggcttgtttctgcccacactgtagttaccttgaggggaagtaaatgggactttaaaagcaatttatgctcttttatagtgaaattatccctcttactatcccgaaagactgttaccttacaatatcctccactcctttccccctgtagttactatagagatgacttttcggttcttcactgccataatgatcaaaatcctaattcatgagatttttatcattccaggcatgtgaggtttacttgatgcataaaaccgcaagtactttttgttgttttttaattgttttttctctcttatcttcttgaaagtctaagtagatcatcatttttgatgtcttattagtagcaactaataaattttccctgtatcttctcagcaaaagaactcaagcagagacagaagattagaactaccattggtagttttgcttcctatggatatgttcacatacatagaaatttttacaatgacctttttatatatgtatttcagaatttcagaatggcctcaatgccttaataggaagaaatacttgaaatttttaaattagggcttggttttgtgaggagctagtaaaggtttttctctttcagctttagcttgtttctgcggaggattccgctctttctccatcagtttcatagccctggaattgtagaaaagctctggtttcaagaccattgatatccatttctgtcagggtgagttttaaatttatttcatgatgcaaacaatatattgaacaacaggacatgaacttgttcttgttgtaagtggctgaattttatcagtaaagcacatcaaaataaaatataccccaattgctagttaagacctagagtgacagattgaaaatagcttgtgttattctcttaagaaaatatataaaaattatcatctcatcaatctttaatgtttgttttataaatctaaatgtttttatattgtttcctaggaaatattaggtctaattttttactttaccaccagctgtcttttattttactctttttttgagacggagtttcgctcttgttgcttaggctagagtgcagtggcactatctcagctcactgcgacctctgcctcccgggttcaagcgattctcctgcctcagtctcccgagtagctgggattacaggcacatgccactacaccaggctaattttgtatttttagtagagacggggtttcttcatgttggtcaggctggtctcgaactcccgacctcaggtgatccgcctgcctcggcctcccagagtgctgggattacaggcatgagccaccgcacctggccagctgtcttttaatataacattatgattaattgtgatgttccattaaactaagcggagaggaaacatgctggtaaaccatgtgtgagttattcattgtaccagaaaggcaaatgatacattttatcctaaaattcaaatttataaacatcttaacacttgtgatcattaaatactactaatctagcatataaattatatttgtaggcggggcacggtggctcacgcctgtaatcccagcactttgggaggctgaggtgggcagatcacgaggtcaggagatcgagaccatcctggctaacatggtgaaaccccatctctactaaaaatacaaaaaaaattagctgggtgtgctggcgggcacctgtagtcccagctacttgggaggctgaggcaggagaatggcgtgaccccaggaggcagagcttccagcctgggcgactccgtctcaaaaaaaaagaaaaaagaaattatatttgtaatattctactaaccttatatcattttaactttttatataacttttttattttaccaaattaagttaaccttttatagcccttggcttatactaaacatcctaacttttttgtttaattgtattagtttttaagttattgccccagatgtcaagtaatgttggattttctataataatttaggatatattgcatgaagtcagttagtatttacatttaaaactaaaacaatttatactaatacagtttatacatttcatactaatttagctacagttggataaatatttaatggaacaaagtaaatcaaagtaccttttcaaatgaattggaaattaaatccacataacaattttttatgaccacactattacagtgtgatggcatgccaaatgatcataatgtggaattatgtatttcttcattggctttcaagattctgttctttagtttgtgggctcctctccaacttgcttgtctcctcacagtttaggcgactgtttataattcttgtccatcctgcataaacacacacagtcaaaatgaaaaaaagcttctatcagcagatctgtgcttgctgtacagaaatgggaaaacaattgaagtttgcattatcttttttctaattaccagatcgtttttggagctatttaggcatacgcttttaaggaaaaaagaaaaaaagagtgtaccttttgtttctaacaaaggttgttatctatattattgaaataaaaaattggggatagttatgacaaagtatttagaaataggaattaaaatcttaaaataacttttcatagcatggacaagacttattaatgtctacctcaataagcaaatcatttaaaaatttttcatgtatatttgctgccatgatgtgttgtgattgcttaaataaccaatgaatgaagatcaacaaggatttaaatgaagaagaatatggatttaactattttctcctgtgaaataagttcatatttacaagttttgattttcagaaattagacaattatttttaaaggctgggatgacaacttctgcctcttaccaagaagtcaaagcacagttatgtgaattcatcataaatcacatcatttttattatattttgtatttataattgtattgtgactactttaaaacctgttataaaataaaattgttttttaatattttattttagaattattagcattaataacaatttgaagtagtttacacaatacctgtgagttttatttttgttttatattgaaattaattttagttgctttacttggcttcattgctatggatgcattctctgtgttacgagttagcagatctttccttggaactgaatttaaaagcaagcatttggctccacttaaatctctgaaaatgcaacttgttctttgcatttattacataattcgctacttatggtacagaaatggatacaatacaaaaatatttccttataagatacactgtgaccaatgagctttttaaatagctgtaatcagtaacatgtatttgacttttcaaaacacatttctggagggatatcagtgctttatttccccaaatatctgaatccctatgctttagtacaaaacaacttctgaagaatttagtaaccatatgtgttgatctcttgtttttctaactagtctttcataagaaatgactagaatagcaacagggaaatgattgccttttaaggtttttgtttctcaatataaaattttggtgaaccatttttattgataaatacaggtatttttactttcttaaatcacttgatttaaaattactttgattaaatatgcatataaagtcagttgtttttaactctcaatacttatcaaaaaaatttaacttgctgtacattctgtataaacctaattctattcaactaaaattattttaaacatttag

SEQ ID NO: 102 - DNA, 24782 bp, Homo sapiens
  source 1..24782: mol_type = genomic DNA
gtgagtagttcttactgccctctaccttactacctttccacctttcccatttccatttgtttgttgatccatttaatctcaaacttacagaaaagttacaaggaactgggctgagcacggtggctcacgcttgtaatcccagcactttgggaggccaagatgggtggaaaacaaggtcagaagatcaagaccatcctggctaacacagtgaaaccccgtctctactaaaaatacaaaaaacttagccaggtgtggtggtgggtgcctatagtcccagctacttgggaggctgaggcaggagaatggtgtgaacccgggaggcggagcttgcggtgagccaagatcctgccactgcactccagcctgagcgacagggcgagattctgtctcaaaaaaaaaaaaaaaaaaaaagttacaaggaatttttttcttctctgaagtatttgagagtaagttgctgaccttaagtcctatcacttccaagtaggttcatgtatagttcttagaaacagattttctcatagcaaccgaacattgataaattacaatatctaattctcagacccctttcaagtttcacccgttgtcccagtattatccctccatataacaagatgttccaggctcaatacctgacccagcttcctttttttgaagaatggtgtttagaaatggagacctagaaattatatatgctgttattggaatatcactgttccctggtttctcagtggaaagagctaggaactaagtgttgtgaatgtttgtgtgtgtgcaggtgaatatacacacactgacatctgtattcctaaatcatgtgtatatttatttattaaaaactgtgagttgatgctgatacttcccattttaatccagcattacaaggtttgttctagtgttctccctttcgatatttgtcacttgctttcctgatagaaaacgggcttctagtatccttaatatattttcatattttggtcagtcctcctatacgtaacccaacttgaatgaagatatgtccttttccattgcagaaatgttctttttccccagctcggactcaacactacacaccaggccaccacatggcgccgcacccagcattgacacttcttttaccttgtctgggctctgacatccgtgccaggttgctcttcgtcatggagtcccttttactgagctctgctctgacgctttgtgccaggtgcctctccatctcatccttcccacccgctagcctctgcccgaccccagacagattccttcctcacctgaagccagaccatgcctttgtggagataccctctttaccctgcctgtgcttcgccagcctgcaccaggccaccctcctgcacagatactctcctcagtactggaccaggctaccaacagccccatgtgaacccattgtaacccaggtcaggcattaacacctgcagtaggctaccatggcttccccttcccacccccctagcttggccctactaataatcactttgtcactgtttggggttgatatttggttgtttcttgtaggttcctagctttaagataggattgcatactaaaatttacttagatctttgagaactcaaggaaatcagtgaaacattattgttattaaataaaaataaaatacctgtagttggtacctctgtttgagcctgccttgttacaagtttcactgacttcagcttcgtgtaacaaagtatctttttctttcaacgtgtacttaaatttcctgtcttattagttttctgatatctaaaaggaaaaaaagcagatatcgttaataaattagaaagaagttctgcaaatttaaaagtgccttctaagctgagttgtaggattacagtacaatccatagggttatcctgaagaagccaggcagggctcttctgtgttacaccctgtgcctgcgcagcatgctcaccccttgccatcagcgcttgcggccccattctctccctctagtaataatctaagttctgcattgctttctcctttccttttctttcttcctttaaatattcttctttcgagacatatctcattttaacttttattttcattttctgtcacttttggtttttctcatgccaccttggcaatgtagttaagtttgtgctaacgtagaagattagtgctcaaatctgaattgccatttactactagctgtgtcatcttcggcagggaatctcccagagccttagcttctttatttgtaaaatgactattatagtggttatttctcaggattgttagaattacttccgcaaacatttgcaagtccctggttcataatttcatgctaaattagtaccgttacaggaagtggtatatcattgtcacagtgtatacaaatatatttcttttatatccctcgtgatataattatcaagacagtgaaacaattcaatgaattttaccagcataacacatttttaagtgattggaaaatcataagtatcttttcttatgtttttagtagaggctttgcaaccccattactctccgctcccaatttgattatttaaaggaagtggattactaactcagatatgtacactgtcaagccaagttctatgttctactgctggttttcctgagaaagcagtcatataactcccttgaaatgatttactacttttgtacatataaaattataatggtgttaatgtaccaaataatgtccttggaagcaagggttttgccagtaactcagctgcatcagtcaccctcaaggagatgagccatgactttgttcattagttggaaaagagtctggagagtgccttttcgttactgtttatctttggtctgacacttgggaatagggtcatggatacttcagccagaaaactttccaaatttaagttattaatgtattataaggatcaaagtttctagtatagcctgttcaattagaacatagtgtgttggttgattggatttggagaaagggaggcaatcaaatttttactacagtttcagcctgttacagaatattgtatagagtgttaaaatgttgatgcattcatatttttgccagttttaagcttgtacgattttaaatcatttccttaccttggagacttcccccccacctttttttttttttttgagatggagtctcgctgtgtcgcccaggctagagtgcagtggcacgatctcggctcactgcaaggtggttctcccacctctgcctcccgagtagctggggctacaggcgcccgccaccatgcctggcttattttttgtatttttagtagagacggggtttccccatgttagccaggatggtctcgatctcctgacctcatgatccgcccgcctcggcctcccaaagtgctggaattataggcatgagccaccatgcccagccctgactgccctttaagatgagtacataagtagtagtagtacatttttctttcacatcctggagaagatatactgtgttcactattgaaatgaaaccataaagctagagttaggaagattgaagaaatgaaaaaggagctcacatgattttgtctcaggagaggctcttccaggattctttggagatatggtagattccatagctggagcagggaaaggacaggatgagcctgtgggtgtagaaaggaagggagtgcttgaaagatgatgaggagatgtcagcaggtcacagaaaccctctgaaggaggctccaactggccaggctggggacaatttgggccccaaaataatgacagtaacaaattgtaactcattgaatgaaataggaatccatacattggtaattatataaataagggaataaaaccatgatgcaaaaagggatgtttatgtcatcacgcaaaatatgttcacagaaaatatgtactaattaaaagagggaaaagagtaactttacagtggatgaagcctggcaatcatcactttaagcaagtggtcagagttaatattatcagtaatggtcaaatcaaaaccatatgcaagaagactctaaaatgcaagaagactcctgaagtacttcttaccaaagatgtagaacttaaattcagtcataacaatacatgagacaaacccaagttagagcacagtctgcaaaataactggcctgtaatcttcaaatgcatcaagatcatgaaagacaaggaaagagtgaagagctgctccagttggaagagacttaaaactaaatgcaatgtatgatcctagattggatctttttgctctaaggacattaatgggccagttagtgatatttgaaggggatccgagggttccattgtagtaatatatcagtgttaatttttaaatttttattaggttgggattattttggaaaataccattattcatagcgaatacaaagtagaatatttggggatgataatgcatgattacaacaaatgtttcaggagaaatatgatctttgtagtggtcttgcaacttttctgtaagtctgaaattgtttatgcataaaaggttaaaaaaaggttaaattttgtttttataactaataatggattagggtcatgtgaaagtactttagaggaaatgagacttttgagaacatcatccctgaagacgttgaaacactgagttacctcatggataatttaataggatatgcagctgatttttctaccttaatttcttgtttgcagtatctacccatacttagaattgtctggtgttaaaatatgcccactgggactttcatgaaattcttttgattttctagaaaattcagtttcaaaggattttttaaatagatattttaagtttggtgtcaacttagataaaatctgtttggagtcccagtgtaagttttagtaatgtgtccaatctgtttattgaaatagtataactttagaatactttctttggagagatgaagattggtatgttatagttcaattcaaagttgttctttctattatgatctattttataattcataaaatctatcttatgattgtcatcataagtgcaatttgttttttgccccattctacctcagaaactaagtatctgggcatcaataacaattggtagtagtgtttgctgctaagccaagtttcaccagtacagtgtggaattattttattgttttttctgtgaacattgtatctgctgttactaggttattgtgaggtattgggccttcatagaaattgcctggaacccttgttcactaaagcctgttacactttttattctctgtgcgtgtaatcagagacttattgatactgacacattcaaggggcattattgatcatttagattgctctaagacctaaggagtcttggccggatgcggtgcctcacgcctgtaatcccagcactatgggaggccgaggcgggtggatcacctgaggtcaggagttcgagatcagcctggccaacatggtgaaaccccgtctctactaaaaatgcgaaaattagctgggcatggtggcaggcgcctgtaattccagctactcgggaggctgagacaggagaatcgcctgaacccgggaggcagaggttgcagtgagccaagactgtgccattgcattccagcctgggtaacagagcgagactccatctcaaaaaaaaaaaaaaaacgaaaaacaaaaacctaaggagtcttttctccttattttacaataaattccttttgattttgtgtaaaaacttgaaactgtttatgaatgtaaaataacatttgaatacttttcttgtgccagatattaggttaaatgctttatgtgaattttcatttgattctcacaacttttgagttaggtagttatttttctcattttacagatgaaatggagggttaggaactcgtaggtagtagatgctgaagctgagatttgggcctgggtcttttcactactgtgccagaatcatttgggagggagtaaaaactcaagcctttggaaaatatgatgacataaaattgtcctttatattgagaagcttccatagttaccagtgtccttcacagggttgatcggaaagacatacatgttagtgatgatgataatgatgaagataatcattattaccacaggtacttcctataatataagcatctttcaaattgtatgagaactttcatagaacatctgagtaaatgaacagtacagtgtgcatgaaaccactaagcaaaccaagggaagttaattttctttatatgaattgtaaacatgtctctagatatcctttatcagattccaccatgcgtaagtagtgtctaagttgccccatatttagagtttttcaatgaggttgtgttcctacttagaatcctaaagttcagctataacagatatattaataaaatctgtggaatctttaattgagcataatggtggctgttattttaacttgaggctttttgttgagctggattggaagtgcaacttattagaaattacagtgtatttattcctatttcttgttctttatgtgagagaagatatactttagtagactgaatacttcagagctgtatctcatttaccaataaaatgtgaaaacagtggtaaattccttcacttgggctaccattgtacaggcctattttaatggtatagtttgatatccttaatgttaaaagcaatatagcttaaagaggctggtaaattagaattttccaatatcctcagctttttttcctctcacagttaatttgctctgctgactccctacgcgaggtggcaacagctggcccttttactggagcttgtggggattagagagtcgggctcgcagcagcgtgctcggcctcttgcctctgttgactgttctttattgtttgatgcctgagcatctcccagacagcgagcaattgtttctggaaacttaaagtttgtttctcttgggagtagacaatgcttttggggcttgtctttgtgtttcttcactttcccagtctcctcttatccttcatcctgtgctttctcttgataattagaaaggagcaaagataccacctttttatttaggtctgcatgagattctaaaacttagaagtataggctatagatgaaagtttcttttttcagtaagccacctcagtaacaaatcatgttttaaatgaaaactttgttcttcataatatcatttagtgagagaaaacaaatgcatgagtgcatttttgaaattatggtactaaaagggagcagcagcaaggtgacctaatactgccattttaaaagctaggattagaaatgtatcataactgcttaaatctaaaaagattctttcactgaatccaaaatatagttctaatttataggatagttataagaaatctctatgccatgtggaaacatgaataaaaagtagtcagaacatagctaaatagaaccctgaggtaggcagaatgattttattcttcacatttagaaaagaaaacatcaaggtaccctggaacttaatttctacagtgacttcacattccgacacttctcccatacctgccatacccttgagtgttgttacggatgagaatatcgtctgtgaagtagtatgagatggaaattttcctagaaagattattgtactcggaatttggaactgaaaagtgtagaaaggggaagtgatgtgtttaaaactgtttgcggaggtggggctctgccatgtgtattttgacaaagctacacaggtgattcttgccatccccgattaccgtgtacccgcctgcccctgagctggcactccaaagagttctttcagtgcatagcaagacaatttttcatgctattaattgggataaaattgacatacattcatttgtagagtctgagacacaacgtcactttggaaaatttggtgagcaatttgaactgcatctgcactggtgtgttctttttgtttctgtagacttaaccaaagaaaatgaactttaaagggactttaaaggcatctgcactggtgtgttctttttgtttctgtagacttaaccaaagaaaatgaattttaaaggaagagagggtgataccaagttgtagaattctaggtatgtaggttcagaggagattttttttttttaagaaaaaaaaaaaaaaaaaaaaaaacacccaatcaagaagaatagagcagggtgtcccgaagagaacgtgtgagctcgaagcatcccggcagcatctttcatatctcagtactgttgctctgtttcttgggctcacaacaccatttcctctctcctggcttttaacacatctcgaggcaaccttttccctttctttttatgcacttctctcactgcgtctcttctatatcatcatcacttcaacctaacccagtatttttatcccacctgcttatttaccttccttcagtgactaaaaaccttactcagatactgccagtgttgtttaattgagcagaatagaggcttctcactataggcaactgtaaatcaatgaaaataaccatttaaagaagaaaaacattttcatgtctatcacggtcgatcccttctgccaaagtgatttggttcattcataaattccccatacctcgtgtgttacatattgtactgtacacatttactgaatgttcgattgtgatcttgtaatacagactgttcattagcccccttctcttgacttaaaaagttggggggaactaactcttttcatcccaaggaaactttcttctactctgtcttgccagaaagttactgctcatttctcttgtagagcagcttgcctgtgtggcattcactcctgttctgcccactcccttcctaatatcgtgcagtctggctttcatctatatcaaaaccacttattgatagatcaccaatgatttcctaatgccagtctacccagttcaccaggaaactttaataactttttatgtttattaggaatttttaagttcattggaatacattcaagtactttttggaatgattatatgatgtagaaatgtgtatgtttgagagacagaaaaattgatttttttttcctcttcactacagaataaataatgtatttgttttatggtagcaatacttgaactctttaaggcatcttttcatggtaaatctggcaattttaaaaatctgggctttgtaaaataattttttttatagtaaggcagttaacacattaaagcaactaggaaagatagtgaagaattatttttaccttgagtctgtatagatgaagtaggctctgctttgtgttggaacagaacaaacaaacaaaaaaacctgagttgatacaaagataaagtaatcctcaaggaaagtcctctctgttagagaagtggttatttacacacagaattccacatgacaacgcctgagtggtgtggtttccaggttattgatgagaaaatcgagactcaaaatgggtcttttagaatgaagtacatttttcatggcctaagtctgtctttaaaagtcaccgttgtggccgggtgtggtggctcacgcctgtaatcccagcactttaggaggccaaggtgggcggatcacaaggtcaggagatccagaccatcctggctaacacagtgaaaccccgtctctactaaaaatacaaaaaatttagccaggcgtggtggcgggcgcctgtagtcccagctgctggggaggctgaggcaggagaatggcgtgaacctgggaggcggagcttgcggtgagccgagatcgcgccactgcactccagcctgggtgacagagcaagactcgtctcaaaaaaaaaaaaaaaaaaaaaaaaagtcactgttgaagaatatcaataaattagtacaagcgtaaaagaacattttcttttctataatattatacatgctgctggtaatcaacactttactagcaagtatattcttttgctttaaactcaagttttaactgattaagaataaagacaagaatgttctctacaataatgtatggattgaatttgccatttatcattttaatgtaggttttacttatatactattgtgaaaatactcttaatgtattcaaaaggccagtgcacaatttttttttcttttacttcttttttttttttttttttctttagaaagagtgtcacttgctgcccaggctagagtgcagtggtgtgatcatggctcactgcagccttgaactcctgggctcaagtgatctaatacctttaaagttgggaataaactttatcttaagcgtttttatttttaaattatgtttttgcatatttgatagaaaaagtagaatgtagtaattgaaaacctaatcacaaaacaattcattggactctgcaacagtatataaaaaataaaattaaacgagataggaaatcttaagggattggtggattgatgcacatgaaactggtaacctctgttaagtacagttctccaggtagttggagaaattagttaaatgtgaagagaattttaattttgcactattttgtacatttctaaactgtgtctcccacagcccttctcccccagtgagcacgattcagaattactttgaaatgttgtagtcttaattatcctattcatggaaatgacgaagctaatacacgatgtgctctatcttaaaagtaacagatattttcccaagtaacctactgctggttgtgatgctgagggacatttcatgggactgcatggtcgttgctcatcgtgataccatcctcagtggttgggggattcacagtgaattctcatatcctgtaactatgcatcatggatctatcatctgaaaataaatcaaaatctttgttgaactcacagtttccacacttgtatcacccatttaagattgtttcattgttacctcctgtgtacagaatatttcatttcaatttctcttagaacagctcattcatctattctctagtttcaatattctgagcagtagaagtttgctgttttgattaacttcagttagatctcttttctgggccaagaattaaagccattttatctttagtctctccttttgttggcactgcttcatagactgtgtcatatatacagatctgtctttagactgatctttaccaaagtacactactggaatttgagggtttttttttttaacatccttttcattatgagagagctagtgtatatgcattgtgggaaattagaaactatagatggcaaaattttaaaaaataattgccaccacccagagattgcactgtagtttaagacacttttgaatgtggtcctagggacataatttctggaacacatttttcgtgaagaggtctcaggttggcttcttatacccacagctcgttgtcattgcccctagttttaatttcccatcgctcagtgggctagattttttttcattttcttcatataaacttatttcagaaatgttcattaagaggaataagcagcattagtaaaaatgaaacctatggtacccattactttatatagttcaagtattctggaagccatattgtagcatagcatgtactgaaaatcactctcctttgaacagtaatcccatacctgtatttgggacctggccttcctttgtgtgcttgtgtattcattatatcccctttctctcttcaaagatgctcaagtcattctcatcttaaaactaatgggttgaaccttccatgcagtctagtagctactgtgaactctaatctctattacaaaggttagctctttgagtctcacttctactgaagttgtttttttttcccaagattactgaaaatttaagagaaaataatggcccaggcatgcattcaggactagaaaatacttccatgtacagaaaaccaaacaccacatgttctcactcataagtgggaattgaacattgagaacacatggacacagggaggggaacagcatacgccagggcctgttggggcgtggggggcgaggggagggaacttagaggacttaagtgcagcagaccaccatggcacacgtatacctgtgtagcctgcacattctgcacatagagcccgcttttgtttttgtttttgtttttaagaagaaataacggggaaaaaaaaggtttcaaaactcataaagaaagagaaagagagggagggagggagggaagaaaatgcttccatgtaactgcatcatttggtactttggagtccatatcctacttgaaactctaggatctggccctcacatttatgtagtgctttattttacagtttacaaaacttctgcttgtccatgtgtgtctgtaaagtcatatgaggcattatgcccattgttcagatagagaaattaacgttcattgacataaatggttaagcccattatgtaaatatttatggcaaagctggggctaatcatatgtgttacagataggactttttttaaagaattgtttaggtattctgttcatcattagtctctgggtttgtgtttgtggtaaccatagacaaccaagttcatataatttggcttcttttttatgtgatttttgatacgtgttaaggatctataacaatgaatttgcctcctaaagaggtacataatgttttcattcctccaaaaagataattctaggtttataaatctatgtatgctcagtgccagttgaattttgtgattgttcaatagaaaagaaattgtgacttaaaggtgattttccagtttaatggaataaatgaaattagtttagaagttatttttatttttctgagcctgattctcactcagttgtgataaacagcacctctgtaagataaactcggtgataaaccgagaacttctgaaatcagcctaacatgaatacctgttcttcttgtgctaagtttcataatgctttatcctaatacaccatttttttaagaaatggaacttgtatttcatttttgctttcatctcacctaattcataattttattaaaacctacgatttttaatttctttttttatgaatttttagtttggtgtataaatcagaattacattctctgatcttttacttttaaaattacagtgatgaactgactgtttaagaatcattctcatgattcattcgtctgttatgcctcctttttaaagcttcagcactgaaggtcttttgacaaaccaatatttataacagtttgacagcaggatgaggaacagcgtttgtctttgtaacagcttgaagaaagaccctttccaggacccagtcatgcagttacaatcttgacctctttcttatgctgggaacatgcatacagcagcacctcccatgtgttttcttgtcccattgactgtccattcacttcccatctgttttgcagtcttaaaggaacagaaggggccttcttataaatctgtctttgcaggtgataaatgatgcctacctctttaagagctgcctgggtggttttccttttcttagaacatttctgctttcctcctaactaaatcagggaaaaatacaattttaggaataagagaaaaagaagaaaagatgaatttttaaagcatttaattgactaagaatattttactgatcttttttaatcttcccaattaattgcctaaatcatattttttaaaatgtattatcgatatttagatttttgtcagggagtaaaatgaatgtattcattttgaaataatgtaactcttttttgagaaaacaaagccatgtatcattaatgagttaacatataaaataactttttaagttttttgtgataatttaagtgtggagcatcttatgtattggatacaaaagtaaaatatttcagagtaaatcattgtaatcttatggtaaaatctattcattttttacatttaaaaagatgatcataaatcccataaacatttatgcttttacttctgttgctgaaaataagtattgtaggaatagatattgatatcattgggttttctaagaattcagcagaaataaaaataatttactttttctcccatgcagaaattatttatgcaaggttttatgtaacaaatattgtccctctatggccctgcagaatattcttaaattactgatttaaaaactattaccagtataaaatgaccacttttagaatattgtggtgtattatgtgaatcagctggctaataatatatcttctgtggactagcttgttagtttgtttattaattccctggcatattccaaaaggaatttgaggcagcttacatatatcctacgcaaaagataaaactacttaagtgaaaaatttgggttgaaagaaaaggaaaatccaggcaagtgaaataaagtaaactttcagataaaattggtgcccctcaaagtgcatgctcaagggttctacgtacaggcagacctcattgtattgcatgtcactttattgcacttcacagttattgcatttttaacaatagaagttttgtggcaaccctgcattgaacaagcctgttggcactattttcccaacagccatgtgctcacctcatgtcactgtcacattttggtaattcttgcaatatttcaaatttttccattattattctgtctgtcatggtgatctttgatgtttgtattgtagctattttgggtaccactaactgtgcccatattagtcagtgaccttaatcagtaaacgtgtgtattctggctgttccaccaactagacattccctgtctctctcctcctcttcaggcctccctattccataggacacaacaatattgaaatttggccagctaataaccctacaatggcctctacatgttcaagtgaaagaaagagtgccatatttcactttaaatcaacaactagaaatgattaagcttagtaaaggaggtttgttgaaagccaaaatgggctattagccaaattgtgaatgcaaaagaaaagttcttgaaggaaattaaaagtgttattccagtgaacacacgaatgataaagcagaacagccttattgcctgagacgcaggaagtttcactggtctggatagaagatcaaaccagccataacattcccttaagctaaaacctaatccagagcaagttcctaactctattcaattctccgaaagctgagaggtgaggaagctgcagaataaaatttgaagctagcaaagtttggttcataaggtttaagaggaaaaaagccattctgcaacatgaaagtgcaaggtgctgatgtagcagctgcagcaagttatcaagaatatctaactaagataattgatgaaggtgattatactaaacaacagattcttgatgcagatgaagtagctgtctattggaagacgatgccatctagtaatttaatagctagagagaagtcaatgcccagcttcgaggcttcgaaagagaggctatcccctcattttgggtgccaatgcagcaggtgcctttaagttgaagccaacctaaagaatttaccattctgaaaatcctagggcccttaaggattatgctaagtctatcctgcttgttttctaaaagtggaacaaaaagcctggatgacagcacatctgtttacagcatggtttactgaatattataactctcgagacctgctcagaaaagttttctttcaaaatattactgctcattgacaatgcatctggtcaagcaagagttctgagggagatgtacaaggagatttatgttgtttttgtgcctgctagcacaacatccattctgcagcccatggatcaaggaatactttcaaccttgaagtcttattattttaaaaatacgtgtcttaaggccctagctgccatagatagtgattcctctgatggatttaggagaaaaaaaaaggaaaagcttctggaaaggactcaccattttagatgctgttaagaccattcaggattcatgggaggaggtcagaatgtcaccattaacagtttggaagaagttgattccaaccctcatggatgactttgaagagtttgggacttaagaggaggaagtaactgcagatatggtagagacagcaatagaactagaattagttctgttgtaatatgataaaacttgaacagatgaaacattgctttttatggacaagcaaagaaagtggtttcttttttcttttttttttttttggcagtctcagtttgaagaaagtggtttcttgagatggaatctgttcctggtgaagatgctgtgaacattgttgaaatggcagtaaaggatttagaatattacataaacttagtagataaagcagctgcagggtttgagaagatagtgtcccaatttttaaagaagaaaaatttgagtaaatttgggtaaaatttacccaaaattacctattgtgggtaaaatgctatcagacagcatcacatcctactgtgaaatctttcatgaaaggaagaatcaatcagtgcagcaaactacaattgttgtcttattttaagaaattgccatagccaccgtaacctgcaacagccaccaccctgatcagtcagcagccatcaacgtcagggccagaccctccaccagcaaaaagattatgacttgctgaaggctcaggtgatccttagcatttgttagcaataaagtacttttaaataagttatgtacattgtctttttagacataatgctattacacacttaatatattacagtatactgtaaacgtaacttaaacgcaccggaaaaccaaaaaaccttatgtgactcactttattgtgatatacgctttattgtggcagtctagaaccaaacttgcatatctcccaagtatgctgggactttgctagaggtaagctgcaaatttagccctcagtttcctggtggctggcagttacaaaatggaaagcagaggtcattccatcattcatggtggccatcagacaacaacacagcagttgcttaggagaagcatgggtcttcttcgtacgcacaactgagagaaatttcccttaaagtggacactgagttagatgatacaatgaatctaatggctacacataatcatgaaaatcatggggccctttattgtaatgtttctcatgcgggctaacatgcgtagttctagggaaaatatgatgctgtccaaacatacagctatttggtttggcttatctaaagataaaatacatagtatccagagaaatagatgaactgtatgtcctccatacagtctcccataaatattatttctttttgcagctgatccttttagtaaatatcaggtagccagaagttcaagattttacactcattgacattgacaagcacctggaatggtactaccttttttttttttttttttttttgagacagagtcttgctctgtcacccaggctggagtgcagtggcatgatcttggctcactacaacctccgcctcctggattcaagtgattctcctgcctcagcctcccaggtagctgggattacaggcgcccgccactacgcccggctaatttttgtatttttagtagagatgggttttcgccatgttggccagggtgatcttgaactcctgacctcatgtgatccacccgcctcggcctcccaaagtgctgggattacaggcgtgagccactgcgcccagccaagtactatttttattagttaagtcagagccataatcattataactgagctgaaattagaattgccatccacttaagaaagttgagtggtctaacaagtataaaagcctaaatataaggctaattcatgttcatactgaagccttttggggaataggccttaaaatatgtagaaagtatttgaagcggttttaattgtactagccaaaaggagcctagtagaaatgcttgtgttataagagtttattttttaaaaagctgaatttatctgaccaggcgcggtggttcacgcctgtaatcccagcactttgggaggccaaggcaggtggatcacgaggtcaggagtttgagaccagcctagccaatatggtgaaaccccatcactactaaaaatacaaaaaaattggccaggcatggtgatgcctgcctgtagtcccagctactccggaggctgaggcagaagaatcatttgaaaccgggaggcggaggttgcagtgagccgagattgcgccactgcactccagcctggacgacagagcgagactccatctcaaaaaaaaaaaaagctgaatttatcaacaaattgctgtggagttttttatatattcagcaggcatcagttgtaatttacctcacagactttcttaaggttgctttctttctaaattatactttatgggggtcacaaaatagcaatttttaaataatcacctttaatgattaagtattgtttaagtcagatcactcaactatgaatgcatgaatattcatggacatctattacatagcaagcagtgctatgctgggccgagtgattttaaatgacagactttttggtaagtagagaatttacccaagcagtccttgctgttctccacattaatgctcagaaaaaatacattataaaaatgatctttccaaaatgaattatgaagccccatgagaatgatatggcaatttgtggttacatattttactagaggattaatatccaataaataaaaagatactaaggaataaacaaaaaaaatttaaaagatgaagtatataatgaattagaacaatacattttaatcataagttttaaattagtgtggactttgaattctcctggacagattccttcattttatagataaagctaggactgtgacttatccagttatgaggttaacggcgaatacaacattgtcatatattttaaatgacacacattacaacatgttctctgctttataaaaatcatatcaaataattgccccatagattattaaaggtgttagactagggattcttaaaaaaaattttcatcaaatgtttctttcattattaatcccatgaagtccatgttacagaagattttgtctacaacagtgcagttacattcttctcgttagaaatacaaccaccagttagagttcctaatcagtataaggaagtagttgttaggagaggggatgggtttcttgtccaaatgaagttttccatttgagtttttgaagtagtgaaactaacccagcgtttacaggccccagaaatctgggaacctcagctttcaaagtactgtaccagtctttaacagttttcctggacgtgtgaattgatgcctccttctgtaacatgcaggagtgttctgtctgtcttcattgagtgttaaaaaataatcatgcctatttcaaggaaaaaatctacagaactaagatgcagaagataagtgctagatttaatcatattccttcatctatctgtttggttcaacctttcatcaactaaaagatgcaccttttttcttgtgctaactctaagattttagctacagttttgagaatcttgagtgtagtctcttgtttaccttttttcctttttttgtttcccccacaccctagattcatttaaatactgaacttctaaagggcaagtatatagtgtagtttaataaaaagcaaaccttttcatgaacaatatatattacataataagaagcgttcctttacttttcagtactctagtgaatagctttctacagtagaatctcacttagagggtgtcttaaagcttaacaccaagtgctcaggcagcatgttatacaacagttccattaaggtacatttggatctttggatgtgtggtttgcttaaagtacactgcattagtaagttggcagcttgctttctttaaaaacatcaaaagttttaaaaggtttatttcagggcatgtgttagtgttttgtgtgtggttctttgttcctgttctaaactgttattaaccactgaagtgaaccttctcccgggtttggccttttggtattcacagtgtattcaaaacctaattacagattagtctatatttgagacttttagagcaagtatcagaagacccaaaaagaaaatgagagtagcagtatcatttcatgtagagataaagagacccaaaacatgaatgggtgtcaagtcagctgaagaaaagaaaaaagagaaggaacttcattcactgagacggtttatgagttggggattatgggaatattcatgactcaatcaagaagcacagtgaattgatgtttgaaatagctcatcttttaagtaaacattggataaatggaaagtagactcagtattcactacacgtagaaatagctatttctgtatagcagaaatagcagtttgttaatcccttcctgagttggtttaatttaccaagtaaatcacaaattttattctttatttgtgaatatttaattcaaatatttaatggaaatatgagtttgctttataattagtcatgctgatccatacacgtatttctgagagaaagcaatttctaatggtgaaatagttacaataatatttttgaaatttgaaagcaccgtgatactgaagcattaatctgaaggatcggaaagtagggagtttttgttgccaacatttaacttcattgtttatggataacttggttttctgggcagccagatggcacagttagtatacagacattcttggaaacttgtatcaaaatttaaaatgaatgaatttatgagaaataattctgcttattatttgtaatgtagctttcttgaaaagcaagaaatcggaatgtagtttctaaagctgcaagtgaatatgtatacatagccagctctttcagccttgataataaggtgcaaccattaagatgaagggatttttttttcccacttgtgtttttgggcccgagtatcctgatctgtgttgcttgtctggttcaggtgtgagccaccagctttctttgactttcattatctatgtgtatcttgcctcctgttcccaggcttgctctagctcttctgatcctgtcttcctccctcttgatcactagtgtagtattcatgaagccagctaagttagtttttccctttgaaaaccacagcccttatcttctgtgccatattttgggcaacttcgtttatcattgattgaccgtacgcagtgatcaggccttgttctagacactgaagactctgagcatttttgggcccattttgtactcctgtattgttctccaggggcttctccaagtgtgcgtcaatttagtcttctcaagagggcatcattttcatcagaatatgatagcatattatggagtgtccggtcatccttaggcatagactacttaggaggtgtaactgttttgttccctgatttttactgaaatgggtcttttctttttttttttttttttttttttttttttttttttttttttttttttgagacagagtctcgctatgtcaccaggctggagtgcagtggcatgatctcagctcactgcaacctccgcctcccgattctccctgaaatgcgtcttattttaagtcaaaggtaatacttaaaaaagaccaaagagacttaaaataacagcatttgcttcgtcactatgagctttgttattatgagttaacatacagtagcagactgggtgtagtagctcacgccctgtaattccagcagtttgtgaagccgagtggggaggattgcttgaggccaagacttcgagaccagcctgggcaacatagtgagacccccatcttgacaaaaaaaattgttttaaattagccaggtgtggtgctgcatgcctgtggtcccagctacttggaaggctaaggtaggagaatcgcttgagcctgggaggtcgaggctgtagtgagccgtgtttgcatcactgcactcctgggtgacagtgcaagactctgcgtcagacaaacaaacatcgtagcagatgtgtttcttaatcagagaagtgtagacaaggctaactccaggctttaatgtcctcatatttagcaatgatacctgcaaggttgtatgagaaccaaatgaaacgccaaatttggaaatacatagtagatacatcatagcagagtaagccaggaatgcttctcaaaggtaggatatcatctgtgtcctcatatcactttatgaagtacattgtgaaagtgaaagaacaaagaaataaatgttttttagttaatgtttaaaggatacatttatcataattgctcttttaacactcacctccagtctcccctccgttcacacctcctacccccattacttcctggtaacttagttaagtgtcctttgtcattcctgaggtttcaaggcatggtagtactgtgtcctgatattctaatcgtaaatatttaagggaaattcggcattttttcattttgtggttttcatattaaagtacattaaatagtctttttgcttttatttaggaaaaaaactgcttacctgttaattttagaaaaatctgattttcatttagaccttacagggtgagacacctgcatcagggtggctcttggtatctttcaattcaattggatcttctctgaatagtctcttgtagggagtgaggctgctgtaccacctccctgcagtagtccatccagcttaagatgggggtcaccagtaggccaaaagaatgggtagacctggccatgcactgccctattgtactcaaatcgtgtatcaaatggagttggatttcttctcttcatacagtacagcatttccaagtagaaatatttctcaatgaaatgtggagagaagcacccgtttgagattcccgtgtgttgtgtgatttaagttagatggttttttaagaccacattcatttccagcattctaggtaacaatttagaaaatgtctttctcctaacctccccactttttaaaaatcctccaactgatgaactgatgtgaaactttcttacattcactgaaaaaaaaaaaaaataggttaagctgtttctaagcaactagatgaattaatttttaaactaagaatgtggccttattttgggaaaacaagaatatttacttgtttgtctgctgtttaaaaaatggaagtcagcctaccaaaaaattgagactcaacttctaggagatgggttaggatttttttttttaagtttctctagtttaattttatatataaggggttaatgctaccttcataataactattatcatattttctcaatacatagcttgattaaaacaactggactccccccccaccccaccccacacacacacagattttatatcagtctgaatctaatgcctagaataagaagtgcttcagccaggcatagtggcactcacctgtagtctcagctactcaggaggctgaggcagcaggatcaattgagcccaggagtctgagtctagcctgggcaacatagtgagacctagaagttttaaattactggaaaaataatatgaaaagaataaattactggaaaaagaatatgaaaatgttacgttctttatatccaaccgtggtaggcttttttgagttcctgcaatgctaataagaattcataaaaaggacaattcttcattttcttgggtactcatcactaatagctgcctcgctggtaaaaaggaatacatgtatcttcaattgcagattatttacttttaaatataaaagatataaatgtcaaatattaaatgcatcttacatggttttcctacatagtgaaagtagaatgcttgccagttttgcctctaggtcactcactttgaaccagccaacccaccttaattgatcatttccactaatatgttaaattaccttaaaagaacaaaaatatttatcatgcttactataacctgtgttttaaaataggaggccaggcacagtggctcacacctgtaatcccaggactttgggaggccaaggcaggaggatcacttgagcccaggtgttcaggaccagcctgggcaacaaagtgagatcctatctccacaaaaaaattaaaaataaaaacttagccaggcgtggtggcacgtgcctgtggtcttagctacgtgggaggccaaggcgggaggatcacctgagctcaggaggttgaggctgcagtaagccctgccaacaccactgcacgccaacctgggcgacagagtaggacccccatctcagaatataaaataaagtaggaggtgcatgtgaagtagtatagatcatgacttttccaattttaagaggggattggcatgtactatgagcagttcacatttgtggaggaaatctacatttcagagagtatatatttcatttggaagtctataaacatgaaaacctaaaataaataatgtaaatctacctctagtggctctggtatttttaaacttatttatagctggcaaagtacttttttgtatgtatttttatagcaccattgcacttctcatgtttgttgcaagcatctcccacagcttcctttgtcttttaattttatgacatataaataaaagtatacatttcaatatggccatattgattgatcttttcctttgtaactcttactactttatatttaaaaagtcatttcccagtctaaggccacctctattttcttttagttttttaaaatggtttcattgttttatatttgcctatgatccagacattagtaactgtgggttcttaattgggcttcagagaatctgagaattccttaaaattctctacataattgtacatgtacttaatacatgcttttttccatgttaagagtccagagtttttgttagatcctcaaaggggtcagtcagtctctcctcccacttccaaaaaatgtctgagacctactactataatccatctggactttatttgggtaaaaggtggtatggtgagactcatatttttctttttcccgcaaatagttaagtataccaaccatttagtaaataattacctcctgatttgtgatacctttgaaaaataaatgtttttctttatttttatctccacag

SEQ ID NO: 103 - DNA, 8809 bp, Homo sapiens
  source 1..8809: mol_type = genomic DNA
gtgagccagggcagggggctgcagcggtgggcgagggggcggcggctccttcccggcgggcgcttccgcggcctgaaaacggtacccgccgccctgccccgcggcccggagcctgtcggggtgagggtggcgaggggtggggcggccctcccgcgagacggctgccctgggaggatccccaagcctcggcgggtcctgacctggtgggagagggtgggtagtgaacacagggtgggcccaagaagggtccagggccggcctcttggccgcaggtaacccctctacaagtcacccagagacttggaggtgacgtcctcccgcaggctgggaaggattccgcagccagttcctcgccataaggaggtggttacagacacgcctgtgggagacatgggaccactacccgagctgaatgaggtgcccagggtcggtgggaatccacatagactgctgtgtctaggagagtgtgtacactctatatagagagaatatttgatgaggccgagaaccccaaaggaattgtttttgccatcgaaatgcataagctacaggaagtaaacatcgctcaaagaaaatgaaacccaggttccgacctggcctccaccagcaggaaaactgttgtatggaaatgtacaccaaggaactgtttgtaaggatgaaatggaaaatgaaagcatagaaaagtaaggcaatgtgaggacctcagaagcctttggatctggttagcaaggtgcaggctgtgtgaacagaagaacccaccttgctcttttgacccagggagagaagagttagtggtgccaggctgcctcccaggacaggcccagttttggggcgggggctggagaagtcccagggcagaccccaaggccagggattgccctggagtggacaaggcaagtttaaatgtgacctgtagacagaggacgatcattgatttaagtcctggcataattcatctgtttttccactgggccaattttaggcgttctttatatattacgtacaacacaataaaagtaacagcttctttttttataaactaacctttaggttgcatattatgctaggaatataactaacctaacctccacccccccacccccccacccacccccggaaaaccaaactttattctcgagggcaactggacactgtattatgtcctgccgaacccccgcccttacttaggtagaggcgcataagtattctggccatgaaatacaccttctgttttatagagatttggcatatttgatatatgttctttggaatttatgaaatagaaaacccaaaggaaaaagaaaaaaattaaacttttttttaaaaaaatatttcatttagaaagaaaaaattaaaagtttttgttatttccactttgacatgtgtatgaggagcattagaatctgtgttatgaagtgatacccagatggctttgcagtgacagaaaacacttctaatttttcaaataagttagaaaggaggattttgagaatctggaagtgaatgccgtggaactgtggagaaactcctaacaatactggcatgctgagtttgtcacctacacagcagaaagcattttacaggtattagacttaaaaatacctcattatgctatattttcatttcatttcaaccaacatttactgcaagcctgctatgtgccagtctctagtaagaataacatggagagaaaatagacgggcagacgatagcagtaatttcagaatgggcggaggaggtggaaatgcagagtgttcttgggtgctcggagtagggaacagttcatatgacacaggacatcatatttaagctggacattgatctgtccagtggaagtttgccaggacacaaggggagccagacatttcgggcagagggcagaagggaggcaaggacgcagagacagaagaatgcagggaaccgtgagctctttaacgtgccttgggtacgagtgttttggtggcaggaggtgactctggtgggtcagttgggcctgggccctgaaaggccacgtttgtcttgttaagaaactgaaagtctgtcgtgtatgggaagggtggactcaggggaatgacctcatattgcaaaagaaaccatgagggcaagaggactgaaattgacagggctgaaagccagtcatttaggaggctgttaaaatgtattcaacagatatttaccgagtcctgccttctatgtggcaagtaatgttctcagtcctggggatacagcagtggacaaaataggcagaacccctgtcctttgtggaggtcaacatggctgtggtacagacaagataagggcctgaactaagcctgtggggatggagaggaggcagtggattttagaaacacttagaagggccaggcatggtggctcatgcctgtaatcccagcacttagggaggccgaggtgggtggatcacttgagatcaggagttcaagaccagcctggccaacgtggcaaaaccctgtctctactaaaaatacaaaaattagctgggaatggtggcatgcacctgtaatcccagctacttgggaggctgaggtgggagaattgcttgaacctgggaggcggaggttgcagtgagctgagattttgccacggcactctagcctgggcgacagagtgagactgagtcttaatttaaaaaaaaaaagaaaaaataaatatttaggaggtagaggtgatggcatttggtgacccattagacttggggaaaagggggctgggaagaatcaagccttactcccaggttcctgccttggggagctaggttaaagctgctgccattttctgtatattactaaaatacgaagtcacaatatcccttctagtgtgtaatgacgaggctgcttttaccccattagtaggatgcatactctaagttctttttccaaggtgggaagggtttagtcaatgcaatgttagaatcttaccccccttgtgaacccaaactcttcatagcatttgccagtagccaactcttgtctctggtcaaaaagcaagttttcactgtttaaaactcatttatcccatgtagggattgaacctacgaatacttcattagcaaatttgaagacttggccataccagggcaagggcctaaccttatactatgtgcagtgtccactggggggaagtcagtgtaaggcaggtaccatttgacacattatgactttctgaccactagagccatcccacagtggaacagacagtgcctgctaaggtcactgcactcgtgctctgtcattgaaatactcaagcctgctctataggatcatgtgccatcgaaaccagacaagacattcttgcattgaatatattggtctggatcatttctaaggccaactcagcaatcagatgtatgctcgtgtttacaaggtcaggtcattactagaattacttgatctctggaatttaaatgtatatacacacacatgcacacacacacacacacacacacacaatcaggaattgagatagcagatctgggaataaaatctaggggacttgcttttggccatccatctactaggcagtcctcagtcttcctcattggtggaatcttgacaaatcctgtgctcaattaattcatccttccatcattaaatatcacttttgcctagaaataacatacttcacatctaggtcagttgattatgggaaactctgttatttgatagaatcttagaataaatggcttagttccaatttctgtaaccttcgaagacatgtgcaaggatatgtaatgtatctctgtctttcctcagttgaatgtagctcaaggtgatgttaaaaacagagaatgaagctttctgtaactggcattccaccgacagatatttcatatgtgcactgcacagtgatagctcatagtgatgtcctaagataacctaagaattatgaagtgccctttgagtcatccaaaatcagttaaattagtttttttttctttttttttttttttttttttgtgagacagggtctcactctgtcacccaggctggagtgcagtagcatgatcttagctcactgcaacctctgcctcccaggttcaagcgattctcatgcctcagctcccgagtagctgggactacaggcatgcaccactacacccagctacttttttttttttttttttttactattacaaaatttatttaacaaaaagtctaatatgaaaatgtacatgacctaacttttacatcatagtaaaacaggccctatggagagaggacatgggtttctctgctgaacagccattttttatactcattccaaggcttctaacatgaggatactgtttcctcgtattaccaccattccagtattgttctgttgcccactagtcgccatctccacacattcatctatcacaagattcataaagggatcaagtccctgcaatattccttggacgtgtctgccaccatttaatttcaatgataacttcttgtccataaatcccttctagccatctggttagaacatgatgctattcgagatgttcaacaaaaggtggcattcgagatcttcaaggaacgaagaagggacagcatgggggtgaccaggggcccgaccgcaggaccgggaggcgagtcggccagaaagaggtgcagtggctgctggtggtaactacgccgacgtgcgagctctgctactaatttatgtatttttagtagagatgggatttcaccatgttggctgggctgatctcaaactcctggcctcaaatgatctgcccaccttggcttcccaaagtgctgggattacaggcataagccactgcacccggcatcaattaaattacttttagtaaaattttggtattaagtatttacatgcttatatttaccgtttatgctaacttcttatgtttgatgacatttgaattacaaaatattttttctaacaatacacaatatcacagaatttgctgtcattaggacagttatagctattcatgagagtgactggcctgcccgtgatacttggtgtatatgcattgaagggtggggtttagattgtggtctttctagaaactaaagaatatttttcacagagttcataaggattatcatttgctggatgagtcaataaataccactagaggtcatgtgacttcccaaggccacacatctggctaatggtacaaatgtttttttctgtggcctcccttagcacgaccccacttttttcctcgtatgcttataaaatccgggcaatgtgagaagtcagaaacactgatgtaacaactagaaccagttttaactttattatggtggtatctgtaggcttggtggaggcataaaaggtcatggaggggcccggcaccgtggctcaagcctgtaattccagcactttgggaggctgagatgggtggatcacctgaggtcacgagttcaagaccagactggccaacttggcaaaaccctgtctctactaaaaatacaaaaattagccgggtgtggtagcacatgcctgtgatcccagctacttgggaggttgaggcaggagaatcacttgaatctgaaaggcagaggttgcagtgaactgagattgtgccactgtactccagcctgggcgacaaagtgagactctgtctgaaaaaaaaaaaaaagttcattgaggaaaaaaatcttaacagttttcaaagaaacgtctctctcttttcttccctctcttctcccctccccttcctttcattttcagaaaaaaaggagaaatttgtgcatataataagatgaaaccaaacacacttctaaaaatctgcttagatcctttctttaaaaaaatctgttgaatattttcatggcctttgcaaaatatagtataatcactgaatacctaagaaaaattaactgttggcaagtaaatgatacagatgacaaggattttctcttttaggtctattacctagaattttagtattcctctgcaaattaggtaggaacactgttactcagtaaaaccctattttaatgagatgattctgggtacaaaaaaatgaattttacagaaaattagaaactgatggtctattcagattatttttgtgagaagaagagcagtctgttctagtcacctaatgctaagctatggaacacttctgcattatacctgttttctaagtgaatttgggtgtgtgacacatagatacaaaaagttcaaaaatgaatcctatggtttatcagtgttttctgcttcgtaagattgccatcaccctcattacatgactacatgagaatgcccctcttggtactagctcttgtaggaagaagtggcacaggctgtactgtcacagggtgtggtaggtagctctgtctctgattacctacaagttcctcacaccaaaaggaggttaccaggtattgcttccagaagatctacagaaagcccaaggtattgcctcctgtggccaaggacgcaacaccacagtggtgcattttgttttattttaattgatggctattaaatgcacacatagatatcatgacacagttacatgtcagaaacaggcagtgctcttatctctatcttccagggactgatatcatgtgtaatggattcttcacaactcagggttcacacaggctccatagtcatgagtggctgatggatctcattgagaccagtgcctttcccccgttagaaatgggatgctcgcttccaagttctctcctcaccccttttgtgcatgcgtggctttctgcctgatcacagttgtatagtgtacattggtgcttaatacctatttattggatagatggattttaaattattttctaaggtccaggagcagtggcttatgcctgtaatcccagcacttttggaggccgaggccagcagatcacctgaagtcaggagttcgagaccggcctggctaacatgatgaaaccccgtctctactaaaaatacaaaaattggccaggcatggtggctgacgcctatagtcccagctacttgggaggctgagtcaggagaatcacttgaacccaggaggtggaggttgcagtgagccgagatcgctccactgcactccagcctgggcaacagagagagactctcaaaaaaccaaaacagtctttttttttttttttttttgagactctgtcgcccatgctggagtgcagtggcacgatctcggctcactgcaagctctgcctcctgggttcacgccattctcctgccgcagcctccggagtagctgggactacaggcacctgccaccatgcttggctaattttttgtattttttttattagagacagggtttcaccgtgttagccaggatggtctcgatctcctgacctcgtaatctgcccgcctcagcctcccaaagtgctgggattagaggcgtgagccaccgcgcccggctcaaaaacaatcttctaacagtaaacatcctggaagtaaataatatgctttttcaggcatgtctctggactttggccattcttgacctttgtagaatgcgtgtgtgggccatgtgtacacagcgtcagcggggaggagttgcctttgctatgtattgctttataatctatccccatcagctcttgaagaaaatacatcattttcaccaagtgtgaaggtggaaatttgtgctgaaacatgtttgcctgggtggttggtaacacagaagcagagtggggatttactcattggtcttgcatttctatgtccacatggatgcctctacaaaacaaaatgatatgtgtaaaaaaatttcagaccatgcaatacctaaagatatcttagtcttttcagtatgcattgaaaaatagactattaaagcctaagtactcagtaatataactttgttgttttacaaggtgtggctttgatagctggtggtgccacttcctggccttggatgagccgtacgcctctgtaaacccaacttcctcacctttgaaacagctgcctggttcagcattaatgaagattagtcagtgacaggcctggtgtgctgagtccgcacatagtaagcattcaaagaatgttaattctccctttcttcttaaccaaaaacacaataaactaaatataggttttaaaacagcttttttgagatagaattcacttaccatgcaatttacttgaaataaggagatttgaatttgaagatttgcatgggaaatttttttcatgataccttgcccatgtctacatatatcctgatcatcatgatgtcataccctcgtctccctcccccatttcccaaatccttattgtaccctttttttttttttttggtttgagacggagtctcgctctgttgcccaggctggagtgcagtggcgcgatcttggctcactgcaagctctgcctcccgggttcacgccattctcctgcctcagcctcccgagtagctgggactacaagcgcccaacaccaagcccggctaattttttgtatttttagtagagacggggtttcactgtgttagccaggatggtctcaatctcctgacctcatgatctgtccgcctcggcctcccaaagtgctgggattacaggcgtgagccaccacgcccggccctcattgtacccttttatacacccatacacacacacgcacacacacacatgcacacatgcgcgtgcacacacacacacacttttctgaagctacatataccttttttgtttaaaaggaagaatcaaaaatgtccaaaatgtaactggagagaaagtgggcaacttttggagtaagtattagcaatcgccaatgggtttgtgggactcccggggaccccttgtggggcgggggacagctctattttcaacaggtgacttttccacag

SEQ ID NO: 104 - DNA, 4193 bp, Homo sapiens
  source 1..4193: mol_type = genomic DNA
gtaagtcattaagctgtaataccagctgaagggttaaaatcgtgatttatgtcatacttttatgttaaagcatgtcaacaccaaagggtgtaaattgaaggacaagtgaaattcatgggaatcatggtttttgtgttgaaaacaaatttttttcagtattttgtggtgttcaagaaagtcaggattcactggacaggggaagcctggggacatctgatgatataaatgatagcttacagtgttcccaattctttcgaaaattataataaaaaaggctgtgaatcctaagaatgagaaatgatgttttgtgttacaatttaatcttttcaataaatcgagtccaaccctgctatatagtcacttgtcaagaaattcaagcacaaaatcagctccttaattgaaatttaaggagattgaattaaggcaaacaaagtgtgcctcagtctattaaacctcatggactttaaagagtaataatatttatatcagttaaataaaagtgaccactgtccattttattccatagctcttctgtatttaatagctattttgaaaatagtttttgttgcagaaaaagagcaaggacataccctttttcttaatcaaggtaataagtgcatatatatatatatatatgacattatgttagctagtagatgacaaggctgtaccatctgtgaatattcaaattattcattttgattactggcatgaagatggtgaaagattacaggaagaattctaaatctgaagatattattggatatatgatttatttcactttttaaattgtttttgcccatgtgctttctaaagggacttgaccctttctgtgcttggagactccatgctgtgttcaaagccagaaggcagaaaaaaaattgtgaagatttaacaggcattatgtgacgttaaatagcacatgagaaaacaagtatcatagggacatatctaaacacttttttaatcaaacaaaagaagtattaaataagaattcataatgattactctagttgttagaagttttcaccatgttgtaatagctaacaggatgtcaaacattttgccctcgcaagtttttgcaatttgcaattttcaaacgtgagacctgttgaaagtacaagtgataatggacaaactataccccctacagtcttcatcccaccaaatctttcttcaattaatgctgcagcaggagttttatgtaataacatttgcagttgtgagccatccatagaaagaaaaaacaattaaaatgccttaaatgttctgcttactgctgttatttgcttgtgtgaatgttgcatgtcagctaaatggaccaaggagtagataaagtgattgggtgcaggagagtgcacactaagctttgtctatcattattgctgggagcaatcaaattgatgtcagcaggacagtagatgcgttgacagctgtaattatgtatctccatggtgatcacttttggcctgtcatggaggcccatgagtcccctcccttggaagcatttaatcagattgggctgtcacttgtcaggtagacatggcgggctgggagttgtgcttagggggagaggtgaattgagaatgaagggtgggagatgtctgatagtttcacagagtccactgtggtactgaagacagaaattttaattatgctagaggtttctgagcagtggtttgagaatctcgtacagaggtgcttgggtgttttgttgtggttgttattgtttgtttttcttccttgtcttattaaaactagagcagtcagtttaccttagaaaacaatttttggctcttaccttttttggtcacaagaatgcatacttaagagttaacttatggtttgtacttttcacatgcttcattaagcctgagatttattaatatggcagaggtgaagatttccttttttatttttgatcatcatgttttgtaaatttgttattttcagaccacagttttgttctgctcagaaatttggttctgatttcatttgaattttttcttaaagtttttagtgcaaatttgtatagcctttcattgaaggaatggagacttgatctgacttcagattggttgttaagaaataaaaatatagctgattattacttggaaaaagcagcataaatagtaaattataaagcagagttttcatactgtggtacagtttttaattgggaatactgatttgcttatacaaagatacgtgtttatatatatcttgattttatcgtatgtattttaaagttaagatgacataacttctgtgatcataatattagtaaataacaaagacagttatatttaattaagatctgtaggtaacaccttataggatgatattattcaaggcaactgaagttttaagtaaggaactgtagaagaacataataaatattctttattgtctatgttattttatttgtgggttgaacatctaagttcttcctagctttgtagcagtttatgtagcaaatgataggatgtagttaaagtcagaagttttagaacttgtatcagtctcgtttgtaaacacagcattagcaagcatgctgtggttttaaagatgacatagtggtcaaattagctctttcactttttagtactaaaattaagaaaatgaaaactcacagatatattttctgttatgtaacccgtttactagttgccattttggggctctttaatgtggggaaaaggtagattgtgattttattgcttttaaagctgctccattaatttttttctagtttttgtcaacactgtgaatttcatagaacatcagtttatgtcctgaaatatgttttcagaaaatagaaagccaagtatatttcgtaagtgtgctgaatgatttttgtttataattaagatttttgtatatgaatgtgaatacgaatacagatatctatatttttgtttgtgcttgcaaatacagaaataaaagcccttcaggtatgttatagtgttccttttacaaccttacaaagagaataatagtagtgtgaattttaagaaaatgaaactatcgcttgtcttctgatgtcaccgtataataaagccatcattataccctcatgtggatatcctagacaagaggttctacatgtggtcccttgataattgcctaaattaaaatattaaaggcctaacagccgctgtgttgacctttttctgccttgctgcagacagatgagctgctgtttattaggaaggcttcttcccacaggtggaaggctacgtgagcttccgctcttctcttcccacccctttacaatgttgggcatcaaagtcctgctgttccagcagctttgattcagttcctccatcctcaagacccctaggatgtgcctgacagtctgaagtattttgattagcttttaaatacttcagattccaaaacttctttctaataatttaataaatgttctgtcctcagtaactgctcatttttaaagttttgcatggctaacctccgtgccttgctgctggtatcaaactgggaaatgaaaacaagaatcagtgatgtactaactcactcgttggctggttaacagcaatcagcctcttcaaaagaatattttgaacttgtgctatccccctaccccccaccccaagaaaatcacaaaatcagaactctaattggggctttacaaagcaaagccataggaaaagctgtgtaaacatgaaagcctcaggggagcaacagtaacagaaaaatagtgttttacagttgagagggtgaggcagaaaaggaaagtgttacagacatgaaaggcccaggcccacattcctatggagctgaggaccaggcttgacgaggggcctcactggtgggctcagaagggtctggcagggagtgcagttagcaagggcatcgtccatgccatgcttcagctggaagacaccatcagagagccacagcatcctggcatagtgatgtaggaagtcttcattttttattttttatttttgctgttttttagtttcgtcattcagtggcagaacaaaaaatgtgttgcattacatattaacggatcaagattttagattgttttcctattttccagaagttgaaatgttatttgagattgaaattctctatccattttctccatggaaatgaaattggtggttacaaaaaaatatctacacaatatgaattacttttctttttttctttttttctcccag

SEQ ID NO: 105 - DNA, 21771 bp, Homo sapiens
  source 1..21771: mol_type = genomic DNA
gtgagaaacctgttaatagagaataaaaaaatacagggcttaagttctctaagccatggcctggccagagcttctccaactctcctcattgttctctgccgcattgtgtctgttctgtgggtcctttctgtgtcactgggggtgggatgaagggtagatgaaaagcaagagagagtgggaagagagggttttcattttttctaacagagggccactcacaggggaaattacagttaaagatcgttcataagggaaaagcacttgaaaatgtttttctttttttgaaagcaagggagaggaaatatgaaaagttaaaatgaactgatgtgcttgaattagaagttttaaaaaatgtagcaccttttttattttttagttaaaacactacaggattattaaataaagtccaagccacagtgcaaagaagaatgaaatcaccccagatcctaccattcagaaacatttggcgaacctcattactgatatctctttgcttatttacagactgaaattatgagagaaagaaatgaaaagaaacataaaataatgtgttatgtgaagtataaagtatatttgtgagagatacagtaagaggctgggatgagggagagagatactgcagacagaaactggcaacatttccagggagaagaaaggaaggagacaggcagacattgtttttaatcaggccagccactcttatcatccctgctctgcaggcttacttctgtggatggcttggcctaagcagtttaggcctggaagtcattcctgtttagaaacaaaagagcggccctcagagacgtggtgataaaccaccacattttagagcttgactggattttagaatatcatctagttgaatacatctttatgggtctggaggaggttttttttttttttttttgagacagagtctggctctgtctcccaggttggagtgcagtggcccgatctcggctcacttcaacctctgcctcctgggctcaagtgattctcctgcctcagcctcccgagtggctgggactataggcgtctgccaccacgcccagctaatttttgtatttttagtagagacggggtttcaccatattagccaggttggtctcgaactcctgaccttgtgatccgcccacctcggcctcctaaagtgctgggattacaggtgtgagccaccgcgcccagctggtttttttttttttttttaatatttatttatttagagacagtgtcttggttggccaggctggaatgcagtggcatgatctctgctcactgcaacctcagcctcctgggctcaagcgatcatcccacctcagtctcctgaatagctggcaccacaggcatgcaccaccacatccggtgaatttttttttgtattttttttatagaggcggggttttgccatgctgcgcaggcttatcttgaacttctggactcaagcgattggcctgcgtttgcctcccaaagtgctgggattacaggagtgagtcaccacgcctggcttttaatttttgttttcaagggctagtctttactttcagatcttcattgcttaattaattgcttactaatgctgcttgtcatattgatacctccactcacttattcctgcctgtgttattttttggtaactttttattttgataaaatttcaaacttcagcctgggcacggtggctcacacctgcagtctcagcactttgggaggccaaggcaggtagatctcttgacgtcaggagttcaagaccagcctggccaacatggtgaaatcctgtctctattaaaaatacaaaaattagctgggcatggtggcacatgcctgtaatcccaactactcaggaggctgaggtgggacaactgcttgaacctgggagacagaggttacagtgagccaagattgtgccattgcactccaacctgggtgacagagcaagactctgtctcaaaaaaaaaaaaaaaattcaaacttcacagaaaaatgacaagaatagtatgggaactcctatatgtccttttcccagattcaccagttgtttacattttctccatttgttctgttattctctctccatatatacatatttgcatgttacatttttctgaaatatttgagaataaattggagatactatgtcttctttacctcctaagttcttcattgggtatttctaaagaataaagatattctcttaaataaccagaatacagtaataaaaatcaggaaatttaacatcgattcatcgatgttattctaattcattatccttattcaggacttaagtcctttatagtgtgtgctctgggcatgtgtgcactttctatgtgcgcgctctcgctctttctgtctctgtctctcatatatatgtgtgtgtgtatatatgtatatatatatatgttcctcctggccaggatccaatccagaataaagcattgactttagatgttatctctttttaatcttttttgatctggagcagttcctgtctttgttctccatgatcttgatattttaaaaaatagctttggccaggtgtggtggctcacacctatgatcccagcactttgggaggccgaggcaggtggatcacgaggtcaggagatcaagaccgtcctggctaacacggtgaaaccccatctctactaaaaaaaaacaaaaaattagccaggtgtggtggcgggcgcctgtagtcccagctacttgggaggctgaggcaggagaacggcatgaacccgggaggcagagcttgcagtcagccaagattgcgccaccgcgctctagcctgggcgacagagcaagactccgtctcaaaaaaaaaaaaaaaaaaaaagagcttaatgcttaatagggccgggcacggtggctcatgcctgtgatcccagcactttgggaggccgaggtgggtggatcactaggtcaggagttcaagaccagcctggccaagatggtgaaaccctgtctctactaaaaatacaaaaattaggcgggcgtgatggcgagcgcctgtaatcccagctactcgggaggctgaggcagggaattgctcgaacctgagaggtggaggttgcagtgaactgagatcatgccactgcactccagcctgggtgacagagcgagactccatctcaaaaaagaaaagtagctttattgagatataatttacaaaccataaaatccacccattgtgaaaatataattcagtaattttaaattaatttttagagttgtacagccataatctagttttcaaacctgccactcactccaaaaataccttcttgcctgtttgcagtcagttcccacctaaccacagtcaattcctcacccaactttcttattttacaaatttttccatctgactcctttcactaagcaccatgttttttgaggttcatttatattgtaatatgtatcagtttgttcctttttattggtgaataatatctattgaatattttatgtattttcatcatttaccagttgaaggatatttggattgtttctggttcctggctatcatgagtaaatgctactgtgaacatttgtgtattactttgtgtggatatatgttttcataacccttggatagataggtacctaagagtgggattgtaggttttatgataagcttgtttataactttttaagaaattgccagatggttttccaaaacaactaaaccatttacattaccatgagcaatgtgttcagggttgcaggttctccatatctttgttgatacttggtattgtcagtctttttttgtttttttttttttgagacagagtcttgccctgtcgcccaggctggagtgcagtggtgcgatctcggctcactgcaagctccacctcctgggttcacgccattctcctgcctgagcctcccgagtagctgggactacaggcacctgccatcacgcccggctaattttttgtatttttagtagagactgggtttcaccatgttagctaggatggtctcgatctcctgacctcgtgatctgcccacctcagcctcccaaagtgctgggattacaggtgtgagccaccaccatgcccagccttggtttttttttttttttgagatggagtctcactctgtggcccaggctggagtgctatggtgcagtctgggctcactgtaacctctgcctcccaggttcaagtgattgccctgcctctgcctcccgagcagctgggattacaggcatgtgccaccatggctggctaattttggtatttttagtggagacagggtttcaccatgttggccaggctggtcttgaactcctgacttcaaacgatccatctgccttggcctcccaaagtgctgggattacaggcgtgagccaccgcacccagccagtctttttttgagacagggtctcactctgttgttcaggctggagtacagtggcatgatcacagctcactgcagcctcgacctcctggggtcaagcgatcctcctgcctcaacctcccaaagtgttggaattacaggcgtgagccactgtgcctggtccagtctttttgactatagccattttagtggtgtgtaatggtatctcactgtagttctagtttgcatttctcagatgactaatcatgttgagcatctttatgtacatattagtcatttgtaaaccttctttgctgaaatgtctattcagatcttttgtccatctcgtaattgggtttttgagttgtaagagttcttcatatattctggatacaagtcctttatcatatatatgatttgtaagtattttctcccagtctgtggcttgtcttttctttcttagtggtagctttatttttatttttattttttattttttgagacagcctcaccctgtcctccaggctggagttcagtggtgtgatcttagctcactgcaacctccacttcctgggttcaagtgattctcgtgcctcagtcacccaagtagctgggattacaggtgcatgccaccacgtccagctaatttctttgtatttttagtagagatagggtttcaccatgttgcccaggctggtcttgaactcctgagctcaggtgatctgcctcccttggcctctaaaagtgctggggttacaggcgtgagccagcacactcagcctatttttattttattttttagagacagggtcttgctctgttgcctgggctagagtgcgttagtgcaatcacagctcactgcagccttgaactctgggctcaagcaatcctcctgccttagcctacggagtagctaggactataggcacacactagtacacccagctaatttttgaaaaatttcttttgtgtgtagagatggggtcttactacattgcccagcctggtcttgaactcctggtctcaagcgatctgcctcggcatcccgaagtgcagggattacaagccactgccccaagcctgtggtggctttttttttgagctagggtctcactctgtcacccaggctgaagtgtagtggtgtaatcatggctcactgcagcctggacttcccggggtcaggcagtcctcctgcctcatcctcctgagtagctgagaccacaggcacatgctaccacatctggcaattttttttcattatttgtagaggtgagggtcccactatgttgcccaggctgttctcaaacttctggacttaaactgtcctcctacctcggcttcctagagtgctggtgttactggcatgagccgatgtgcccagcctctggtggcttttgaggtggagaagtttttaattttgaagtccagtttatcaagttttcttttgtgggtcatgcttctattgtcatatgtaaaaacttgtaatacaaagtcatgaagattttgttttcttcatggagttttttttgtaggtttggctctttttttttttttttttttgagatggagtttcactcttgtcgcccaggatggagtgcaatggcgctatctcagggattatgggtgcctgccaccaaacctggctagtgtgtgtgtgtgtgcgtgtgtgtgtgtgtgtgtgtagatatatatatatatatatatatatatatatatatgtatatatatatatatatatctacatacacaagtacatataagagagcccagccagctttcttatagtaggtctgtgatccattttgagttaatttttgtatatggtgtgacagaagagtctaacatcactcttgtctcccaccattaattgacataactattctttccccattgaattgtcttgacacattgataaaaatatcagttgatcataaatgtaagggtttgtttctgaactctcagttcttccattgttctatgtctgtccttaaaatagaaccacactgtcttgattactgtagtttataggagttttgaagttgtgtaaaatcctccaacttggtttttttttttttttttagatgtagtctcgctttgtagcccaggctggagcacagtggcatgatctcagctcactgcaacctccacctcctgggttcaagcgattctcctgcctcagcctcccgagtagctgggattacagtcacgtgccagcacacctagctaatttttgtatttttagtggagatagggtttcaccatgttagtcaggctggtcttgaacacctgatctcaggtgatccacccgcctcggcctctgaaaatgctgggattacaagcgtgagccaccgcacccagcccgatcagctcttaactctacaaaaatgcctgctgagatttgataggaactgcattgagtctgtagatgaatttggtgagaatttacatcctaacatattgagtcttccactccacgtagatggaatgtttctctgtttatgtagctctatactttgtctcagcaatattttgtaatttgcagcatacctgtcttgcacttcttttgttaaacttatacctaaaatatttcactctggccaggtgcagtggctcacgcctgtaatcctagcacttggggaggccaaggcagggggatcacctgaggtcacaagttcgagactagcctggctaacatagtgaaaccctgtctctactaaaaatacaaaaattagccaggtgttgtggtgcatgcctgtaatcccagctactcagaaggctgaggcaggagaatcgcttgaatccaggaggcggaggttgcagactccagcctgggtgacagagcaagactccgtctcaaaacaaaacaaaatattttactctttgtgatgctatttagaatggaattatcttgttaatttcctatttggattctttgcaaatgtatagagatacaattgattttcatatgttgatcttgtatactgctttgctgaggttgtgtattagcttgaatagggggtgtgtgtgtatgtgtgtatttctttggattttctatatacacaatcatgtcttctgcaaatagaggcagttttacttattcctttctaatctggatgccttttatttctttttcttgctaattgctctgcttagaacctgtagtacagtgttaagtagaagtggtaagagtggacatccttggccgggtgcggtggctcacgcctgtgatcccagcactttgggaggccgaggtgggcatatcacgaggtcaggagatagagaccatcctggctaacacggtgaaaccctgtctttactaaaaatacaaaaaaattagccgggtgtggtggcgggtgcctgtagtcccagctactcgggaggctgaggcaggagaatgccgtgaacccgggaggcggagcctgtagtgagccgagatcgtgctactgcactccagcctgggtgacagagtgagactctgtctcaaaaaaaaaaaaaaaaaaaaaataagagtggacatccttgtcttgttcctaatcttaaggagaaagcattcattcttcaccattaagcatgatgttaactggtgtgtgttttttttttttttttggacattctcttgaaggttgaggaagttcctttctacttctaattttttgagtgtttttatcatgaagggtatttaatattgtcaaatgcttttttctgcatctgtgagataatcatgtgttttttgttctttattctaatgatatggtatgtaacattactggtttttagaatgttaaaccaaccttgtatttctgtgataaatcctacttggtcatggtatatcatccttttttggaaggtgctgggctctgccagtatttccttgagtacttttgaatcaatattagtaagaaacattgacctacagttaccttgtgattttttcttttggttttggtattacagtaattctcacctcatagaatgagttggaagggttgcctctgtgaggtaggttccctatgcactggttatgaacttttctgatttcagtaagacagaacactcacacaagttacatgaagtgcccggccacatctgttgttttttgacatttttttttttcccgctgtaggcagagtcttgctctgtttctcaggctggagtacaatggcgcgatctcggctcactgcagtctccaccttgtgggttaaagcagttctcctgtctcagcctcccgagtagctgggactacaggcacacgccactacacccatctaatttttgtatttgtagtagagacagggtttcaccatattggtcaggctggtctcaaactcctggcctcaggtgatccacctgccttggcctcccaaattactgggattacaggcatgagcccctgcgcccggctgttttttgactttttaattatggccgtttttgtaggagtaaggtggtatctcattgtggttttcatttgcattttcctgatagtgatgtgagcattttgtttcatgtttgttggccatttgtatatcttcttttgagaaatgtctattcatgtcctttgcctactttttgatgggattattttttcttgctgatttgagttccttgtagattctgcatactggtcctttgtcaggtgcatagtttgcaaatattttctccagctctgtgagttggctctttgctgattacttcttttgctgtgcagaagctttttagtttaattaggtcccatttatttttgtttttgttgcattagcttttggggtcttagtcatggattttttgcctgggccagtgttcagaagagtttttccaatgttgcagaatttttatggtttcaggtcttagatttaagtcttggaagtctggtaatgtgatgccttcagatttgttctttttgcttagtattgctttggctatctggactcttttttggttccatataaattttaggattgtattttctagttctgtgaaaaatgatgatggtaatggtagtgttttgatgggaattgcattgaatctgtagattgctttgggccatatgatcgttttcacaatattgattcttacctccatgagcatgagatgtgttttcatttgtttgtgtcatgtatagtttctttcagcagcgttttgtagtttcacttgtagagatcttcacctccttggttaggtatattcctaggtattttattttattttttgcagctgttgtaaaaggaattgagttcttgatttgattgtcactttggttattgttggtgtatagcagagctatttatttgtctatattaattttgtaacctaagactttactgaattcctttatcagatctaggagtcttttggatgagtcgctagagttttccaagtatatatgatcatatcactgataaacagtacttgtttgacttcctcttttccaatttggatgccctttatttctttctcttgcccaattgctctggataggacttccagtactatgttgaatagaagtggtgaaagtgggcatccttgtcttgttccagttttcagggggaatgctttcaacttttccccattcattacgatgttggctgtgggtttatcatatattgcttttactattttgaagtatatccctcctatgcctagtttgagagttttttgtcataaagagatgctggattttattgcatgctttttctgcatgcaattgagatgatcatatggtttttgttttaaattctgtttacgggatttatcacatttattgacttgcatatgttaaaccatccctgcatctctgggatgaaactcacttgatcatgttgtattatctttttgatgtgctgtgggatttggttagctagtattttgttgaggatttttgcatccatgtttatcagagacactggtctgtagttttctttttttaatgtcatttcctggctttggtattagggtgatactggcttcatagaatgatttaggaaggattccctctttctcaatcttttggaatagtttcagtaggattggtaccaattctttgaatatctagtggaattcaactgtgatccatctggtcctgggcttttttgttgttggcagtttaaaattactgattcagtctcactgcttgtttttggtctgttcagggtttctgtttcttcctgatttagaggattgtatgtttccacgagtttatccatttcctctagatttttcagtttgtgtgtgtaaagatgttcatgttagtcttgagtgatcttttgtatttctatgatattggttataatatttccagtttcatttttcattgagcttatttggatctattctcttcttggttagtctaatggtcgaccaattttgtttattttttcaaggaaccaagtttttgttttattttttgcttcaatttcctttagttctgctctgatctttgttatttcttctgctggcattgggtttagttcgtacctgtttctctggttcattgaggtgagacagtagattgtcagtttgtgttctttcagactttttgatgtatgtacttaaaactatgaactttcctcttagcactacttttgctgtatccccagaggtttttataactgtgtcactactatcattcatttcaaatttttaaatttttatcttgatttattgttaacccagaaattattcaggagcagattatttaatttccatgtatttgtatagttttgagcatttcttttggagttgtttctagttttgttccactgtagtctgagaagatacttgatatgatttcaattttcttaaatttgttgagacttgttttgtggcctgtcatacagtctatcttggagaatgttccatgtgttgaggagaagaatgtatattctgcagttgtttggtagaatgttctgtaaatatctgttaagtccatttgttctagggtatactttaagtccattgcttctttgttgagtttctgtctcaacaaaaagagtctagtgctgtcagtggagtatcgaggtcccccatttcactttgttgctatttcatttcctaggtctagtagtaattgttttataaatctgggagctccagtattaggtgaatatgaattcaggattataatatctttttgttggattgttccttttattatataatgaccttctttttctttctttttttttttcttttttcttttttttttttttttttttttactgttgttgctttaaaggtctattttgtctgatataagaatagctactttgcgaggccaagacgggcggatcgcgaggtcaggagatcgagaccatcctggctaacacggtgaaaccctgtctctactgaaaatacaaaaaattagccgggcgtggtggcgggtgcctgtagtcccagctacttgtgaggctgaggcaggagaatggcgtgaacccaggaggcggagtttgcagtgagccgaggttgcaccactgcactccagtctgggtgacagagggagactctgtctcaaaaaaaaaaaaaaaaaaaaaaaaagaatagctcattctgcttgcttttggttcccatttgcatgggatatctctttccccccctttaccttgaggttatatgaatccttatgtgttagatgactctcttgaagacagcagatatttggtttgtgattttttaaaaatccattctgccattctgtatctaagtggatcatttaggccatttacgttcaacattaatattgagatgtgagatactgatctgtttatcattttagttgttacttactttgtttttttttcattgtgttattgttttataggccttgtgggttttatctttcaagaggttttattttggtgcatattgagcttttgtttcaagatgtagaactcttctgaagagtaatgctggtttggtagtggcagattccctcggcatttgtttatctgaaaatggctttatctctccttcatttaggaaacttagttttgctggatgcaaaattcttgggtggcagttattctgtttaaggaggctaaagatagaaccccaatcccttctagcttgtaaggtttctgctgagaaatctgctgttagtctgattggttttcctttataggttacctgatgcttttgtctcatagctcttaggattctttccttcatgttgactttagatagcccgatgactatgtgccttggtgataatctttttgcaatgaatttcccaggagttctttgagcttcttgcatttggatattgaaatctcaggcaaggccagggaagttttcctcaatgattctctcaaataagttttctaaacttttagccttctcttctccctcaggaccaccaagtatttttaggtttggttgttttacataatcccatatttcttggaagctttgttcatttcttctttctttttttttttttctttcttgagatagggtcttactctgttgcccaggctgtagtacagtgttgtgacctttgtctcctgggctcaggcaatcctcacacctctgcctcctgagtatctgggactacaggcacatgccaccactcccggctaatttttatgttttttttgtagagatggaaatttgctatgttgctcaggctggtctcaaagtctgggctcaagcagtccacctgccttgccctcccaaagtgctaggattataggcatgagacactgaccccagcctatttatttcttttgattcttttttctttatttttgtctgattgggttaatttgaaagccttgtcttggagctctgaaattcattctttgacttgttctggtctattgttgaaactttccattgcattttgtatttccctaagtgtgtttcatttccggaaattctgattgttttttctttatgatatctatgtagaaaatttttccttcatattctgaattgttttttaagttttttttttatgttggttttcacctttctatggtgtctccttgagtagcttaataatcaacctactgaattatttatctgattatttcaaatatttcgttttagtttggatccattgctggggagctagtgtgatctttcgggggtatgatagaaccctgttttgtcttataccaaaattacttttctggttctttctcgtttgtgtagagtatttcttctaattgttcttgaatttatttttgatttggctgtggtttttttaagtttctttttcctcttcactaaggatgtgactttagtgtttatagtttattatagcctaatgtgattcttaatgcttttagggggaagactgtatgagttccttggctatagagagtctttgtatgatggcttctttagatgctggttgtatttatttatttatttatttatttttgttgagatggcgtctcgctctgtcactcaggctggagtgcagtggcacaatcttggctcactgcaacctccacttcccgggttcaagtgattctcctgcctcagcttcccgagtagctgggactacaggtgtgcaccactacgcctggctaatttttgtatttttagtagagacggggtttcaggatgttggccaggctggtcacaaactcctgacctcaggtgatccacctgccttggcctcccaaagtgttgggattacaggcgtgagccactgcccctggcctgtatttaatagatatgtacttgatgtgtgggcaagttcactgtctcctatggggttgagatggaaaggtctcttgaagctcatctcattcccctgtggtgtgtgcttttttatttatttaatttttcccctgtattttatttactaagttgatggttaaggcttcaggccagtaggggagctgtccctgggtaggaaccagttgtggctaaagcaaatgggtaaatgcaatactcagtaaggcagagaggttccacccttgatgaaagtggctgggggaactctcaattagatgcactgaggtcttatcaaggggaagggtgggagccacctcagctcctttgccaggccagtaggaaagctattcacctcccagactcgctcctgccctagtgttccagctattcggatcagacaggcatctcttttcatctgtaggactgttgttgttccacacagagaggaatttgtgactctgcctctcttgcaagcctgaacttgggccagggcgggggtgggggttgggggattcctcctgtggagatgcagtcactctgtagtgttccaggaaggctgtctataggttcacctttgccaagctcctgtggagaagccccaactgtgtctgtgtagtggtggacaaggtgggagagaagataccttctccaggacccttcatgagcagcaaagctgcctgattgttggggtagagctgcagactttcccttctgagcccagcactgcaattgtgtctctgctgaaaggaacttcccatcagtggaaagatctggaactcaaggcctgccatctgaattcttttgtcccatggggtattcccttggtgtggtggtctcctccttcccttaggagtaagaattcctgagagccaggataagttgattgctattcttctgggtctagccacccagtggggctgcccaactccaggctggtgctggggaatgtctgcaagggatccggtaatgggacctgtcctcaagtctcccagcaagggatataccaacactagtgctgatgggagtgtcaggtgagtgaggtagactctttgaggttccttggttacagaaagccttagtgtgctggctttctcgaatgctggttataatagtagtgaactggtcacgtggacagatgcaggacctcctggttagccagggttttgcaggcaatgatgatagcttaggtcatgcactggttttctcctttctgttcacagtgttattctacctagagatgctgtagtggactgtgttggttggcatccagcctggaggtagcgtttacaaaagggcaccagctgcagtagtagcagtgggattcgagcttgtcctgtgttgcccaggaggtattctggtttctcaggtgacaacggggtccataaagctgccaaaagtttctgtcctttgtattaagtaaccagggtgggtggaggggtacagccaggtgggggctgggtcaggtgggtctacactctgtctctccatgtgtggggaaagccgtggctcctatgagggttgggggggcggttctcaggtcattagggtaatgttccagagaggaatataactgcctctactgcacagaagagatcgcacagtgtgtggggagtaacaggtggcactaagcctcacccagatcccacacggtcggaaaggcagatctcactccctctgtgctctgctagctgcactgggctaagttccaggcagcctaggctcagaactcaaacctgccccaggccataagctttccctgtgggaaagcagctgtggctttcaggccatgctcctcccaggccacctgcagggccaggcacctggctcctgcacttgtggctgcagtgcacttccccctgcccctgggaggtatgggttctggacaaaggagttcatcctcactcagtgttatatcttgaaatggggagattctttcaacctgcgaccactacctgagcttgttggctgacttccccaaggtcccctgtgaggtacaataaagaatggcttaccttggtctgcactggagactgggaatgcctgcaaagcacttcccgccactgtttctacttttatatttcttactgctccctaaatcagtcccagccctgggtaaggttaaggccttcccccatggcctggattttcaggttccccagtgggaacctgaaagcagcttctctctatctcacactctggagacttacagtttttcccttgtcttatggtttaggctgcagactgccacttctttaaaaggtctgtggattctttcagttttcctgttaagttcctgcgtggcttcttggaaaaagagtcaccatgtgattctcaatacactattctgttcttctaagtgggagaggcatgctaacactgcttcttatctgccatcttggtgggggtggaaaaaccaaaacctctcaaagtattttctaacttctcttgtagattcttcttttgcctattgcttatttagaagtgttttgattaatttttacgtgtttgtgaatttttcagttttcctattgttattgaattatagttttattccattgtgatcagaaaagatgttttttatgattccaatcattttaaatttaagatttgttttgtggattaatgtatggtctctcctggagaatgttgcatatgcacttgacaagaatatatactctgttgttgggtggagtgttctctataggtcttttatatgtattagttcatagtgttgttcaagtgtactgttaacttaccgatcttctgtctagttgttctgtctgttattagaagtgaggtgttaagtctgcaactattattgtgcacctatttctccccacaattctgttaacttttgctttgtgtattttagggctcttgttgcttcatagattttggggctctgttaggtgtgtatatttttttaactggtatattttctagatgtgaaccttttatcaatatgtctctctagtaagtttttgatttaaagtctctttagtctgatagtaatatagccacctagggtctattttggttaccctttgcatggaatatttttttccatcctttagtttacctcttcatgtctttgtatctaaagtgaagctcctgtaaatagcatacagatagattctgtctgtatgcaatctgtcaatccctgtcttttaatagaagagtttaatccatttatacttagcatgattgctgaaaaagaaggatttacttctgccatttagttatttctgtatgtgttttggttttttatgcctcagttcctccattatggccttggggtggtgatatttagttgagttgtttgcctttttgattcacttctttcattttaatcatattttaaagtttgttttcttagtggttaccttggggattataattaatatcttgaactagttggaagaataccaggttagctttagtagtacatagacatactgcttctgtaactctccatccttccttttttatgttgttattgtcatagattatatctttatacatgttatactcattaacaacagatttattgtttcatgcatttgcattttatttttatttatttatttatttattttttgagacggagtttcgctctgtcgcccaggctggagtgcagtggcgtgatctcgactcactgcaagctccgcctcccaggttcacgccattctcctgcctcagcctcccgtgtagctgggactacaggcgcgcaccaccatgcctggctaatttttgtatttttagtagagacggggtttcaccgtgttagccaggatggtctcgatctcctgacctcgtgatctgcccgtctcggcctcccaaagtgctgggattacaggcgtgagccaccgcgcccggcctttttatttatttttgtaaattttattttttgtgcagactcctctgctggggccgcaactgctgagaggagcagcacatttgccttttaaatcacataggaaaaagacattacaaaccaaagtacaacactacttttatatttacctaggaagttacatttattagtgttctttattttttctcatgacctcatgttactgtctaatatccttttgtttcagactaaaggactccctgtagaatttcttgtatggcgtgtctattgcaaatgaatgctctcagcttttgttgacttggaaatgtcttaattttcccttctttcttgaaggatagttttgctggatataaagttattggttgaccagttattttgtttcaatacttctttttttctttttgagacagagttttgctctgttgcccaggatggagtgcagtggtgcgatcttggcgcacagcaactctgcctgccaggctcaaatgattctccctcctcagcctcctgagtagctggggccataggcatgcaccaccatgcctagctaatttttgtatattttgtaaaggcagggtttcaccatgttgcccaggtgggtctcaaactcgtagactcaagcagttcacctgccttggtctcccaaagagctgcaattacaggcatgagccattgtgcccagccttctttcaatattttgtttttatttttattttagacacagggtcttgctgtgtcacgcagaatagagtgcagtggcatgatcatggctcattgcagcattgaccttataggatcaagcagtcttcctaccttggccttctgagtagctagtagaacaccactatgcccgaccaaccaaaaaaactttctgtagagatcagggctcactatatcgtccaggctggtctcaaactcttggcctcaagtggtcctcctgcctcattctcccaaagtgctgggattacaggtgtgagccagcgcacctgacttttcagtactttaaatatgtcccactgccttccggcctccatggttaatcttgctgaggatcagttgcatgggatcagttgcttctatcttgctgctttcaagtttctcttattgtgttttgacagtttgactataatatgtctccgtgtagatctctttgagttcatactgcttggagtttgttgagcttcttgggtatgtatacttatgtctttcatcaaatgtgggaagttttcagtcattatttcttcaaatctttgaccctttctttctgttcttctgagattcctataatgtgtatattggtatgtttggtttcccacaggtccctcaggctctattaatttctccttttcttttttctggttccttatactagattattttgttttgtattccagtttcctgatccttttttctgcttgcttaagtctgctgttgaacccctgaaatgaatttttcatttcagttattgtcaactccaggctttctgcttggttccttttcataatttctgtctctttgtggtgttctcattttgttcagacattgatttcctgatttcctgtagttttttccccccacagctttctttagctcattgaacatatttaagacagttcatgtgccatctttgactattaagtccaatatctgggtttcttcagagatgatttttgttaaattatttttttcttgtgaatgggccatacttgcttatttctttgtatgatttgtgatttttgttgaggatgagaaattctgaatattatgtttggaagtttggaagtctagttctcctacttttcaggaatagccgatttttgcttgtcaactgctgggtccatctgtttgaacttttgcaagctgtttttgcaaagagtatgttccttttttaatatggacattgaaattttagttctcttatcactgtgtttaaccagcaatctgacagtaatttccttaaatgtctgtctcccagaagtgtggaggggtgtggaacaaactacctttttaaatcccttgtggctgggaagctgcttgagccaatcagggttgaaacaatgccagcctctatgcttagcccctcagccatcaaaagcagtggtcagtaatcagaacatacaaccttgatttttcaaggttgaaaaaccaagatgcaaaggttctaatttcccaatctggcaccaactagctacactaggaacatcctcgtggctacctgccatgggttgttggctgggggattatagcagccatgttattaataaatgtgaagtttactgaaatttacttgctgttttatcaaattctcctctgggccctgaagtgtttgagtagactccagagttcaaaaatagttgctttagacagctgaatagttgttttgatctcagatattcttggagcttcctgttctctcttctgtgatgtcactcagtttttttatggtaagcatatagttttagtgtaccattttaatttctagtgttttttagctgtattttttgagttatttttagtagttgctctaagggttactatatatctcttaatttatcacagtctgcttcaaattaatactgacttaattctggtaagacaggaactttgctccaatgtagctccattttctcccccttcatttgtgcttttattgttatgtaatactcaaaacagtgttaattattgctttatacagtcttgtttttcaaagtattaagaaaagagaactatacttatgcagtgtttataatcacatatttatcattttcagcactcttaattggttcttgtggatttgaattatagtctggtgttattttctttcatccagtaggacattttgagctggtatgggcaatggtggcagccttggttaagaatgccacaggctttcactgttcttatctcaagtttagtagtttttcatgaataaacacttctcaatttgttacatttggctcatttttagaaccccaaaatactcgtttttgacaatgctgtccagttgtttttggggagagaattttctgaactcttcactctgccacagctggaagtctcccctactaccttgatatctttgcagaaagcatagattacattttgcactgtccttagctgtgtatagattgggcttagagccaaggcaggctgaaaagtgaacctacttttcctaagctgatgggacttaggagaaggaaagaatttggaagtagggcaaagaataattgggccttttatcatcttgcctgggtcttttgagcccccacatcctatctttcctgaggcttagtccttcacaacacagtgtccttatggaggctttctggctccttctaccgccttctctcctgcattccttgtctggggatgggcagagtagacactgggtactcagtgtcaagaagcacctgcttgtacccttgcgtgccttctgtggagggtgtggagggactcaaaatagaggtcagggtgccaagataagtgttggctctgcaaactctgcatgaggttttcagtcttctttcaggcagctttgcacagatggggggctttgcatttggagctgtggtgaggatggtgggatacactctgtacctcatgcccttagtgaaggttttagggaactgctgcccaggaggggaggggagagaaaatacttgcctcagaaagtaatatgctgaccatcctaccagttacggggagaaaatgcacatataattcttaaagaacttcactgattaggtctgttgcctcctgtatagaatttctgtgggaaaaaagccaaatgttatcttattgttgtctttatctttccacagataatgcctcaaacatctctgtaaccagatgcttttgcttttctgttttggcag

SEQ ID NO: 106 - DNA, 9808 bp, Homo sapiens
  source 1..9808: mol_type = genomic DNA
gtaagaaagaagggcctgtttttggtgccgtttgagatttgtgcagttccttacctgcaataaaaataattcctgacccagatctaggttgttacctgcattctcattggctttcagcatagtgatgataaggtgttaatggagagagggttttggcatgaaatctgtagcttgtgggggttcagtggcaggggatgcttatgtacttcattggtgggtgattttacttgttgatctgaattgcaaatgattttcaggtaatcaaagaatcctgtcctttgaccagatagatgactgtttactgagtcctattcaagaagtttctcatggaaggcttttctgtaatctgtttattgggaagttgtttcttcctttatttcttcagctccttgccattttattacattgtgtccataatggtaaaggataaatctgatctcacacttcattttcagaggtacatatctttattacatgactttaatggacttatattttaaaaatatttttaaatgaagtctatttgaagttatacatgagtaattaccattcatctcaaaccttgctttaaaaaaatcagccttttcttcttaaaatattaataaaaatgaacattggatgccaagacagaatggttggggggaaaaagtagtgatagccatccaacttgaggagaggagttctagagggagtgtaaatgggaaaccctttgttctcaagggaagttaggcagtaggaattcaaaagtttcacaaagtgcttaccactttgacccaactattctgttcttagtgatataccgaaagtagtgtaagtgttcaacaataagagtgtcttttattaatcaaatttaagatgggccatacacagtgtctcacgcctgtaatcccagcacttgggaggctgattcaggtggatcacttgagctcaggagttttagaccagcctaggcaacgtagcgaaaccccatctctacaaaaaaatacaaaaattagctgggcgtggtggtgcatacctgtggtcccagctacttgggaggctgaggtgggaggatcactcgagcccagaaggtcaaggcagcagtgagccaagatcgtgccactgcactctagctctgggtgacagaggaagaccctgcctcaaaaaaaaaaaaaaaaaaaaggtaagatgaccacttctcttacttggtggacaatgcagaattttctgaactttgcttactaagtctatatatacacacctagctggtgctacccccattctctcctccttcctgcctgttacgaagggaggtgtgggatcaattcctctggctagagccatcctttcctcctgctacacacatccacattgctgaatataactctccacccttcttcaggacccttatactgttccttttctcctttctctttagtatcttcagtctgtccgttggtactagatcctcccatcaaaacttaatcacactcaggtctttcctatcatcaaaacaaaaactgtcctctagttggcatactcctgtagctcttgctgtgtttctctcttgccatcccattctttaacacgtgttaatttagctttgtcccctagaccactaaatcgttttttttttttaaggtcctcagtgacttgcatcactgtaaatgcagtttaactctcattttcctgtctttcaacagtattcccttggcttccattataccatactctggcatttcttctcacaactctgaccataccttcctggtttccattggcaatttacatgattccattcagactctagatgctggagttcatttcaactgctttctcttttaattctgtgttttattctaagcaatctcattttctgcttacaaaactttagttaataattgcatattagtgagacttcctctcttgtcctcagcaccattcttaagctgtcaccattctacatcttaaatattctgtgtatttaataagagtgcagtggaaaatactaagtcttttttaaaggactacacaaggtaattataaagttcttatgggaggaagaaacaccatgcaagaataaacattctatgaaagtagtgtaatgaggagttagccctaccaggtgccaggatataaaactacaataactaaaactgtctgaagaacttgtaggtaaatggacagaaagaccaagggacattacagaattgatacatagatctatatctatttggacattatgatgaaaaggatattattctaagcagagtcactgataataacaatttcttatgtcagagataccagtgattgctgcatcactaaatccagttgacatttctcaccctttgtcttacctgttgacaacatttgctctagctgatcactccagtctcatgactttaaatactgatccgtatgctgacaactctgaaatctgttcctccaggattatatttttaagagcctaccagaatttccatttggactttaatgggtatctcaaacttaacaggttttgatttctaccaagcttctcctgcattgctctcctgcagccttcgccattttaaatggcaggtctagtcttccagtggctcaggtaaaagctttgacactgccttgactcgtcttttgctatcacatcccaaatttagtcagaaggtcctgttggctttactttagaatataatccacaatataatcaaattgcttcttagcacgactacttacttcttactaacaaaactgctaccactttgattcaagcacatcatttcccacctgattattacagaatcctcctgactggtctccctgcttctgaacctgggagctgaaggttgcagtgagcgctttgggaggctgaggcgggtggatcacttgaggctagtagtttgagaccagcatggccaacatgatgaaaccctgtctctactaaaaatacaaaaattagccaagcgtggtggtacgtgcttgtaataccagctactcgggaggctgaggcaggagaatcgcttcaacctgagaggcggaggttgcagtgaaccaagatcgcgccactgcactccagcctgggtggcagagcaagactctgtctcggaaaaaaaaaaaaaaataataaaaataacccaggtcaggaaatagctcttcaagagccctgtcatcatgatcctttctaaggatcattgtagcctccatcctgcttagaatttgttattaataataattctttattgtctcagcttttatggtagtgtttttatttgctttgcttcatagttgaaaataaaaattgcctccctaaacaatgtggattagcgtttcctgttttgacctttacgttaagtgaaaccatataatatgctttcttgtgtgcatggcttctggctcattatgttgttaagatttatctatgttgttctttgaaaatgtagttcattcactttaatagctgtgtagtaagtgtgtgtgtgtgttttttcttttgtgtgtgtttggtgttttttgttttttttttgagacagagttttgctctgtcacccaggctggagtgcagtgacatggatctcacctcactggaacctttgcctcctcggtttaagtgattctcacacctcagcctcccatgtagctgggactacaggcgtgtgccaccacacacccggctaattttttgtatttttggtagagatggattttgctgtgttggccagggtggtctccaaactcttggcctcaagtaatctgccggcctcagcctcctaaagtgctgggagtataggcatgagccactgcgcccagttatagtaaatatttcttaacatattcattcattccactgcagatggacatttgaattatttcaagatttttgccattgcaaatgatgctgatgtaaacatttttctatatgtgtcttggtgcgcacattttattttctggtgctgatgtaaacatttcacattagaggcaatcttaggtcataggatatatatgtcttcagcttctctaggtaatgcccgtctgtttactaaacaggttgcagccagcaatttgagaatttcacttgtttcacatccttgccagcacttacattaacatagtttaattgtgccagtttgatgcttgtggtatagtctcttattgtgttgtcaatttgcattgactcaatttgcattagtccatgactgataaagctgagtgcctttttgtatgattcctgttcttctaaattaaggtatgtttatgactcagaatgtagtctatcttggtgaatgttccatgggagcttgagaagaaagcgtattttgttgttagatgaagtatgtccatcatatcctgtttattgatactgtttttcttttaattttaaaaatgatttctatttattttacttcttaaaatgttttttattatttttttttattttttgagacggagtctccccctctcacccaggctggagtgcagtggtgtgatctcagctcactgcaaccttcggctcccaggttcaagtgatcctcctgcctcagcctcctgtgtagctgggactacaggcacacactgccatgcctgcctaattttttttttttattttggtagagaactggtctcactgtgttgcttagactggtcttgaactcctgggctcaagcaatcgtcctccctcccaaagtgctgggattacgggtataagccacagcacctggtctataaaaatgtttagagacagggtctcactctgttgcccaggctggagtgcagtggtatgatcatagcttaccacagcctcgacctgctgggctcaagtgatcctcctgtgtagctgggattacaggcacatgccaacacacctggctaattttttatttattttatttatttttttgagacaaggtcttgctgtgtcgcccatgctgaagagcagtggtgcgatctcggctcactgcatccttgacctcctggggtcaagcaatcctctcaccttagcctcctgagtagctgggactataggtgtgtgccaccatgcctggccaatttttttatttttgtagagacagggtttcaccatgttggccaggctaatttttatttattttaatttttgtagagatggggtcttgccatattgtcataggctggtcttaacccctggcctcaagtaatcctctcacctagggcccttgagttgctgggattataggcatgagacactgtgcccagctgattggtgttactgagttcatctatgtctttactgtttctgcctgctggatctgtccacttttgatagaggagtgttaagatcttcaactgtaatcatggattcatctatttctccttccagtgctatcagtatttgcctcatgttattttgatgctctgttgttaggtgcatacacatgaaggactgtttgtctccttggagaattgacccctttatcattatgcagaattcctctgtataataactttccttggtctgaagccttttctttctgaaattaatatagctactcctgatttcttttgattagtcttagcatgtaattaatatctttctgcattcatttacttttaatctttatgtctatttcaagtgggttttttgtagacatcccttatagttgtgtcttgtttcttgatctagtctgacaatccgtcttttaattgatacatttagaccattgacattcagagagattgttggtatagttggattagtatctaccatatttgttactgttttctttttgttgtatttgttcttatttttgtcttccacttttctgccttttgtgattttaattgagcattctatatgattccatttttctcctttattaacatgttatactttttttttaccttcttcagtggttgccttagaggttgcaatataatttacagctattttaagttaatttcagataacacttttctgcttcccaggttgtatgagtaccttataatagcaaaatcattctaattccttcctcctatccctcatatgatatatataaaatatgtgtacataattgcacttggtcttagccaaaaggctgagaagcgatgtgcacataattcaattgtacataattgaatgtgtacataattgaatttttgctactattaatttgaatcaaaagttttcattttaccttcatttattccttcttgaatgctctttctttctttatgtagatataagtttctgatctttatcatttaccttttctgtaaagaattttgcttaacattttttgcaaggcaggtctactggcaggagattacctcaagttttgtttgtttgagaaggtctgtatttttccttcacttttgaagaataattttgcagagcacagaattctaggttggtaggatctttcccctcaacactttaaatatttcattccactctcttcgttcttgcatggtttctaagaaaaatttggatataattattatttttggtcctctataggcaaaatgtttttttcttgtggctgcctttaggatattttctttataattgattttctgtagtttggaaataatgtcctaagtgtagttttttgtttttgtttgtttgtttgtcttttgtttttttagagatgggggtctccctgtgtttcccaggctggttcaaactcctgggctcacatggtcttcctgcctcagcctcatgagtggctgggacaacaggtgtgcaccactacacctagctttctctgtgtagtttttttttttttttttgtcattcatcttgcttgatggtctctgagtttattggatctgtggtttggtgtctgacaatttggggaacttttctgtcattattgcttcctatattctgttcttttttctctttctgctccttctggaattctcattatgtatatgttacatcgtttgtaatttgtgccacagtttttagatactccagttttgttttgttttttttgatccatttttttctcttcgcttttcaatttgagtggtttctcttgagatatcctcaagctcagagattctttcctcaagcatgcccagtctaccaaaaaacatcaaatgcattctttatttctgttgcagtgtttccaatccctggtatattttagttatttttttagaatttccatttctctgcttacattgctcatctgcttgctgtctactctatccatgagagcccttaaaccattttgtttgtttttgttttttgagatggagtcttgctgtcttggccaggctagtgttgaacgcctgggctcaagtgatcctcccacctcagcctcctgagtacccaagactacagacacatgccattacacctggcaaacatcttaattgtagttgtttcaaatttctggtctgataattccaacatttctgctacatctgattccagttctgatgcttattctctcttcaaactttgttttttgtcttttagtgtgtcttatgacttattcctgatagctggacatgatacactaggtaaaaggaactattgtaaataggcccttagtaatgataaggagctggggaagaggaagtgttctgtagtcttatgagtaggtgtcagtcttttagtgagcctgtgcctctgaactatgaatgtcatgtgtctcagtctctcgtacttttttggtgggacggtggctagagcgggttggggctggccatttcccctcttccacatggaaagcaagagctggcttgagtttggtatttttcttccctcgcgtcagcagtttctgataaaacttcagcaggttaggctcttatcatatagttttgcctgagagaagaccctgttaagaatgatgctctcgtgcgtttcagaagggtctttttttcccccatgcatgtcagaagcatgagggagttttctctgattatcactgtgagaaccttgttgagttcctagaggtaaaactcacaaaagtgtgggagcccccaatgattggccggccctggagtcttgatctctccgacttgtccatgctgggcctccagcaatttgtcagctatagttccggttttcctacatcagccctggctctggaggagatttgtgcttgtgggtttctgccctgcaaggctcaattttctgcatttgccagttggtctccagttttggggtgctttgttctgcaaagacctcacctctttgatggacctaagaaaaactgttggtttttcccctgcaactttttcagctttttatttgttaagaaggagtatcaacttttagcttcttatgtgctggactagaaacctgaaattttgtgtctctagttttttttttttttaacagtttcaaataaggctgctataaacatttgtttagaagtctgtgtgaagtggggaagacctttgtagctagacctttctagcaagatttcaaaccaagaagccataagataaaagactgatataatgcatatgatagactaaggactaatttccttagtacataaaaaagccaatgatgtattagaaatgggcaaagaacatgaatagtgagttcagagagcactgtagtaatatttattgcagaattgcttattatactaaagttttggaaacaaccttcatgaccatcaattggtgaaagttatgatacaaatcctactatactgatatggaatagaatgatcttcaagctagaaaaacaaatttgagaacagtgtgtattgaactctatgtgtattgaacacagtgtgtattgaacactatgtgtattgaaagaatgtgttgggaagaaaatgtttgcattagaaagtgtttgtgttagataatgtttgtgttagaagataagagggcaaagagggcaaatatatatataaatgcacatggatgcatgggtgtctctgtagagagaagaaactgacagggtatgccttaggggaggcgaattggaggcctggaagtaagggctgggctgtagactttccactgtatctcctgttcctctgtttaaattttatgcagtatacttatattatctatatattagaaactaaaaattaaaagcctatcactctttaatagcaaagcattgatttattagtttttttgtttttgtttttgagacaggtttttactctgtcacccaggctggagtgcagtggtgcaagcaatcatagctcactgcaactcaagtgattgtcccgcctcactctcctgaatagctaggactacaggcacatgccaccaggcctacctaattgaaacaaatttttatggagactgggtctcgctatgttggccaggctggtcttgaactcctggcctgaagtgatcctcctgccttggctttccaaagtgttgggattacagatgtgagccactgtaacccactgatttatcaatatttttaagtagcttcatttaaagtgactggttgcatacagtctccatatctcagtttcctcatatgtaaatgagggtgataatagtacttaggctttagtgacacagttttgtgaagtgcttaaaaaacttcttggtgcacagcaagctctgagtaagagccacctgttactgtgttctacagatgaatgaccttgagatgttagccacattgcaagttaacttctgaggtagaactgtgcaacagaaattttttaaaaaagacaataaggcagggaaaacttgggtctttagtttggagtcgtatctttaagctacatcctatcctcattcagccacgtcactatcttctctgcatttgtcatcttggctgaatcaactctaaggctgtgaccagctctggtgctctgaggttgactgttctggaaatcttttatttcag

SEQ ID NO: 107 - DNA, 17953 bp, Homo sapiens
  source 1..17953: mol_type = genomic DNA
gtgagtgtcatcttcagtccattgcaaagcgcaacacactttcacttctattatggtgactttgcacactgaaaccaataatttatttaaatttttaaaaattgggaccgtgcgtggtggttcacgcctatattcccagcactttgggaggccgaggcaggtggatcacaaggtcaagaatttgaggccaacctggccaacatggtggaacccctgtctctactaaaaatacaaaaattagttgggtgcagtggcaggtacctgtaatcccagctactcgagaggctgaggcaggagaatcacttgaagccagaaggcggaggttgcggtgaactgagttcgcgccactgcactccagcctgggtgacagaacaagactccatctcagaaaaaaaagaaaagaaaaaatcaaccgggtgcagtggctcacgcctgtaatcccagcactttgggaggccaaggtgggcagatcacttgaggcaaggagttcaagaccagcctggccaaatgatgaaaccccaactctactaaaaaaaaatacaaaaattagccatgtgtggtggcacatgcctgtaaccccagctacttgggaggctgaggcaggagaattgcttgaacccgggaggcagaggctgcagtgagccaagattgcaccactgcactccagcctgggcgacagagcgagactcatcctgaagaagaaaaaacaaacaaaaacttaattgaggtcttttactttaaaagaaaacagccactcattaccaaaaatatttcctgcaattcggaaatgtagaaagtaagtcactacacaaatttccctcttcttttcctgtctccccaacctctccatttagaaccatccccagaggcaagggttttgcaactttttttcattcagtgattccattaacatttgtaacaattgttcaatgaattgctttgtgcatatatgttttgacacttctgttcctgtaggacagatcctcagagatggaatcaatatgttattttatatttgtcttaaaaagtgatacatttgtgagggaggaggaatcacagctcaaaaaggtgttcagtgaaaagtaagtctcttctactccaaactccagcctatatattctctctgttctgtctctttcaatctctctcacacacaaacacatatatcaatttttttatctttccagagatattttatacacgaagaaacaattgttgaaacagttgattgagtttcctttttaaaacatgaaatcataaatgataacttactacttataatactttatttttttataccgtatcttggaaatcttcaatatgtattaatcttactcattcttttaagatgctgcatagatttctgttgtctaaatgtatcagttttgttggttgattttttaactaccttattgaggtacaatctgacatagttttgacaggtttgacactaaaaccatcatcacaatcaagataacaaatatatccattacctccagcgttttcttgtgcccctgtgtaatccatataatccctccagccctcaacctacgaacagcctcccaaaacaaccagtgatctgctttctttctatgttttgagacagggtctcactgtgtcgcttaggctggagagcagtggtgtgatcacagctcactgcagcctcaactttctgggctcaagcaatcctcccaccccagcctcctgggtagctgggaccataggcgcacacaaccatgcccagctaatttttgtattttttgtagagatgggggtctcactatgttacccaggctggtctggaacacctggctcaagcagtcctccttcctcggcctctcaaagttctggggttacaggcgtgagccaccatgctcagccatgatctggtttctgtcactatagattgaattttctcgaattttatataaatggaatcatatagaatataagatttttttggtttgaattattttactcagagtaagtcttttgagattcacccatttcgtgttaatcagaagttttggctattacaaataaagctaccgtgaacatttgtatacaagtcttcatgtagacatgtgcttttatttctcttcagtaaatacctaggagtaaatgcctggatggtatggtaggtgtatgtttgactttttaagaaactgctaaaccattttacaaagtagctgtgccatttcacattcccactcacaatttatgagagttccagttcctcctcatcttaacatttgatatagtgagccttaatgttagcctgtaagtttgtacaggtgttttactgtggttttaatttgcatttccccaatgacaaaggggttgaacttttttttttttttttttttttttttttttgagaaaggatctgcctctgttgcccaggctggagtgcagtggcacaattttggctcattgcaacctccacctctcgggctcaagtgatcttcccacctcagcctcccaagtagctgggcctaccggtgcactaccacaccttgctaatttttgtattttttgtagagatggggtttcaccatgttgcccaagctggtctccaactcccaagttcaaaggagccagctaccttggcctcccaaagtgatgggattacaggcatgagccaccacacccagccagaacatctctttatgtgtttatttgccacttacatatcttctttagtgaaatgtgtattcaattcttttgcccattttgttttgttttgttttcttattattgaattttgtaagttttttaatattttctgtatacaagaccttttctagatatataatatgaaaatattttctcccagttgtgctctgttttttcattctcctaataggttttcattttaatgggatttaatttattcagttttttccctttatggtttctgcttttcatgtgtatccaagaaatgtttctctattcaaaagttagaagataatctatattttatcctagaagttttgtaaatgttatatattttagttgttctatggtccatttgtggttaattttttatatattgtaagatgtggactgaagttcctttttttggtatatgtaaatttaattgttcaggtgtcatttgttgcaaagacttttatttcactgctaaattgtctttgtatctttgctgaaaaggaattgatcaaatatgtgagtctatttctggactgtgtattctgttctattgatctatttgtctttttttttttgagacggagtcactctgttccagacaggaatgcagtggcgcaatcttgcctcactgcagcctctgcctcccgggttcaagctattctcctgcctcagcctcccaagtagctgggattataggcatgtgtcaccatacatggctaatttttgtattttttttttagtggagtcgaggtttcatcatgttggccaggctggtcttgaacttcttgcctcaagtgatctgcccaccttggcctcccaaagtgctgggattacaggcataagccactgcacccagccgattttttttttttttttttttctgagatggagtcttgctctgtcactcatgctggagtgcagtggcatgatcttggctcactgcaacctccgccttctggcttcaagtgattctcctgcctcagccttctgaagagctgggattacaggcaactgccaccacacccggctaatttttgtatttttggtagagacaggatttcaccatgttggctaggctggtctccaactcctgacctcaagtgatccactcacctcagcctcccaaagtgctgggattacaggtgtgagccaccacacccagcctgtaagattatttttgaatgtttactattcccaagtattatttcctaaatgaattttgagaaaattgattttttgaggataccatggaaaactggggatgtgaaacattcttacgtcctagtgcaaataaatatgactcaagtcaaccacatcctactttcaaaaagccttcacccagaaaggggccaacttctcatcatctgattcagagaaacagacatgttagataataatcccagagtaattagtcttcagcaaagatgaagactatttgtctgtcttattcaaattccacagtcttgattactatcgttttataagtctcaaaagtaggtaatgttagtccatccattttattctttttcaaagttttgtctattctacaacttcagcagttccatttgaagtttagaatcagcttgtcaatttcttaaaaaataattgctgggattttgttagagattgcactgaatctgtagatcaatatggagagaattgacatcttaacaatattgagtcttgtgacccatgaccatggtacatgttaacatctatttaggtcttcagtttttctcagcagagttttatagtttttactgtagaggtctttcatgtcttttcttagatttatccctaagtttatcatatttccagatgctattataaatggtactttttaatttctatttttggttgttcattgctagtatatagaatagataatatatatataatatatatatttacgtgtgtatgtgtgtgtgtgtgtgtgtgtgtgtgtgtatgtgtatagtacttgctagaacctctcctacaatcttgaaaagaagtggtgagcgtgggcatattatcctgtttctgatcccagggcaaaagtattcagtctttctttcacccttaaatattatgctacctgtaggttttttataaatgaccatatcaagttgaagaacttcccttctactcctgctttaatggagtttttgaatcacgaatggatgttggatttagtcagatgctttttatgcatttattgaaatatttttatggtttttaattttaattttgccattatggtaaattaccttgattgattttaaaatggtattccattcataaaccccacctggttatgatgtactgtcactttgtaggttttatgactagatttgctaaaatcttgttaagaaattttacgtctgtgtaaaagacatgatctgtacttttagtgtctgtctgattttgagttgtgggtaatactagtctcatagaatgaactgggaagtattcccttcttttcagttttttgaaagagtttggttagaaatggtattatttcttccttaaatgtttggtagacttcagcagtgaagacgtctcagcctgaagatttttatgtgtgagaaggttcttagctgcaaattcagtttcttgaactgctgtggggctgtttagactatcagtggcttttttagtgagctttggtaatttgtgtctttcaagggagtctttcaagggatttgtccatttgatctaagttgctccagtgctctttatttgtttgtgtagatagtgtgatcctttacctttacctgaaaatttttattttgttttgttttttacgaatccacttttatttattattgtttcattagtttaaatccttgaggggtacagcatcactcggactctgtgtccaatagctctagcaggaagattgcttcggaatttggcacaaaccatgccactgtgttcatgcgcccaagttacctttccccagattactctggttttgtttggtttgctgccaggagtcaccgtgttgttctttgctttgtatacataaggacatctcttgcccaagtagaattctgtttcatctcgggcataaacacctttaattttaagaagagatgtgttcccttttgttctggagaccgcacttatagccagcaaaaatggcctcggactacagactgctttccagtcgtatttccatttagaacatttagaagtcccgttcctagccggtctccacaggatccaagatggcgaggcaagaatacttctttatttctttctttatttctttatgagacagagtctcactctgtcacccaggctggaatgcagtggcgcgatcttagctcactgcaacctccacctttcgtgttcatgcaattctcctgactcaacctcccgaatagctggaattacaggtgcccgccactatgcccggctaatttttgtatttttagtagaggtagggttttgccatgttggccagtctggtctttcactcctgacctcaagggatccacccgcctctcaaagtgatccacttgggtcctcctgaagtgatctacctcccaaagtgcagggattagaggtgtgagccaccgtgcccagatgatctgaagaattttcttttcttttcttttctttttgagacggagtttcgctcttgttgcccaggctggagtgcaatggcacgatcttggctcactgcaacctccacctcctgggttcaagcgattctcctgcgtcagcctcccgagtagctgggattacaggcatgcgccaccatgcccggctaatttgtatttttagtagagatggggtttctccatgttggtcaggctggtctcaaactcccgacttcaggtgatccacctgccttggcctcccaaagtgctgggattgcaggtgtgagccaccatgcctggcctacctgaagaattttttttaaatatttattttagttcatcaccagcaaacctgcattatttcagcttctgtatgtctgaaaaagaatttcatctttgcttttgaaaggtattttcactggctttagaattccaggttaacagtttctaaatattagtactgaaagttggccacggcgtggtggctcacgcctgtaatcccagccctttggaggactgaggcgggcagatcacttgaggccaggagttcaagaccggcctgggcaacatggtaaaaccctgtctctactaaaaatacaaaattagccaggtgtggtggcgggtgcctgtaatcccagctacttaggaggctgaggcaggagaattgcttgaacccaggaggcgaaggttgcagtaagctgagatcacaccactgcactccagcctgggcaacagagtgagactctctctctgtctcaaagaaagaaagaaagttgctccactgtcttctcacttgcatcacttgcattgttttagataagaaatctcctgtcatccttatctttcttcctccatacatgagtcttttcttcccacctctggctgcttttaagattttctctttcttactggtgttgatcagtttggtcacatgtgctttagtgtagtttctcttagttttttgtgcttgggagttcactgagcttcatagatttgtgaatttctactttgcatcaaaattagaaaattttcacagtttttctattcctcctttgggaactacaattacatacacgttaggcttctttagatctttcttttttagtcttctttctctgtgtttttagataagttcaattcctatgctttacatttgctaatctcttaatatgtgtttaatatgccattaatacattaatgtgtttaatatgccattaatcttactcagtgtattttttcttcatacattgtagttttcatctctaaaatttagatttcagtgtttttatgtcttctatgtttctatttaacatgttctatctttgctcaagatttttgaacatatggaagacagataaaattgctaccttaatgtccttgtctgctaattctaatatctgtgtctattctaggtagcttttgattgattggtttttctccatattatgggtcatatttttcttcttctttgcatgcctggcagtttttattggctcctaggcattgtgaattttatcttgttggatgctggatatttttgtaaatattcttgagctttgttctgggtgcagttaaggtgcttggaaacagtttgatcctttcaaattctgctttgtttgtttgtttgtttgtttgttttgagacagagtcttgctctgtcacccaggctggagtgcagtggtacaatctcagctcactgcaacctccacctcccgagttcaagtgattctcttgcctcagcctcccaagtagctgggattacaggcgcatgccaccatgcccggctaatttttgtatttttagtagagatggggtttcaccatgctggccaggctggtctcaaactcctgacctcgtgatctgtccaccttggcctcccaaagtgctgggactacaggcatgcaccaccgcgcccagaccaaattctactttttaaaaaaaattttacttgaagctttgggatacatgtgcagtgtgcatttgttatataggtatacatgtgccatggtggtttgctgcatctatcaacctgtcatctaggttttaagccccgcgtgcattaggtatttgtcctaatgctttccctctccttgccctcaaattctacttttaagatttgttaagtggaaccagagcagcatttattctagagataattaatccctgcttcttaaggcaagacacttctgagaactctatctaatgtagcaggaatttttgagatttttctggctggctgataagaatagtcattgttcctaggcctgtgtgaacatgaggagctgttcccttaaatccttttggatgattatttccctggcctcagacagtttcctcataccacatgtactaattaatactctactgaatactagcaggcaggtcctctgcacatctcaggagttctgtttctgttcagctcttttctctgtggtactcttttctgcaaaaattagctcctttggtcttctcaaactctgagctctgtgccctcaactctgttgagtttcacttaagttttctctcactgccccatagcctgggaactctcccaaggcagtgatatctaagggatcgctatccatcatttactcattttcagttattgaaaccattgtatgttttgtccaatttttgtttcaggcagtaagttgagttgttagttactatcgagtcatttttaattttgataaataactccccaataagtcctcccaaaaattgtacaaatttacactcccatcaacattttatcagagtgttcatttccatgtaccattactaccacaaggtattattcttttgtttgtttttgttaatctgataagcaaaaataggcatttcattatcatagaaattttcttatatttgaaatcaagactaatagttgtccaatcaaacagttattgagggccaggtatagtggctcatacctgtaatcccagaactttgggaggccaaggcaggcagatgacctgaggtcaagagttcaagaccagcctggccaccatggtgaaaccccatctgtgctaaaaatacaagaattaactggcatggtggcatgcacctgtagtcccagctactcagaaggcagaagcaggaggatagcttgaacccagggggcagaggttgcagtgagccaagatcatgccagtgtacttcagcctgggcaacagagagagactctgtcacacacacacacacaaaaaaaaaagttactgagaaaaatattttttaaaatgataaaataaacgcttttatagaatttatcatcatcttgcatgcataaactatgcccattataaatcatctgccatttttagtttaagtttaaagtggaatgagaacttaatggaactaattcatctgagttcaaatcctagtctcttacattaattctatccatcactaattacagagctctcttaagcttttcacctttatctagtctttccaaagcatcaaattaattttcagagaaataagtactctttctatacttatatttcatccatttatagaataggtaagtaaattacataattataacaaatacaattgacataaataccctgggaagcaaacctaaattactgttggtaaacatgtaactcaactggtagaaatagaagtgcaaaggctcaaatagagtaacctaccagctttgatagtactctgagaatcaaggaggtttcacagagggaaaagagaatgttgttggttagccttgcaggtcagtcaagtaaggatcacacaacagagcttctgctgatttttttttcacttgaattcattaattattcatgaagttgagcaccttttggtgtggtttttgactttgtatttcttcagtgaattgtcatttttaatccattgtgtattttttctactaagatatatctctttcttaatgacttacagttctttacctattacacatattaatttgttgttacatatgtggcaaatagtttctcctgctttatttttgttgttgtttttaactttgttttttgtatctttcatcatgcaggattttaaaattcttatgagatcaaactaaatatttttcatctcgatgtctatattttagatattgctttaaaagacctatccctacatctagactttgccgtttcaaaagttgtataattatggagcatttctcactgaccctttgcctatttgttccgtaggaagaatgaataaggattttagaagacatttagctagtgatgaacattctttatacatataggtgaagggaatggggctgaatattgatcctttaatagctagtcagagataaatctttaaatctttttttattcctggttttttggggcgttttgtttgtttgtttgagacagggtgttgttctgttgcccaggctggagtgcagtggtgtgatcatggctcactgcagccttgacctctgggggtcattcctcccaccggagcctcccaagtagctgggaccacaggcatggactcgcctggcttttatatatatttatatatatatatatataaatataaaatatatataaatatatatatatatatatatatatatatatatttttttttttttttttttttgtagagatggggtctccctgtgttcccagggctggtcacaaacccctgggctcaagcagtcttctcacctcagcctctcaaagtgctggcgttataggcgtgagccaccacaccagggcctattcccagtttttaaaaactgggcatcattacgtatgcttcgattttgtagtacaaattactggaatttttattctgtttcccaagttgggctagatttctactatctcttaaattactaatttgattaaaaatatcattttgcttatacataggattgaagttgtttgctggcttgactgtcactcagagataaaggtagaacaaagactggttttgagaatgatgaaacatgaaaattatatgcaaacctaaaaatgtatatgcttcatagaaaatctaagaagtataatatcacaacccaagaacatttgaaaaatccttcttaggttaaacatggtgctatagtttttaaatgtatgtataagagaaaattataatttggacatagagatcaaaattttaaatcataatacttttaaaaccagtagcagcttttcagtcctcattttgtttgattaggattcttggtatttgacgctgttgatctctctctctctctcttttttctttttttttgagacatgttctcactctgttgcccaggctggagtgcagtagcactatcatggctcactgcagcctcaaccttctgagctcaagcagtcctcctctctcagcctcccgagtagctgagactacaggtgcatgccactatgcccagctaatttttaaacattttttgtgcagatgggatctccctgcattgcccaggctggtctcaaactcctgggcttaagcagtcttcccaccttggcctcccaaagtgctaggattacagacatgagctgttgcgcctggcctgaacatattatcttcttttgcttttcttctctactctccaaccctccctctgtcctgttgggctgggaggcaggacattggtggtttaatcatggactctgaagagtcactgctagctgagtttgaatcccagcaccctaattacataggtgcccttgggcaagatattttacttctctgagcttcagctttcttacctataaagtagaaatagttctcctaccaagagttgtcctgagaatgcagtcagataatggtgcactgcctgccacaaggcaataactccgggcaaattgttccctgtcagtgaacggtaggagggtggttcacccaggtaatttcacaccaaaacgtgaacactctttgaatcttcttttttttttttttaattatactttaagttctagggtacatgtgcacaacgtgcaggtttgttacatatgtatacatatgccatgttagtgtgctgcacccattaactcgtcatttacattaggtatatctcctaatgctatccctcccctttcccccttccccatgacaggccccagtgtgtgatgttccccgtcctgtgtccatgtgttctcattgttcagttcccacctatgagtgagaacatggggtgaaccttcttttttccttacctctcatagtcactcagtcttcaggtcctgttaatgctacttctaaaagtatttggaatctacccacatctttccctccctactcagagatactgtcttggtcccagcaccatcttctgttaatccagctgtctccagattaacatccctgtctccattcttatccattcctaatagtctcatgcttcacagcccccagggagacctttccaataactgcccccattgcctgcaggataaaagacaaatcccttaatttagtctgtaagacccttcttaacgtggtcttattttcatgcctgtttcatatctcatcactgaagtagtcactgccataagtatcttgcaaaaacttactataaaacaaattcaagtttttgataagaaatttgagaaattaaaaaacaaaaaaggaaatgcacccataatctcaccattatcattttggttttgttctctaatttttaatgcatatacttacatatcttcaatcaaattgcatatgtagctttctttgtccccacaaaaaaaaatttttatttcgatttttaaatcgaaataaatacaggctcattatttgaaaacatagaaaatggcagatcctatttatgattcatacatttaccacttctcccaaattccctaatctcatttcctttttgcctgtgtttatgagtagaaattcatagatattttcttccttttttttttttttttttttttgagatggagtctctctgtcgcccaggctggagtgcagaggcttgatctcggctcactgcaacctctgcctcccgggttcaagcaattcttctgcctcagcctccccagtagctgggattacaggcttgcgccaccacacccagctaattttttgtatttttagtagagacggggtttcactatgttggccaggctggtctcgaactcctgacctcaagtgatctgacctgcctcggccttccaaagtgctgggattacaggcgtgagccatcatgcccggccttattccattttttaaatgacatatgaatttttataacattaatattttataaatttcagttaacattgttaaaggtgatggtagttgctaccttgtgttgagtaactactgtgtgcctgacatgtaactgctcatcttacacagtaattcccatttgactaatgagggaactgtatggctaataaagtgtcagctctgcctctcccgtggatacctcaacatgtgggtatgtgacaaccatcaaccagtcttcccccattgctggatgttaatggtttcttattttctgctattacaaaagatgtagtcactatttttgcatgttagtctgtgtcttcatttcacattgtttcccaataaaagttactagaagtgaatattttaaaagttttgacacatattgccacttgccttcctgaaagattatgccagtttacagggagtgattaattctaatgggagggaaagcagagaaaggagtgacatttcatagaggaggtgacatttgagctggatcccacaggatgagtagggctttgccagaagagaggcagagtggactgaaccttccagacaggaggaggaagcaagagcaaaggctccaggtctggagagagcctttgcctcagcagaggctgtgtgttccctatgcttatttgcaaccagaagtcctcgtcatttacttattttataattggcagggaagatagaataaagccacagagagagttaaaattctcatatgtgactctgccctttcatgtatttagaaaccaactcaaatgagaacttctttgaagttctgaaacattcatggtagtctatttcttttttccttttcccaaaggagggaaaaataccccgaggattcagtataattgggaaactcatcaaacctccctggttccagctgcttccctgaacgttaagggacaatagcagcatatttgacattggtcctaatgtggataggattcatcacctaccatcttctagttacatgcaaggagaaggtcattaactttttgcatttagcaggatttatatccatttgcttgataaaatggatgaaagtaactaaaatctatttttaagcttgggataagtgccagacactagggagtcaagttatacagtaagtagagctgtagccggatttcggcctttatctaagcactggtatgtctgtagttctctctttccgggctagagcaagtgctgaaagccaaggtgataaaggtgacagggtaagggagcaggtctgagctggggaggcttccgtatgccacttcttactaattctatcattgcagcttgaaatgcaatatggccagtaagccatttcccatcatattttgaagaaagcaacttataaattatgaattaagttaataaaatatttctaaagctgccaaagtacctcaggacaaataggattttttttgcatctgatatatatactgctactgggaggatttggtatatctggcattcatgaagcttataaagtgtgaatgtatattatgaacttatattttcttaaaaacctaaaaacaggcactgtgccacagtagcagaataacagatcgtacccagaagacacgggtatatatcccacagtgctattttgccagtcaaggcctttctttctgtagtttaacttattaaaaggaggaagccagctgggcgcggtggctcacgcctgtaatcccaacactttgggagcctgaggccggcagatcacctgaggttgggagttcgagaccagcctggccaacatggcaaaaccccatctccactaagaatacaaaaattagctgggcatggtagggcgcgcctgtaatccctgcaattagggaggctgagtgagacaggagaattgcttgaacccagggggcggagattgcagtgagccaagatcgtgtcactgcactccaacctgagcgacagagcgagactccgtctcaaaaaaaaaaaaaaaagtatgaatttaccttaaaaccttaccatgaaataaaaattagggaattagggaaacgtgaattacaggttgttttaacataaattgtgtattttggttttttttttttttttttcgtttaaggaaatgtaatacaggttaagtatcacttatccaaaatgcttgagaccaggagtattttgaatttagggtttttcagattttggaatattcgcattacattggttgagcattcctaatccaaaaatccaagatctgaattactcccttggagcattatgttagcattcaaaaagtttcagattttgaagtatttcagatttcagattttcagataagggatacttagcctgtaataggaatagatgaagtgatgaaataatctgttggaccagatttacttgacagctaagaaatattttttttgagatggagtctcacactgttgcccgagctagagtgcagtggtgccatttctgctcactgcaagctccacctcctgggttcaagcaaatctcctgcctcagcctcccaagtagctgggattacaggcacccaccaccatgcctggctaatttttttgtatttttagtagaaatggggtttcactatgttggccaggctggtctcgaactcctgacctcatgatccgcccaccttgacctcccaaagtgctgggattacaggcataagccaccgtgcccggccagctaagaaatctttatcatgcatttaaatggctttagacacagtccaacaaaattgctgtggccactctcccatctgtctcttgttctgcaaatgtctcctcagaagggagccagcaagtggaagtatttactccttattacgtccagtgaagccttaaaggaatcaagagtactttcttcttaaggttcttgcaatctattaattagataatgtatgtaaaactcctaacattatactgacgcttcttaatgttagaagtaggagggagaggagttgtaatttttgctttattatgatgactgtggttgttattgttgtggctattatttagattgttttacatttctgatgtttatttccgcctttctagtcttttctccaatcctgtcaaaggaatatgtaatattggagggctgtgtcctaaataccatttacctgtctatgaaagggaggctagaacttggtacatagaaaatatgcaaatctgcccctggccaggcgtgcagctctccgctgagcataaactgctggtagttagggtgtccttcctaagtgacaaacttcgtctgaaaggcaagttcatgcccgttcatgaaaacttatttcctcaaaatttcttcatgaagatagtgaaaatgagatctttaccaacagctcttggcaacttaaaagtttcaaaatcagatgtgaatggaagcctaagagaaggaaagccttcagtctacaacctaatgttttatttcaccaacgctgtgtctgatttctttagatcatattttccgactaaaacagaaaatctccctgcttagattaggattatttggccccttcttagatcaatttgtttcccattcctggttgtgccctttctctaatagcatgcgctttcttacgtatttggatagaaggaatattttttaaataacacatttaaaagtgtaaaattattttatctgcttaaagtgcttgcataagttttataagtcttttaaaatactccatgcaattggttataagaatttagggttagtggccgggcgcagtggctcacgcctgtaatcccagcactttgggaggccgaggcgggtggatcacaaggtcaggagatcgagaccatcccagctaacatggtgaaaccccatctctactaaaaatacaaaaaattagctgggcgtggtggcgggcgcctgtagtcccagctacccaggaggctgaggcgggagaatggtgtgaacctgggaggcggagcttgcagtgagccgacatcccgccactgcattccagcctgggtgacagagccagactgcatctcaaacaaaaaagaatttagggttagtttgcattactactgaggctgacatggtaaatgcatttttatttctgttaatgaaagtgatactattcattttatatggactataaagttttgtcttaggaaaaaacttacgtaattttggattatttaataaaaaaaactctccttactgcctagattcccaattcttttcatttttattatgctccaagcttttatcacttaactttgtttaactagtacctatgcaccctttatcacttaatcttccccttcaattatttcataggtttcagtcttaacttcccaaatgtactataagttccttgatgacagatactgccttatagccggggtatattctacaagagcctcagttgtgctacacatagttgttgatgaagaaaggttatagtcagcatcagtaaacttcatctgtttgtattacattgaatgccttgatgccacatcaaaattaatattagaaatatgcatctgcttcttccccag

SEQ ID NO: 108 - DNA, 15472 bp, Homo sapiens
  source 1..15472: mol_type = genomic DNA
gtgagagggtgttttaattttacatatagcattaagcatgatcaccacacctacttgttggctttgcctaagtaatatcacataccttgggagaaggaatagcacattggaacaacactttcatgcagtttagcatcatgtcacagaacatctagatgattgacttaaatttttcacatttcattttcttttggcattctgtggataccacgagcatcttatcttgtgataaaattaaactgcacacatcttgctatttcagatgaaactttctacatgattccatgctaattaaaggtgatgaacgcatttaaaaaggaagataatcatcaaatcatttagggtttccctttatctttaatgtagcatgcaggattttcaaagtgcttttctgatttttatagtacataaaatatttaacacaatacctggaaaatagtatgagtcataaagagtctactgttattattagatggtatatttatgtattataatgtgtgtcctgcaaataattgatatattattccaaattagatgtcacaatgcaaagcataattaaggaagggtctaaaaatagtagaaatgaagtttaaatttataaagcttctatgtagactggcagtctttttgcttttaaaaaaagtgaattataacttgattattaagggtgacactaatattaaaaatagtgataaaaatttgctattttcatattttattcagaggaaaaactcgagaaaaaagatagaaaatggagaactgtcagtattgggggaaaaaaccttgaaaattgttttaataagtataactaatagttatccattaaatagtccatttaaatagtctattaaagttgacattgttaagtaatgtttttcttatttcgaaagcatcctcgatttattatagaaaatttaaaacgtaaaaatgacaaaagaaaacaacaaagaaatcaactgtaattcaaacatcccatccgctcagagatagccacattaaatgtggggtgtatacatatctagtctttttatgcacaattgttactctttcataaaatgggataatattcacagtctgtgttttaagtgaaaataaaagtattaagtatctcattgcccatgtcattaaatattcttctatgacatgacttttaataactcatagccttctatcatatagctccaccataatttaattactaagtccccaattattggatatttgcaatgctgcactattttattttatttgtgggtacatagtaggtatatatgttacggggtgcatttgatattctgatacagacatactgatttttgtacactgatttttaatcctgcaactttactgaatgttaatcagttctaatagttagttggtggagtcattaggtttttccaaatacaagatcatgttatctgcaaacaggaataatttgactttttccagtttggatgccctttattttattttcttgtccagttgctctagcttggatttccagtagtatgttgaataacagtggtgaaagtgagcatccttgtcttattccagatctcagaggaaaggctttcagtttttcttcattcagtttgatactagctgttgaactgttatatatggctttcattgtgttgatgtatgttacttctatacccaggtggggtttttttgagggtttttatcagaagggatgttgaattttatcaaatgctttttcaacatcaattgaaatgatcatatgggtttttttttccttcattctgttgatatgatgtatcacattgattgatttgcatatgttgaaccatccttgcatctctgggataaatcccacttgggagaatcatagctcagtaccttgtttgtggtgggcaacttctgtgttgcaattcatgctccagagcaccctgtgggatcagtctgagactggagtttgcctgaggccacatttcgacttatcttcttccctgtcttaacctgcttgcctcacctccctgcagttttttcctgagaccattctctcagttactcatgtgctcaacatgtgctcaagaatcctcatgtccacttctgcttctagggaaaccagcaatgctaagtagcttgctgttttataaataaatacaagaatgagttccctatctgaattaattcttaatcaaaattaagaatttaaatatttgaaaatagttacatctctcattctgatatttcttcagttataatagtgctttttctcttttccatggcctttaaaagattaagaaagactgttctatgagtttctcattttactcatatgaacatcagtatgaaattaatttctctttggaaatccaccaaaggttctcaaattcttttctctttttcctgctttacttaatagcatatttaataaactataattaaaggtaaagataatttacatagatacaaataaatcactattaatatcattcttctctaaatagaaaacaggacctattaggtacaatgcatattacctgagtggcaaagttatctgaataccaaacccctatgacacacctatatgacaaaccctcatgtgtacccctgaacctaaaataaaagctaaaaaaaaaagaaaacagaaatgtcctttttcaactggatgaattttattctgtaagaaatagaggttaaacaaaagcattttcaagtgaaattacatgtattttcagtatttagaggaaatactttttagattatcaactttaacccattagttagccattgtctctaaggaataagcacttgcttcaagagaacatttcaacactaccatatttcagcctactttttctattgtctgactcacatgttcttgtgagtgagctgaaatttatctaaaattgtttcaaatagctgggtgtgctgacacatgcctgtaatcccagctactcgggagcctgaggcaggggaattgcttgagtccaggagacagaggctgcaattaactatgaatgcactactataccctagcctgggccacagagaccatgtctcttaaaaataaaataaataaaataaaataaaataaaataaaataaaataaaataaaaaaataaaattgtttgtaaatatttcctgattcagtgtatggccccgattcgatatagcaattgagctaaaggtctcataatggaacattttactaatggtgcttcagagatcatttctgtaatgactaggggaaaatgtcactctaaagaatgagagacataaggcctttgaggttgtagggctcttttcacaaattgatgtcctttggaaaccttatctttgcaccatcaaaaagttattttaggaggataaaatgtacaaaaatacagaagtagagttttaggtcaatcttatttttgtttttcttttcttaaaggtgatcagaaagcatttttagaaatgtataatattgtttaaatttggacagtatttggacatttttcagttttagaaaaaattttagaggcatggaatcacatggagtctatattggtctaatagagaaaatatgattttttttcctttgacatgtctaaactcttaactggcctcatttttacaactcaaggaaaaaaaatcatttgcccttaacatgtaatgctaggaaagaaaagtcatttcacactttgagcatcagtgtgtcttttttcttgtcttggaataatgtaagtttgtttgaatgatgccactgaaaataagtaactgtggttttctctaaagaaaattctatctaggacatggcaggcactgggacactgttttagcagcaaagacttttttagtatcatcattttaatgtgatgcttgtaaaggtcatttctatttgaacattaaaaatgtcattggactgcaaaatattaccagatgtttaatagtcctgtaaattatctttttagagtaatttataaaccaaatagataagaaagtggaatttcccccatgatttgaacaatagatatttatttcagataaggcaaaaatacattattcagattatattatacatatattatgtgtataatatatgtataatatttaggttatgtattatctgaataatggttggaagttaaggaataataaagattcgttattggatttattttgtctttgtaaattcagagtggtagattagtcaagttgtagagtaagtgcctaactgaatcctaacaaagtataacattcacagttaattcctttaaataaaaagtcacgtagaaaaatataaaaacatagtaaactaaagaaataaaattttaaaaccctctaattctgcaaatactggtaacatttttaatgtatatccttctagcatgtttcctatgtacatttttgtttgtttgttttttgagacagagtctcgctctgtcgtccaggctggagtgcagtggcatgatctcggctcactgcagcctcggcctcccgggttcaagcgattctcctgcctcagccacccaagtagccgggactacaggcacccaccaccatacctggctaatttttgtctttttagtagagacggggtttcaccatgttggctaggctcttctcaaactcctgacctcaggtgatccacctgccttggccttccaaagtgctgggattacaggtatgagccactgtgtctggtctctgtgcacattttttaaaataattttttaaatgttttacagaccaaataatgtaattacagagatgcctagtgaaatatcataacactttttttctatttttaaaatacctataaaaggaaaaagtaaatatccaatacatttattaggaaatattatgtgataatgtcataaatgcaatatttgaatatgacttttttaatgttagagaagtaaagaaaaaaataatgagcatttactgagtacttactgtatatctgacactatgttgagccctttattttatttttcttttctcaagacagggtctcaatatgttgcccaagctggtcttcaactcccagctcaagcaatcctcccacttctgcctcccaaagcactgagattacaggggtggttcaccatgcctggccatgaagcttttactgtattcactcacttaagtcttaaaacctccggatgtcctaattaccattatttccatttaacaaatgaagaaactaaggcactgaggagttaaattgcttgccctgtgccacacaattagtaaagaaaggagttaggatgaaaacccaggcaatctggttctgcaactcatgttccacatcagcacttctgcatgttaagtgtgaagaccagggcatcatgataaattgctgatcctggttcactggatctggggtagggcctgggactcagcatctctaataagcccccaagtgatgggatactgctggtccttggagcacagtttaacaagcatctccaccacacacacgcactacctctgtaacaaagctgtaattttctggtaacctttagcaaggatgggcccttcattcatctttctgacctccatagcaggttacctgaatgagtgagcacaggatataagacctttaccttaaacagtaacatcttttgattgaatttttagttgaatgtcaagaacttcccccctttaatcactggatgttgtcagaacttattcttcagaaagttaggtttatctttgtgggttctatttgattgatttgtgcattggctggccaaaatacatatccctcaacttggaagttacgaaagctgtattcatttgccaagcattcatttccatacttgggaaagttgtcctctaagacagagtacctgaaactacaaatcttacccagccctcaaggccaaaattgttcacaagaattcccaacatcgtctgtttcatcctgcaagtggaagtgtgtgagtggtcttcgtgtaatattgatgttgaaaaggaaaagttgtttggtaatactaaaagtttatttattccaaagggcctactttttgtattgtctgactcacatgttcttgtgagtgagctgaaattcatcaaaaattgtttgcaaatattagctgggtgtgctaacacatgcctgtagtcccagcttctcgggagcctgaggcaggagaatcgcctgagtctagaaggcagaggctgcaatgaactgtgaatgcactactgcaccctagcctgggcaacagagaccatgtctcttaaaaataaataaaataaaataaaataattggtaaatatttcctaattcagtgtatggccccaatttgattattttaataatgatatgaattccaccaataaaataatgtgacatcaaaaaaatccaaggtagtgcttttataaggttacaatgttttgcccaaggccttggataccatttaattattcaaaacagaaacttgatatttcattcacaatataagaacttgacactaaaatcaaagatgaggtttacagcttattttggattctctttaaataaaattcttcctccttcaaatcttcctcctcaaataataaatttgcaagatattaatttatagaaacaatagtttatcaaaatccctgaactttaaagcatccaatacagtaaaaagaaaaggttttcctttaaatagtgatgctatctctttcatttctatactgtacagatttggcattcacaatgcactttcattggatgccttggataaaactgggtcctaactaggaaaaccatagtaatccccatttttagagaagggaacaattgctcattatggtagagtgatttggtgcctaatatcaacggccaatgagttgaagaactagggtctttttaaatatgtatcaagaaaagaccattcattcacttgaattgaaactggtcaatgattggttcaattcagctgcttttacgaatatcctccataaaaatttctaaaatttcaatggattctaatgaggggctttgggttcatctgcctaaaatagggatgagtacaataacttcaatatccatgtcatgtccaattataaaatcatggctcccaattaatgatgaagtttttcactttgctttagagcagggcttctcaagttttaatgtgcatacaggtgcaggaaatggggaggtgtgggtcaaatgatacaaagcaggaaatgtgtaggatgaacaagtaaaaaaatctaatgtacagcgtgaggactataattaacaatcatgtatcatagtcagaattttttctaaatgagtagattatagctgttcttgccacagggggacaaagcgggtaactatgtgagatgatggatatgtctatttgttcccttatagtaaccattttactgtacataggtatcttataacatcatgttgtatgccttgaatttacacaataaaatttatttttttcaacgtgcatacagatcacttgagaatcttgttacaatgcagattcagattcagtaggtctggcacagatcacaaaacaccgcatattcaacaagcttccaggtgatgcttatggcccatggaccatatttggattagcagggctctcaaactttagcatgtaccagaatcacccagatggcttcctaaaacacagatcgatgggtgtcgtagccaaagtttctgattcagtaggtctggggcggactcaagaatttgcatctctaacaatctgcagtgaagctgatgctggtctggggaccacacattaaaaaccgctgctttgaagccctgcatctttctttcgcaagagtgtggctctccccagatgaaacccattaattccatccactctaaaatgacagcttaatcacagaaacctgggaagggctccaggagacacttttcctgggaattatccagaatttgtcccgcaagtgattgaccatagtccgtaccaaacgatttgacttaattaatctcaaagatatatttccacaaaattaacattaagagttgttggtctactttcctttaaaaagagaaatccatgatttctacctagcagccaagagttcattccttctgaattctttgtaaactgtatcaaaacacttctaataaattcaagttggtaggaacttttttatatacatatattaaagtttgtatatgtaacacatataaaagggtcagcagagctatgttcttttaccctttgatagcctgctgagtaacctgctgttattatgcattaaatacaaacttgttacagacagcagaaagcagcatcttcactcttttcattcattgatttattcattcattcaaatttgttttattttagcataacatttaggtagttctttactttcaggactttgccattaataatagagctatttattatgtactaacaggaaactaaatatgaattatgcattcattcaatattttttttttaaaaaaacccaactatgtgtcagtcactctgatggccattatatatgtaatgctgaggaaaatcagatgctctcatagcccttacaacttggaggaagagagtgacattataaaatttatacatctatgtgtaaaattgcagctgctactaatgttcaacaaaatgataccatgtgaatgctgttgactcatgtgagtgcttatatgatgacacacagccatgctgtgtcaagattcacttgaacccatgctccagttaccgctggaagaacttgctggacattaactgtgcaaaacaccaaaagtactttacttggtgttaatgaagaagctcaaaaaactgaagtcaacagatgaatttatccagctcattaaagctgtctcttgcttctaactcaccctggtagactcttcaaaattaggagttttgacatatttcattatgaaaaattctaagctaacattgaaagagctgtacaaggaacacctatatatcagccacccggattccataattaaaattttgatgctttcacttgatcacatataaatccctctatccatttatctatccatcttggttcaataggatgcattttaaagtaggttgcaaacatcagtatacttcactcctaaacgtttgggagtgcatacagcaggacaaagtttgttaaagtgattctgaatttcttagaaatatgaggcagatacattatctaatttcattcaactaatagaaatttaaggtacaaattgtgctcatgtttgaagaagctcctccttaagggaaaggctggctctaacaaagctactttctgacaatatttgtcctgagtagggtggatttctgcatgatgaaattatgagactcacccgtaatacgctggaaaaactgatggccttacctcttacccatgtggtgcccatccaaagcaagatgctgtcataaggtaaaaagaactgcactcttttttttttttttttttttgagacggagtcttgctcagttgcccaggctggagtgcagaggcgcgatctcggctcactgcaagctccgcctcccgggttcacgccattctcctgggtcagcctcctgagtagctgggactacaggcgcccaccaccaagcccggctaatttttttttttttttgtagttttagtagagacgggatttcaccatgttagccaggatggtctcgatctcctgacctcgggatccacccgcctcggcctcccaaagtgctgggattacaggcatgagccaccgcgcccggccggaactgcactcttcagatgactcagacaaggaaagcatgatccaacacctctaatagcccagtaatacatatgatatttgaaaggcccttcacttaccatgttaaccattcagttaaatcctccaaatcctaattctctgctgctcaaccatcagatccaaactttcaatgcccaggacggaaatcttttcaaccagcacatcaaatggcttttcctccttctatagaacttataaaaatgatcttttcagttaccattttactggtccatctgtattctattttcagtgcacttctgttcattttggaattaggaagcgtacaaattctttttatatttaattttaacattcaagttaggcatattttgaagaaaaagatattgcaatgattgcatttgtccactagagggcaggaacttacttctgtggttcattctgcactttttttttcactacccacctaagaaaaatctagtcaatgcgactgaagtactaccaccttctgaatcttctttccttgataattgcttaattggaatttaaatctttgaatcaaattaagaaactagacattcctagtttctgtttctatcacaatttccagtaccagatttttattcactcataaaaacaaataatgggggagaaataaaatattgacttctgctgattctcttgagtgggataaggaatttggtttttgcactttggcttacagatccatatagtggaattattcgatctttcaattataatatcagaaagttcaattttagtattgtactcctataggtgctttttttcatttttcagccattgttttgcttaacttatttaactttgtatgtacggatgcctttttagtgcaacagggtagttctttgagaattatgtttacatgtagacatctctatctcagcagcaagttaagttattattacggttccttaagctgctgttatcatagagtggactgctgtaatagaaaaatttagtctttagcatatagtccatattcaaatacttgttcacagtttcctgtgtgacctctggcaagttacatgacttttaataaagtttttagtaaagacttttaataacacctccgattattttgctttattatggtactgtgcgtgttgcctacactgactggctgtgaaaaagctgttgtatataacagtgtctaacccaggatgatctacagccacttctaattgcagtctccattcggtaaatggaatcaattaaaatgtgtacctatgggctgggcagggtggctcatgcctgtaatccagcactttgggagaccgaggcaggtggatcacttgaggtcaggagttcgagaccagcctggctaacatggtgaaaccccgtctctactaaaaatacaaaaattagctgggcatggtggtgcatgcctgtaattccagctactcgggaggctgaggcaggagaatcgcttgaacccaggaggtggaggttgcaatgagccaaaattgcactactgcactccagcctgggtgacagagtgagactccatctcaaaaaaaaaaaaaaaagtgtctacagcccttagcaaaaaagtttaaacattagtcacatgtatatgttatagaatcttacttaactcaggcatcccaaccagtactggtctgtagcttattaggacctggcccgcacagcaggaagtaagcagcaggtgggcaagcaagcaaagcttcatccccatcactcaaattactccctgagctctgcctcctgttagatcagtagtggcattagattcccataggactgtgaaccctattgtgaactgcacatgtgaaaaatctaggttgtgggctccttatgaaaatctaatgcatgatgacctgttactgtttcccatcacccccaaatgggaccatctagttgcaagaaaacaagctcagggctctcactgattctacattatggtgagttgtataattatttcattatatagtacaatgtaacaataataatagaaataaagtgcacaatacatgtaatgcacttgagtcatactgaaaccatcccctcaataacctcctctccccctggtccatgaaaaaattatcttccatgaaactggtccttggtgccagaaaggctggggaccactgacttaacttgtatataacatctgtctccagaaaatcatgaggtccctgacaagagtcagactatgcaaggatctccaaattccttagcccagtgtttaatgtcctcattactgaccctcttctctatgcctttgcttggccactggggcgagaaggtaagaagctcctggcccaccgagttcccagcacagtcctgtcacttcagcattactaaggatgcatagctcactcttgcaccatctcagaattccaggcaaactctgctcctcctggcagagggtacagattggcaacttctgggccaaatgcagtctgaagatgtgctctgtttgtcttttcagtgattggaaactgggagagttcactcaaaactttcatttttccatttttctcaaaacctgggtggaaataggctaaaaatgaacagcagccactgccccatttacaggctgtctctctcctgctctggacatgacctcactttgccctattgcattaaatctacttcactggtttctatcatttccactaactgcctattactctacagtgtgaatagtatccttaggggttgtgtcccaagagtgacacagtccactctacatggagacatcaccaggtgtgacccctggactaagcatttctctaaagcctacttcaaagtccagcaccaacccttggtgcccactttatccccgactgcaaccataaagtatttgcctgaatgtttacttaacatctatctgctttttaaaaatgtctttgattttatatagtacgtccctttttggaaggtggaggctttgtctcacatgcccttgataagcagagatttattttttcctttatttgactcaaattgacaatcgaacttggtttcccaagggcatacagctacatggagtatctgaaaacctaatgcaaatctaaaaataaacttgttggatccagtttgaatgcacctccagtctaacacctcaagacactaattttagttgccaaaaaaaaaaaaaaagccaccattattactttcacagaagctggttttccctaacttccattctttcctccatcaaaattttctttttctctatcctttttcagagggctaattttagtgagctgtcacattgggaagaatctggttcattccccacatggttttagaaaccaacttggatataatggggaaggtcagatccccacggaatagggacatcttcctacctgctttctaaagcagctgagtttggtaaccatgggcaccctcttcagctgggaggccagcaaagcgttacccctgctgtatttaagccaaagaaccacccactgtgggtgtataggtcccatgtagtcaaatctagtttttcaagggaagtaagaaacccattgtttcagtataagatcaccttaattaaaagatttgacaacactggttgagccaaagaaaatgcatccatgtactccattgggaccatgactttccagtttgcaatgtcttgctgaacaacacatacacaatcctttccctttgcatataattctagggagaatttttctgatggatgtaactaaatagtgtgaccatactggcacttacccatcagaagtagtcatttttcaaaagaaagattctgccatagtgagctatacaggctgccccggttacttgtttagtctcctgtctcccctaactgatgtccagccactgctactaagggctcttccagcattgagtagggtgtagtaaacaagcagggatgatttgttgaattaaaataagttctgccatcacttaatgcagttttggaagatggtttaaagatgatttgggaaacagattaaaagccactggtgacaatcagtgtcactattttcactcttatcttactttttataagaaagttattataggtcaatttttcatctgtaatcacatgccaaaatgtcacaatgttaggctccaaaagacttctggaaaaatatatttcctaatgtatttttaaaatgtgctacaaagtagaacattgggatagcctcattgtcagtaaaacctgccagggacttggaaggcaattctgataaagagttacagagaatttagcatattgaaaagcaacattaaaagagtatgtaggcaattattttataaggatcagcatttattcaacaaacatttttaaactgtttactgtgtataaggtatgtggaattagctgctggagggtgtcgaatgaagattttacgtttcaatgcatttattattattattcattggtagtattccacaagcttaaaggttttatttgttttatgtcaacataaataacaaacagatgctctctaaaagaaaatggtattatttaagaatagggcatactaaattatgtgcttagtcagggagggaaggaagacaaaggtttgtaaaggataaatgaggagggttacataattgttttcagatgattagccttggctacaaggatcaataacaagagtgacctcagtctgacgttggacagggagttgctaggcaggtgtcctcacagaagtattttttgtgtaaagttgctatggcctttgtacaaggtgatggcttttgcagagtcttttgtgagagtttttcttatcaggcatttatgagtgagaaccttctctttatgacattccctggctctttttgtcagggttttttgggtttttgtgggtgttgttgttgttttaatataagggactccatttagattctgacaactttcacattatttaacatccacatatttactctgtgccagaaacaattctaagtactttataagtattaacttatttaatcatctaaacaatctaacaagataatattatgatccccagtaaacacctgtcttcatctataaggataaagaaattgaagcacagagagttaagtgaactgcccaaaatcacactgctggtaaattgcagggccagaatctgaacccaggcaagctgtgctccaaaatgtgtgttcttatccatcacatcgattagctcattctgtaaaacaaccccaaacttggcagcttataacatcaactagttattatttttcatgcattatctggtcagctgggcaggtctgcagatccagaccagactcatagactcagctcatctcagccgggttcactcaagtgtatgtgctcagctggggactggctggtccaggacatccttgaccaggatgactcagctctcttccagaagagctggatgacagaccaggatgactcagacctctcatcctccattgctataataggaccctgagaaacagtggaaaaatttgcaagggtcttttgtatcaagtttgctattctctgattaaccaaagcaaatcacatggtctggtccagagtcagtgtggaagggcaccaccaacgggcatagacataggttggtgtaaaaattggagactttaatacaattaacctcccatagtcatggctcaacactatgctgttttaaccctgctttccagggagtatcaaatttgatatttccaactccaaaagaattgtgaagatgctataaaatgtagccttgttggtttaggaaggcaagaaaagaataaaaagaaatgtggaaaatgaaaggatatttataattttag

SEQ ID NO: 109 - DNA, 2438 bp, Homo sapiens
  source 1..2438: mol_type = genomic DNA
gtaggttacaatttactgtctaatgagctcaggactgttttgaatggtaacagagttgctgagcttaccagttcacacgttgatatcctctatttagagcagcaaatgttcaagagaggtacttagacattagagtaggagagatgaattagtgtcatcaccatctgaactacctctaagttcatgggttgaaatatccaaagaaataattggcagctttgtctttttttagataacaggagttttgattctcatgtttctccatatttcctttttttccttcttactgttacttataaactgattgctctaagattttatctttgatttatttgaggcctaataagttgttttagaatgtgactccactggtacctgagctgtacacctcattgttgcctctttgtagaggtttctctgcaatgcacttgtagatagaataccaaaaaataactattatttattatattcttgagagcttaccatttgctctatggcatattgctggtcctctgctgccatgagtgaaacacttggaggagttgtcagtacccccttaactactacactttttattctgtagttgccgactgatcctggcctctttcagtattagcagtatcaagtagcctatttttctactcatttcccagtatctctctttaggagaaaaaaaaaagttctgtgactcctatcaaaccttccaaagttcttctgataccttggctatcccattacttttcctgagggaaaagagtgaataagtaatgtctgcttggtcccctggccaggctatggaactaaaaaaaaaagcagagagatttgtgccctttgtgtttggagcattgtagggtggtcagagaaggagagatagtccttgccttaaaacaatttgtaatttgtcaggcagtgtggcatgtgcctgtaatcctagctacttgggaagctgaggcaagaggatctcttgagcccaggagttacaatttagaagaggcaggggtatcacaaaatatatattcacgtattataaaatctaagtagcagtttcatgtaaattttagggttggttatagaatttcagacctatgttgaattttgttatatttaaggtggaatgattgatccacagtatacacagatctgtacagtgaagattatgtcacgatagggcatacttctttttttttttcctttttttttttctaagggtgagtctcactctgtcgcccaggctggagtacagtagcgcaatcttgactcactgcaacttccacctcccaggttcaagtgattctcctgcctcagcctcctgagtagctgggattacaggcacatgccaccatgcctggctaatttttgtatttttagtagagacggggtttcatcatgttgatcaggttggtctcgaactcctgacctcaagatctgctcgcctcggcctcccaaagtgctggaattacaggcatgagccactgcgcctggccagtagggcatacttctgtatgagtgctgagggcatgctgtgaatgaagtgactacattgggtgggattaataaaaatggcttcttgaaggaggtgtctagatagccttgggatacgggtcccatttttggtccattcaggtccccaccccacacaatatattatgggagagtcctttttcttgaactgtaggagttccaggaagcgctcgcccctggccgaggatatgtccttgcaaaacacgagccctcctagtgaagaggggatgtcacccaaagcctaccaccggtgtgtacatttgctttttcccattgtcccttccagttggccactctcggtcctgttaaattcaccttgcaaattagtcatcatatttgagtttccattgtttgatgaaaacaaagtgttaatggggattactgaagaagaaagagaaagcccctgtcctggaagagcttagacttagttgggaaaactatactaacattgaaatacttaacacttggcaaacagaatatcaacaatgtaatttaacctaatatgaaccaagctcttacacgctaagagaatgtgaaacaaaagtttaatcagagtgggataggttataatgaggaaaacttcttggaggaggtgagttttaggcaggatttggaacaggggttgtggaaaagttgagagaaatcattataaatgtgagcagtagcatttgcaaagaccttgagatgggaacatttataagaacatgggaatgaaatttgtttgactggattaggagaatgttgaagttgggtgagatggagagtctagtagaccctgcttctggcaggtggctatttgcaaggttgtgtcatattcccctgggaatagccagaaaatgctggtaggggctaggataattcttcccttctccccacggggagggatacagcttttctttcatcttgggttcccttag

SEQ ID NO: 110 - DNA, 1455 bp, Homo sapiens
  source 1..1455: mol_type = genomic DNA
gtgaggagggaaaggtgaggggcggccgggcgtcttttcctctgggcctggggtgtctctgcagggagaccctcagcagggagcccaccccagcgagcactgtcctaccaaggcggaggcagtgcttctgcccaccctccctggggtcaggcacccccttccccagtggggtttcctaggtctgctgttggaaggtagcatgaacctactggcttaaaacagtgcaggtgtggccgggtgcagtagctcacgcctgtaatcccagcactttgggaggccagggtgggcgggtcacaaggtcaggagtttgagaccagcctggccaacatggtgaaaccccatctctaccaaaattagccgggtgtggtggcacgcacctgtaatcccagttactcaggaggctgaggcaggagaattgcttgaacctgggagacggaggttgcagtgaactgagattgcatcattgcactccagcttgggtgacatagcgagactccatctaaaaacaaaaacaaaaaacagtacaggtttattatctgtggtcctgtaggtcagaagtccaaaatgagtttcactgggctgaagtcagggtgtcatcctggagcgttccttctgggggattcaagggataatccattccctggtcttttccagcttctaggggtcactggcaccccttagctcgtggccctccctctgtctgcggagccagccacatagcaccctcagacctctctctgactctgcttctgtcttcatatctccgcctctgtttttgttcccctcttctattttaagggcccctgtggctatactgagcctactcagatggtccaggatagtcttcccagctcacaatccttaaaatccttcttaacctcttcacgtcccttttgccctgtgattctgggaattagaacatgggcctctttgggcatgtgtgtgttggtgggggcgtaatttgccttccacaccaggatctgtccccgctgcaacaggggatgttattcaagtaattattcagttaccttctgtcttccttggtagatgtactcgggagaggagacgttttctgtcttgtgaactgtcgtttgccaagcacccggcctggcacagcgttcaggtgttccgtgtccccttctcctttccctctccccatctcacccctggtctgggtgtgggggtgcagctgtgagtagcacagacaggacccctgccccgtggcgtggacattcttgttggggccgggtcaaagagacagtcaacaggtgaactctgtcctgcgtctagcggtgctaagtcaacaccaagaagaaaaagaaagggggtggcggtgaggcagcattaggtgctgatttaactaaggcacgtggatactcggggggcccgctcagaggaggcctgggtgggcagcccacgcgagcagctgcaggacctccccctcgccctccccag

SEQ ID NO: 111 - DNA, 42234 bp, Homo sapiens
  source 1..42234: mol_type = genomic DNA
gtgagcagcgagcgccggggcgcggggggcgcagtgtatcctgccccggggcgggggcggcgcgaggcgtcgggatcctaggccgggtgatgagccgaggcgggttcggacgccgagcgcgcgcgctgggtggagatgtggggtccgcggggtccttgctttgtgtggtgtggggggtgcgcgaggtcaccggatggacgtctggggagctgcagggtgggggcgccctgcgccgcggctgagggtcttctgggggatgtgcggccagctgaggtcgggtgggggcatgggggcgcgaggggcgagtgtggcaagggatctgcttgcgccgaggcgcggagtctttgcggagcgtggggtggggacgtggggtgcattcgcggggcgccgggggcggaggtgagctttgtgagtgcgtccgaggtgggggacggggagctgacttccccatgcgtgacccgggcccggcgtggccatcgcttgggagtcagggccggcgaaggccgtgcgtggcgagatgggtgctcgggctctctgcggtgtccctacccgggcagcggccccggggcctgtgcgcaggccccgaggccgggcaggaagcggcccccgcgacctggggagctctgtagcggccaggcccgggaggcacgggcccttcggggatgacgtcacgggcgggggccccggacacgcgagccttgcgccccacagacggcggcgcagcccgccgcccttttcgaggccggccccccctctcacgcgccttgaaggcagggaacccgggaggaggacatgggggccgagtgcggcggggacaaggggtggcaggacgcgagggtgacatttggagcctggtcgcgccaggggcctccgtggtggggcggaggggaagcgaaacaccagccaggccctaggccgtcgcggccccagcttcctggggcgcccgttttcccggctagcagttttctttcttggggctcttggtcgttatccagtccacgcaggggccggagtgcgggctgccgcggtgctctcctgcgcggagcccgggctggcgggggcgcggcgggcctcgggctctgaatggatgggagcgagtgtaacaatgcgccggtgggggctgggggaggggaggccgcgcgcctgaatggcggagccggccgggcgctgctccgcgcgccgcacactctcccgcgccgccttccccgcggtttcggcgggcccggattcagggacccactcgggatctgcacggttcctcccaccaatactgtcccccgccccccttttatgtctttccaatgcagtagtgtgttgagaattcaagggcattacatctggttgcaatccagtttcatgccgctgccgggctgttaagacctcgcgctgacgtcagagcaggggaattacttctttttattttatctttttttagttgtctgctgccctgggaggagaggcgggggtgggttaggctagctctgatgtggaggcgccagcgtgatgggagccccgagctgggggctctgcttctcttcctgcccctgcccccctccattctccatacagtcctcgctctgctcagggtcaggcccaccccaggtggggggcagccctcgctgcagactgaatggtggcccctccctgctgaccacacagctgggttttcagaggctttcctgggacgtggccctcgggatctagaaactggaaaggaatcttctagtttcccacccctccccctcttgacaggcaagccggtatattcggggcccaggagcaaggaaaagtggccttttgcgtgacacagaagtggacacatcattctgatctcagggcaggctcagccccataactctggcaaaagctctcacaagcaaaagccttggagaggaggagaatgtatcaaggtgagatccaggccccagaagccaactgtggagtgggcaaaataggacctttcccaccagcctagcatccctctggcttctgtggagataaagggaactcaggggtactggagctgcctttctcttccactagactgtggggctctcataggcagggaccctgtcttactcctctttgttttatttttgagacagggtcttgctgtgtggcccaggctggagtgccttggcacaaacacagctcacttcagcctcaacctccagggctcaagcgatcctccagcatcagtctcctgagtagctgggatcacaggcgcccgacaccacacgtagctaattttaaatttttttttttttctagagacaggggtcttgccatggctggtcttgaagtcctgggctcaagcgatcctccctctttggcctcccaaagtgctgggattacaggagtgagtcactgcacccagccttactcctctttagactcccaagcctagaccaattgctttcaaattcttgcccgtgacctatagtaagaaatacatcgtaggtaactacacaggtcacactgtatatagctgaaacaaaagtttactgaaataactcccttactgtgtctgctggtctgtaatcctttttgttcttgtgtatttgttttttttttaattactgattgctacccacgaaattaattttgcaatccactgatgggtcatacccagaatttgaaaaaaacaagcctaggaaatgaatttgccatctattcatgcaacaaatgttaattgcaaccctaataattcctctcatgttaaactactcaagtaacacttggatacttgggtgaaaaatgcaaataagccagaaatatatgtagtaaaagtaaaagttcccttggcaccctccctgcaggtaaccccagttaatagtttgaacgtatccttccagactttttgttactcacttaatgcatatatatatatatatatatatatatatatatatatgtatgtatgtatgtatattacatataccaatccatgcatagttttctttttccccaagtgaggacatactgtgggctcttcctcggcagcttcctttttcctctccgtttgtcttggagaggttggttgtgtggcgaagtccttcagggcaagttctgggttgactcctggctccaccacatactgaacaggccatttacctctctgtgcctcagtgtccccatctttacaatcaggagaataacagtacagacctcacggtactgaagtaaagatgcagtgagttaatccatatgaagtttagagcagtgcttttgccaataaatgctgattgctgccgtcattgttgtattgttattgctgttctatctccatggcagcccatgtttgaaatgcattgctttccacagctgcctgtggccatggcatgggtgtctttttcctcccctatccaacgtgtggctccacagggagggaggaggtgcaacagcaacggtgtgcgcagagcagcgtctctgcgggagaggcacctgggcactgggcccaagggaacagggattttccaaggacccactgtttccaaagttctgtgcttaatgtcggggtccaagcaggaagcatccctgcacttgaccacaagaaggtcacagcccagtgggtgattgggacccagctcatagccaaggcctcgaccagagctggaggcttcctggaggaggggcctttgagcaggtgcttcaggcacggcgaggtaagagtgagaggagcattcctggcagagggaacacagtgagcagagcgagtctttggaagctggaagggatgtggcctgtgtgctgtagccaaacaagaggggaggacttggctcagaaagaatggtggcggaagaggttgggctgttgctgggacctcctcactggcctccctgcctccatcctgtcccctcccaggtgctggccagcagcactgtcagagcgatcgttctaaacccagcagataacctccagtggctcctgctgccttatgaataaaggtcccatctgtagttcttcccatgctgtccagggccatttctggtgtcctctgcctgccctgtcctcattcagtcctgtcccctccagccacagctggcacctccttgttaaggtgcagccatgtgcatccttgcctctgtgcatcgggctgggctgttccttccacctgggatgcccctcaccttcctccctgccgccccagaccaaaacagacgtcctgtctcctcctcctctgacctccgaggcagaatgagtcatctccctttgtctatactcgtggcatagcgtttatcacggaattatcggcaattctgccagtgtctgtcctccccatgaggctgaagcatcgaggcctgaaagcacgtctccttgctctctccggcccagtgccaagggcgaggcctagaacacaggacgctcagaaatgcttcctggcaggagggccaggtgaggtggagagggtgagagccccaacattgtctcccgtgggcccctttgatctttagcaagggcatgctcaggtctgtgtggatcttgtgctgtcagcctttagatgagtggggtgaggggcttggtggggtcggggggcagggggaggtggcgggcagcttccccaggctgcttcctgagggggctgggagaaactggctcatcctgttccccagtgattgaggcagagctgtgccctgttcctggtgggtcactggggatctgagattggaatgtgacaccagggaaggggaggcagggtgggaggcagggcttggaggtacaggctggggcttggctggcaaaggacagatttcgctccactggttcttgaacccgtgtgtgtgtgtgtgtgtgtgtgtgtgtgtgtgtgtgtgtgcacgcgcgcgccggggaggggagagatggggaagagaaaaacatgagggcagagaggtggagtgggggtggaggacctggggagtggtgagcagggacagggagagatggaagtggggggacggcaaggagtgagggagaagttcctgctgctgctgctggagagtatgaagagtgtgcttagggccaggaaggaaagcagccaggcgcatcgtctcacaccaccatcagccatgccttccttcgtctgtccagcagacaaccctaagtgttctcttgcttggctccatgcttgcatggccccagacaggagcaagcctgtggtccaggcttcgcacccttgaagtctaggggccaggtgaacaatgagcatccggtttctttcttttttttgagatggagtcttgctctgtcgcccaggctggagtgcaatggtgcgatctcagctcactgcaacctctgcctcccgggttcaagcaattctctggctcagcctcccaagtagctgggattacaggcgcccaccaccacgcccggctagttgagcaacctctttctgcacaaagtgatcaggctgggggagagaaggtgcccagaatgctgtgcagaggcaggagaggagggtggagcaggcgagcatggggtagggggcagggaagccatgtgttaggcactatggtggggagccaggactgctggggagtcttcctttcctctctggcctcggtctcatctgtaaatgggggaagagtggactgctcttgcactgatggtctgtggacccaagtcacccactccttgggcatgagaaaccagggaccccgtggagacagctgatagaacagggacagcaggcatgctcagagcgtctgcaggcccatggtcagggggcttgagggagaacatgcagaatccagtggagcttgggttcgcctcctagagttcccttcttggagactgtgctcatctggaaggcgagatagggtcggggtaggggaaggagcactggattcggaatcaggaaaagtggttgagttttaactgcagcatccctcgggcaagtcactttccctctgtgagggtcagtttcctcttctgtcaaaaatgtgaacgggctttgttgtaagcattaaaggtgagctggggcgccgtggctcacgcttgtaatcccagcactttgggaggccgaggcaggcggatcacttgaggtcaggagtttgagactagcctgaccaacatggcaaaaccccatctccactaaaaatacaaaaattagccaggtgtggtggcccatgcctgtaattccagctacttgggaggctgaggcacgagaatcacttgaacccaggaaatggaggttgcagcgagccaagatagcaccactgcactccagcctgggtgaaggagactctgtctcaaaaaaaaaaaaaaaaaaaaagtgagtgttgctgtgttttgtcatctggaaagcaaggaggtcctatagcttggggccataaacaggctttggggtcacaccagcctgggttcaaatccaggtaccagctgctcactgtggggctccatttccctcccctttaaaatgaggataataggcagggcgcggtggcttacgtctataatcccagcactttgggaggccaaggcgggtggatcacttgaggtcaggagttcgagaccagcctggccaacatgatgaaacccatctctactaaaaatacaaaaattagtcaggcgtagtgtcacatgcctgtaatcccagctacttgggaggctgaggcaggaggatcacttgaaccccggggggtggaagttggaatgagccaagatcgtgcctctgcactccagcctgggtgacagagcaagattcagtctcaatgataaataaataaacaaaatgaggatagtaacaggcccctcctggttgctgctgcacagttcctcagctgggatatcattgctgggctgttaggcagttgttttttgttttgtttgtttgttttttgagatggagtctcgctctgtcgcccaggctggagttcagtggtgcgatcccggctcactgcaacctttgtctcctgagttcaagtgattgattctcctgcctcagcctcccgagtagctgggactacaggtgtgcgccaccatgcctggctaatgtttgtatttttagtagagacggggtttcaccatgctggtcaggctggtctcaaactcctgacctcatgatccgcctgcctcggcctcccaaagtgctgggattacaggcgtgagtcactgcgcccagccttgggcagttatttttattgctaaagtgctttgtatgtagaagagatcaccattatgattattattttttttttttgagccggagtgttgctctgtcgcccagactggagtgcagtggctcgacctcggctcactgcaacctctgccccctgggttcaagcatttctcctgcctcagcctccctagtagctgggattacaggtacgcactaccatgtctggctaatttttttttatttttagtagagatggtgtttcaccatgttggccaggcgggtctcaaactgctgacctcaggtgatccacccgcctcagcctcccaaagtgcagggattataggcgtgaggtgagccaccacgcccggccaattattcttcttccattcatgccaggtcacatctaacccttacctgtaataacattggccaaaatgaggagtttggtgcttatttcttttctagccaggtcaaggcagatggattgagtgggtctttttacacatggggcgggtgagaattactagttttctggccagagtttctgtatgtaaagggactttgccccagtggtgtaggtggaccccaggaaagcatccagcaacttgtgactttagtggcagtataaccacaaactctcattcattcgttcatttataaatcacgtgtagaacaccagggtactgagaaaacagccatgaatgagatgcagctctaatgtagcatagtgggtatgcatatgtattttggactttgcctgggttcagatccagggtctaccacttgcgaacttagccaagttatttatctcctttacttggttctgtcatctgtaaaatgggggaactgatagaatctacctcatagggtggtcgtttgttcaagtccagcatcaggtacatagaaagtgccagagcatggcccttcctccattgttgcttttatttctgccctgaaggatctcatggaccagcttggtgctggaggaggtcaccctggccaggcttctcagtgacggttggcatccagaaaggggtgccaaagccccccaactccttgaatcagacccttctatagtgatctaaagctgcttctctgcttgactgttggggcctgatgctggggaggtcctgtgaggccttattgacctgggaaagtccgcctttgtctggcgccaggtgtgcttgattttagaaggaatttcattcctagccgggcaccgtggctcacgcctgcaatcccagcattttgggaggccgaggtgagtggatcacctgagcccgggagttcgagaccagcctggccaaacatggtgaaaccccatctctactaaaaatacaaaaagatagctgggcgtggtggtgggcgcctgtaatcccagctactcaggaggctgaggcaggagaattgcctgaacctgggaggcagaggtggcagtgagccaagatgatcgtaccactgtactccagcctgggtgacagagcgagaccttgtctcaaaaaaaaaaaaaaaaggaatttcagtctcaagtatgaaagcagaaagtgtttcctgattgaggactcctcaccagccggaggcagcaggactgcctgcctctgtgtgtctttaggcaggttcctcaagctccctaagcccgtttcctccttcatcaaaggcgaaagtaatagtacctatttcatagttttgttaagaggatcaaatgagatagggcctctaaagcacttagccagtcctgggcacagaatagtgtgcttagtaaatattgtgcctattagtgataatcagaattctcagacaatgtaaagtaaaaaccacctgaaagatttcttaggagctacagcttcatagagatgtgaagttgtaaacctcccagagcccaagtggacaaagaattgttacagcagctggagagacaggagacccagagaagcttaactcctgtagcaaagtcacccagcattctggcttggggtgggcagggatggggaatcagagctggctttcagtctggtgctctctggtgctttgatagtgattccttcagcaaatagctatgggcaaacagcattgatgcacagctgaggtcatatgggcctgtcttctggaagcttctgttctgatagggaaaatgaaatttctacatgatcatgatgagaggtaaaataaaatcacatgttctattagaagggtaaagtcatcgggtattcactcattcaagggggctctgtgccaggctgtggagcagtgggtctcattcgggggcgatcttgtgtctcaggggacactgggccatgtcaggagacatttttggttgtctcagctggggaggtgctgctggcatctagtgggtaaaggccatggatgctgctaaacatcctaccgcacaaggcagcccccggaaccacacaccagctggcccctgatgtccatgtgccgagggttgagatccctgtcttgggaagcagcagtggccaagcagatggagcccctgcccgtttgaagcatagagcgtggtaggtgagcagacgttacagaaatgattgcctagatatggatttatttgtaatgtgagctatgaaggaaaaggtagcgggaagaaagagggatgcgagcccttctactcttttaagggagggcctttggggaggtctttccagctgagggcacagcccaggcaaaggctcagaggcagaaagtgcaggagtgtgttgtgggtggggaggctaccaggcacctggtgtgtgcccggggagaagtcagaaaaaggcctggcctcggggggcccaggaagtggcttccagaggtggggagaaggcaaaagagaggactaaaccctttagtctgtttgagggaactccagcccccagcatgttgctctctgggggatccagcagggccaggtgggcagtgggagcaccctagccccaggtgctaccttccagcctggggccaagccttttccctttctctcatttgcagctttctgataggtgggaaagagaagcaggaaaaaagagcagaggaaaaacaatattttcatttcaaacacagataggggtgagggaggcgggaagtaatctggtttatgatacctttgagacaagcacagaaaatccccaccgtggcccgaaatagcactaaaacagacgttttgccaaatcagacttaattgagtggctctcttcttgactccagcaggatgtggctggagctggctttgttcccttggggtgacactgtcccctggggcccctgccctggctaattaaacaaagaggacctggtctcctaggcaggacaggagcctggggagctgaacttgacagcccttggcctctgcctgagagggccagaaatggttacaggggttgggaaggtggggggttcctgacaggagggccaactgagtgaaagcattggtgggagaggcctggttcctctaatatgtgaatatctgtctctttggatgctgaaagggatggagaaaagccagcattgagtgcctactattgtgccaggcattgggtggtcctcgctaagtcttattaactgccctatatccattatcaaggaaactgaagcacagagaggttaagtgatctgcctgaggtcacacagcaaccaagtggcagagctaggattagaaatcacatccgcaggctccaaagccaggccctgcctgctgcttacccccttccccatgttagtcactcatccattcgggagctaattcctggctatgaaataatattgtgaccttgtgggaagtgaaggcttgcagtcagacagccatgagcttggcttctgaccaaagcagtttttcttttcatggttttctccctcagaacctcctctttcctcatctatcaagtgggcataatcatgcctttatcctggagttgctgtaagggttaaattcagcacagaaagggatggaaggggaaggaggaggtccttgggccacccagcttggcagggtgcaataaaagagtcctaggtagagggagccaggcaagattgcaatatctctgtgcctatcagtgttgggtttctttatttgaaaggggagagagggcagactccactctgcaggtagagaaggtggtgtggaatgcgggtatttatttttctttgcctgtgaaagccctgttttcgctcaggctgtgtagggcttcccgacactgccatgggtgcgcacatctgcacactctggggtgcctgccatgcagaggcatctgcccagggtgggcactgagggcatccaccatgtgacgcccccgtgcagcctgtaagctctcatcacagtgcctgggatacctgggagtccccagaaagagtgaggatgggtgagggccatgaaaccagggcatcattcctccacctcctctgatcaggccctcctggtcccattcatctccttatctcctggcagccagtgggttgctgggaaggcaggggcagccttcctgattgacaaacaaaacaagcttgatcacaaaaggagaggggagactggctgggcctctccagctcccctccccgtgccccaggcatctttcttgctccacccaactggcaccctacattctaagatgctgcgagggggctccaaagccattgtcgaaggtcaggccacccaggctaggagccccttgcactggggaggtggattcaaggagtgatggggttgccatgaggcggcgcttgctgcaatggccgcccctccttcccttcagctggctgggcaggcagcttggagaggaagccaggcggcaggtagctgagaaagacatcggatccagggggagcagcagagaaagcaaacaaacagggctttgtgtggctgcagattggcggctcagaagggaagccaggcctgtggtagggggaagggagaggaaggaacgggagaccaggccattgctctgggccagagatcggcggctggaccagcccgggctgggcggccgggaagtagcgagtgccactacgtgtggacaggcatctggagtcacagcctggccgagtcccagctctgccacttcactccttaacagatctgggcttgtttgcccacctaatctgggcagtcattcacacgtaggactcgctggcttaggaggagagtcacctgtcctggcccagtcagtgtctgctctcatcctacccttgtcccgtcattgctggcaggacacagaatcaaagggattcagggtctcctgggagctgctagccttgccgggtctcctgggagggcagcgacttctgcttagatctgtgggcactttggagtctttgaccggggaggcagccgtgctgaggggaaacgggttctctgcccaataacggatgcctggggtgtaggtgggcagaggctggcatcaggcctgaggaaccaaactgccccctcctcgtcgcggtggagacgcacgaggtgcggggaggaacatagccaggaagacgggccttcctgtggggagggaggggcatcttttctggggtgtgagtcacattctggatcccagcgagggcagcccccaacctggcccacctctcagagggctgggagggcccgggcctcgaggaaaggcataggtaggagctgtcaggccagacgcccgggcagctccacgctcgcctccgaggccatttcctttcctctctccccgacctcgagaaggggcggcgagagggcaaatgcccgcgcttcctgccggtcccgcccctccccgcccgcggcgcccaccatcttggccgcgccggagcctcctccgcggtggcgtcccacaggccgcggtcggggcccgcgacgccgacgccgggagggggcccgggaccttcggggcgctgaggccaggcggggggcgaggcggggcgggccgctcgcgtcgccatggcagcgcccggcccggcatgcttcgcggggccgcggggcggggcggggtgctgaggccccgccccctggcggatcccgggtctttttccgggaacgcgggggcttccagtcccagcgttgcggccggcgcttgcgggttaccgggccaggcggcgcgcatctctgggcctcgttctcccactccctggatgtttggggataatgaaagagagtctgtgcgggttagcctcgggacgggctctgcttaccgagcccggcaaccccacggcaggggcctcgggaagccgcttccgagggccaggataatggggagactggacccctaccgcttgggggctattaaaagtggaggccaggcggcctctcagctgcagtctctgggtctcgagctcttccccggaactgtccatgggtcagtgaggacctaccctttgccctagggcaggagaaagaagggggccgggactgcacacctcacccggtccaggcctggaccctgcaacctcggccggcctccctccagcccaggagcacaggcctcccctagttggcagtcgttggactgtctggctgggaggcacattcctacctcctgagctcgggcaccccgcctgccctgggggagcctcttccagaactttgctgccaacactgccctgtccccacccggccttctcgtgccctaagtccctagttactactccacagccgccttctttcccctggtctttctctctctctttttttttttttgagctagagtctccctttgtcgcccaggctgtagtgcagtggcgtaatctccgctcactgcaacctccggttcccaagttcaagcgattctcctgcctcagcctcccgagtagctgagattacaggcacttaccacggctaatttttttgtatttttagtagagacgaggtttcacctcgttggccaggctggttccaaactcctgacctcaagtaatcctcccaccttcgcctccctaagtactgggattgcaggtgtgagccactatgcccggcctcccctagtctcttaagaggcaccgattcagctaccctttgtcacctcctacctgtactgagtaggcagctaaattgaatgtcggcctttgggtctccgaagggaggctgtatgctggttgagaggctgtcctcgcgcctttctccctcctcacccagggcacatgcacaaagaggctgagaatcggctacagttgcagcagaagagactcagggttgccatcggaaagaacttcccagtcctaagcattttgttcttagtgaaattgtcagattattgatatgttggttgtagagatatccaaaaatacaagaaaaaagtaaaaactttataattccaccagcagtatataactactgtcaacatactttctgtagatgtatgataaaccacttatgatacatctacggagtcatgctgtatatttggttttgtaaggcacttggtggttttaatagcttttttctcactataaaaggaggacaggcttattatagacttttggaaaatatgacaaattaaaaaaaaattcacccgtactctcagtctccaaaggcagccacagttgtcttccctcaacccccccaccacccgttcatggggtttttcgctttgtgttttttgtctgtttaggtatgccatcattacttctgtatatagcagttgatattccgcttttcttacttaatgctgtttaagatgctcctgaaccacgttcttgggagaacttccgagatgaggcagacatttctgggggtgatttgttggactggctgttcactttctgagtttgtcctctccctacctgtagccccccgacagagcccttctccattgccagtaaccaatgatatgcagcttgggtcagggggtcctgcttgctgggggcccaggaggctgcctagtgtggacagggacatgcaagactcatggcccgatgctgagatctgggctccaatagtaaggggctttactctggcccagatatgccaggtttcagggaggtctcagaccttggcctcatcctcattcggggcctcctttgcctgggcacactcagacccgaggccccttgtcgatcctgtgacccaccttctgctttgacttcctaggagttggtttctgctgcccttggctcctcagcccctcttctctagcctctctctggaggcatgcaggcttggcaccagcacagcctccctctgcccagctgccccttggccctagctacaagctgcccttgccctgacctatccctactgccaggcctgtctcttctcccctattccagaacggttcaattctaacacatccaagccctgcgtgaaacaggccttgggaaatcacagttgccagggacggtttggcatttaaaaggcatccaaggctttggggaaaaagctgaagagacaagaggatgcagggccctgtatcagaacagcatctggatttactggatggaaaaatcacagaatgcccctttcctcgggaataacagtcctggccgaggggcagcgggtgtggcatgggcacgccatgccctgcctggccaccacctgccatcaccgctgtgtactctcagaaatgaaaagattagggaaaagattagggagggacattgtcagcctgcagccaacggcccgctctaacaggtttattcagttgtaaaatatttaagacctgtttcactttacctgtatccaggaggcagccaggctggggccgagattgatgtgctgaacatgatttatttatctggatttgctcttgtggtctgggtgttacctgggtgtggaatttaaccaaatgacaagatgggtttgcgtgtgttcctgagcttggggattgtgtgtgtgtaaaaagtgagttggggtttgtgtacatggcagggggttgctgttaggtggcttgtgtgtctgtttgtcactgggaccaacgtgtggttgtgtgtgtgtctgatttggggaaatgagctgagggtatgggtgcttacacaccaggcagtatccacagcaggtcacacgttctttgtgtgttgggggcacctctgtgtgtggccgagtagctgtttgtgtgcatgtcctgtggtgtgagacctggatctctctcacccacttttcatcagtggtggggcattgcgcactgactgagttgctggggcatctgcttttccatccggccctgggtgagcactgacaacacctgactgtcttccagtagaactgggccttcctgccctgcagtccagagactagagggagttcggtggtcaaggtggtccaggcccacagccatagccctaatgcaaagcatggctcctactccagtgcgctgctgtggggtgaccctgctcctcctccctggacctcagtttcctcttctgctgcagagggcaggcgcccaggtccctgtggctgctctcacacacgggcttctgggtggctcatggcaggcttagggcattgggctggggtttgtctcctgccactcaagagttgagtcccaccagtactcaagaacagcaaggaatgatgggaaaatccctgctttggggcccaactctggattctgggcgttgtctctgtcccccatctaggcccagccctggcccagtagtcaggaaagcggcagacaaccctgtaacagccctcggtctccccctccccccacacccctttatattgaatgtgtctgtcactactttcctaatgaggctgctgagggcccccctggggcagatacctttgcagaccggaggtgagggggtgggccagcctcagggtcaggacaggaaggggagctgagcccttcccctgcctgcacccccaggccagctcagctgtggaggcattgaggcccctctcagcccctgagccagctgtgagtgggcatgagagcttggggaggtaggaaagctcaccccaggcactgagttttctttggcgctgtgactctgtagtaataatacttccacctggtcgatatctatgtttggaggcctactgtgtgccaggcactgagatcagccatgatctggatggacacacaaaatccctgcccttgagggaggtgtggccaaaggaagaaagacattaatcaaagaatcaagtgatctgagtcgtgcattcatgcatgggaatgccggctgatcacaagccaagacagaggccaggcagagcttctctgatggagacagggagtcctgtgcttagactgggggctgatccaggcactgggtaaaggctcagccgggattgaaggaatcaggagacccagattcttgctgtgtggcctcaggcaactgcccaccttctctgggctcctagaggctggtggcttccttctggctcccgtcacctctgagtggaactcaggcagtatatgtctcctcttcagtgctttttgcgctccctgccagggccctcaagacatctgtcggcaacatccttgactttggaatgctggaggcactgccccaggggacgcctggagccaagcacagcaccgctgcctcaggccccacctgccagttcctctgggcccttttgctctcacagagccacctggatcgaagaaagcctggaaaacattaaattgaagaattagtcccctattttgccccaaaattgcagagaaaagcatttattcatgcattcactcattcatttgcttgactagtgtttcctgaacacctagtaattgctgggcacactgcactccatgttggactgagatggcaaagtggtggtcctcctgccacgtcctgaccacagacctgttttgaaagcccatccattgtcggggggccgggggggggggaatcaaatgaattgccagtgagtaatcgttgagtgacttcatttccaatttccagtttacatttcttctggattattctaccctgcttcccccggccacagttggtggagatggctactgtctgccgggtaggatggcccacccagcccaccagctggtcacggtcccatcccccaccactccaccccaccctgtgcctctcctggtcatgtcacacatgatagtgtggcttcctagttatgagcccagcctcaggagccagactgtcgaggttcaaagctcactgtggcttgtgggaccttgggtgtccccctccaagcctcagattcctcttgtgtaaaatgggatcacaagagcaagtatccactactcctggggctcttggggagattaagtgagaaaatttatgctaaatccttaaaactcacataagccttggctgctatcgttgttgaataaatgaaccacttgcaggctgagaccggggctgtgtgtcacatggcacctctaggcctcagtttcctcagctgcttctttgggaaagcacatctgctctctaggttgggcctcctccctcgtccttcaaagacctattcttggggcctgggccctgtgaaacctctggctctcggacgcagcctggaacccctgagacgaggtcaagctccgcggcccgcctcctgtcgcccggccccaggcgggactgccttggcaggactcgggccgcgagctggaggcgcggctcccggctcggggctccagcggccgcgccccgccgcccctcggcgttcgcgcgcagcccctgcgggggtggccgccatcaaagcgtcttctcgttcttatgctaatgagccccattaaagcttaatggctgcgaacgcgcgggtttaattgcacctgcccgggcctgaggcgcggccggccgcggaagcagctgcgcgccggccgggacggccttaattacctggaaaacgacgcccggcggggaggggaggggatgggagagaagaggagagcagcggggcctccgcgaggccgggcctcgtccgccgaggccgcagtccggcccctctcgtcctcggggcgcggcgcgttcgtttcattaatttatcgccctgcctcggcggagatccgctcgcccgctccccggcgttcaaccgcgccggcttcgtgctcccccgcgccgtcccccggccatcttgggcttggcattcaaggcccttcgggaccgctgctgccactgacccagtgccaccctgctctgcacgaacaataataatggtggttgcacattacgtgccaggcgctcttgagggttgaatgtgacctcgcagagaccccagatgcctcatctcggccttactcccctcgtctttagaagctggtacctctgcctgcaacaaagacccctctccctcctcgctcatcctccctgaaacccacccctgcgcctccaacaagatgagcccctgtcctcctgggatgggattggggatgggtctgggccctttgttgaggggtgggctagcccatggtgaaggttgtctgggtgtgtcctccctctggactgacatttcactgaggccagtctgcctgactgccctatctctgcatgcccctgccatctccctggggatggccctggggttgtgggggctgcactgctgccctgagccttctgcctaggcagggggctgtgagactgatgggaacctcagggaaaccttgagacctaatggtattctctgtgggacttccctgtgctcctccccaccccatcaagtgatcctgggataggcgcctgcccctcctctctccctcattcccttctctcactcttctctttttgcagagggaaggaaaacggaagagggaatagacagaccgctcatgcagtttttagatggtcccctttccctcccctctctcttccatgtccccttgtacccagcccctcttttttctttctttgaagaccgcatcttgctttgttgcccaggctggagtgcagtggtgcgatcatggctcactgtagccctcaacccgtgggctcaaacaaccctcccacctcagcctcccaagtagctgagactacaaggtgtgcaccaccatgcctggttgcccctcctttctgccccttccagtcccatccctcctccctttgtgcgtctcagagaccaaagcctgaagcattgcacagtgcccactgggaggccacccagccctggtcctgcctgtgtcaggcaatgctgagagcacagaggggagtcagacttgggctctgccctccaaggactccagtcggggaggcagcgctcgaaaggaatacttgtcctctaatggaaaaaggaccaatttaaaggaagcagagaacagtctttgagctcaaactgggaaggctgggagaggcttctaagctcagcctggaaggaaggataagtgtgagctaattggcaggaatagcattccaggtagggaaacaattggagttcagccctggctagggcagaacactggctgacatgaggggagagggagtaagggacaaccacagaaaaactgagctcactccaaagtgtggaggcatgaggctggagaggtgggcagagggtcctctgttgcctagcaaccttcactgcctccctattgccaagaggaccaaattcagacccttcagttggcacaaaagcttgtaccacccacctcatcccaggatgcagcctattatcttcagctgggttcctcactaccaggccaagcctcggatgatgattgtgagcctactgtatatgggaaggggggataagcagtgaccccatcagggctaatagcagtggggcctgctgcccaactccatgccccttctcccattcttgtccccagatgtccttgcagacaaaatggaggtgaatgggcaggctgccaggagcgtcaggtggcatcacagccgggtagacagtcgtcactgattaatgaggtggtagaaacctagagggaggtccctactggcatgcctcggggttctgcccttgctctggtcaaggcaaggaatgaggctcacaggggtttagcacctccctgccaggctatgtgaaactcttggtatccagtagtttatcaccagccatgaggtggcttctcttaatatctcattttgcagatgcagacactgaggccagtcggggtgaggagtgagctcaaagtcactcatctccgaggtggcaaaattaagcctcaaacccagggctgtgtgacttcaaagcctgtgtttgtaactgcggagctgtgcggcatcagtaatgcatctgctgctgctgccagacgtgaggaggtggggccctgcctttcaacttcatctctctgacagtggttagcactgtactttacgtgtagtaagtgctcaataaatgcttgtggactggatgattggggcagtaagcagtgagcagggctcagaagcagtggagaggctccatcactcttcctcccaacctgcacctccacccccaggagttggacagcggctgtaaggggacttggagactcaaggcttccaggcagggagtgggctcacaggaggctagggaggatccaacttcctgtccaggtcagggtcaggaggacagccgcgccccctactgccccgctgggaggccaggctgacgtaggaaggctgcactgcaagtcagaatcatcagcaaaacctggggaatagagcgtgtgagggtttccatgcagggtggggactgctttctgatcaagcccctaggccaaaaacctttggaagggactctctgagggcagtgcattcttgtagcgtcgggagcaggagttctcccataacctttttggggtggggacccacctgtggctctggaaaggtgttggctccggctctggggctcagggggagggggccattggtgggcaaaacaagcatagtgaaaactgaggctcatagaggttaaggtcacagagcagagctgggtctgttttctttttgtttctgttttagttgcaacaggggcttgctctgtttgccgaggctggagtgcagtggtatgatcataaatcactgtagcctcgatctcctgagctcaaacgatccttccgccttggcctcccaaagtgctaagattacaggcatgagccttcatgcctagctgggactgttttcaaactccaccaaccccttttcttttgttccattccactctgcccagaaccttcgtctggcttcccagagggcccaagtccttgtcttcagaggtcctggctggggagccttagagcatggtcttccctcactccaggcttctcgggtctccctattggggactgaccgtgggagcagtgagccactgtgcaccagggcagcccggctcctcggggggtggcccaagcagtcagggcggcaggcttgatgggccagggcctggggactctgccatggtggaccattgtgcccttgcctggcttgccaggaaagtggagtgcgtgtgctcacccttgcttctgaggggccttcctgaggcagaggctgtccctggacacccagtgctgttgaggcagctggggacactcagaccatggtggacaaagacttgaagtctcgtttcagccctgcacaaggtgtgaccttggctccagcactgctccctctgggcctgtctctttctcagcagaatctgggactggccacatcatctccaggggttctagcattggacgcctgaaagtggacaacatggcagtgtgagggggctctttgtggtggggtggtcagaatggccctccatgtggggggctctttgtctccccagggcagtccttaaccaccagccagcctccccaggcacccgtgccgggcagtggggtgtgtaaaggcctggcacacacagacaggagttccgatctcaactccatcctcatgagctctgtgaccttggtgagtcccttttctgtgtagcctttaactctcatctggaacgcaggatatgcatagtcctgacatcaggacgttaccatgagtagtaagtgaaactcccacttcaggtccttcgcctggtgtccagggcatgggaggagctaatacgtggcctctgctgcttgtgttgttattggtggtggtgtttgagatgtccttagagatgttggccaaagtttccagttccccaccctcccaagcccgtggggaaattgtgcttcctggtggtttttgggtgggggggccgggggagggtcatgtgaccagttatggcccgtgaggtgtgagcagaagtgacatgtcccttctaggccagagcctttcatggccatgaggatccacagaactcactttcctctggtagaccaaagtcaaggtggcaactgctcagtgagagggagcctccctgctaccccagtggatggtagtgtgaaggataaaccaacttttgttgttgtgagcccttgagatttgagagttttgttacagcaacatggctagcacatcctgactgattcttcatcatcatcatcatcatcactcaagcctgtcccccggccaggggtccatccaggagaacaacagccatggaggagacccgtcaaaaaatagaactttattaccaatctgtttctataattgtttgactcattttctcactcatttgtttgctttatcaccaatttctttacatcatttattccttcaaaaacatttcttggctgggtgcagtgggtcacgcctgtaatccgagcactctgggagcccaaggcaggcagatcacctgaggtcaggagtttgagaccagcctggccatcatatagtgaaaccccatctctactaaaaaatacaaaaattcggtgagctgagatcgtgccattgcactccagcctgggcaacaagaacgaaactccgtctcaaaaaacaaaaacaaaaacaaaaacaaaaacgagccaggtgtggtagcacacacttgcagtcccagctacttgcaaggctgaggcaggagaatcgcttatacccagcgggcagaggttgcagtgagctgagatcgcaccactctactctggcctgggcgacagtgcaagactccctctctcaaaaaacaaacaaaaaggctgggcacggtggctcacgcctgtaatcccagcactttgagaggccgaggtgggcagatcacgaggtcaagagatggagaccatcctggccaacatggtgaaaccccctctctactaaaaatacaaaaattagctgggcatggtggcgcgtgcctgtagtcccagctactcgggaggctgaggcaggagaatctcctgaatccgggaggcagaagttgcagtgagttgagatcgcaccactgcactccagcctggcaacagagcgagactctgtctcaaaaaaaaaaaaaaaaaaaaaaaaaggcaacaaaaaccaaacgccacttgaccacctgtttcataggccctgaggtagcgcacaggccagcagggagctatggatcattctgcagagccacggtgcttgcccagaggtcagcagccctatgggatgcttggggtggggcgtcagatttgcagagctggggcgagggaaggaatggcacttgggggagtgggtctgctggagaaaggcctacaggtaacaggaagcactaggcagttgggtccggccagcagggatgggaccgtgtagtggccaagctggagggggactttggtccctgggtcatggggtgtgcagtgctctgcactgaatgatgagagggcatgcataggtgaaacaagaggccagctgctgaagggaggaagaccaggtaggcagctgggccaaggatccaggtggacaagggctggcatgggtctgaagaggaagagcagggccagggaaagcccagggctggatggccagtggttgtgagctgcaccagcagccagagggagccggggactggatgggggtggccctgtgcagtgacggggaaagtttgagggatcagagtagagttggggcacccgagcggcatccaggggagatgtccaggatgtagggtggtgaatggacaggacattgaagtgagaatcacccctcctgcccatagacaaaccattggtttgagggtggggcctgccctgggagccgggaagcacacatttcttctctgtgtgggctcaggggaaaaaaagaattgaaactcccacaggggaaaagtttttaaagattccaccattggaatgctggtcttgtgtaacaggaatgttttaatccatgcatttgaaacacagttattgagatcctactgtgagctgggctctgccctaggtgcccatgggtgagcagacagacagcgatctctgccctggtgagctccttcctgtcttagtgggagacaggcagctaatgacgagcaatctggggcatgctccttagtcctaagctactcaggaggctgaggcaggcagatcgcttgagttcaggagttcgaggccagcctgggctacatagcagaaccccgcctctacaaaaaatacataaattagctgggcatggtggtgtgtacctgtattctcagctactcaggaggctgaggtgggaagatcgcttgagccccggagtttgaatccagcctgggtaacatagcaagaccttgtctctgaaaataactaaatacttttaaaaagaagatagatgtagtgagaaaaaaaagtaggtggggaaggggctcagggatgggggagatgcgtgcagttttaaattggagtgccaggaaaggcctccctgagaaggtgacaggtgagcaaagactcgagggaggtcagtgaaccttgcaatgtcaaagggaagggcattgcaggcagagggaatagcagtgcaaaggtcctgaggcaggaacgtgtttccatgttgcaagaacagcaggggagccactgtggctggaggggactgagagaggggagagggttcctggaagactgtttgtttatttgagacagggtctcactctgtcacccaggttggagtgcagtggcatgatctcagctcactgcaacctccacctcccaggctctagtggtcctcccacctcagcctcctgagtagctgggaccacagatgcgtgccaccatgccctactaattttttgtatttttggtagagacgggtttttgccatgttgcccaggctggtctcaaactcctaagctcaggcaatccacctgcctcagcttcccaaagtgctgggatcataggtgtgagccaccgtgcaggccagactctagctttcattctgagtgagctggagactgcaagaggcaggctccaagctgacttactatctcacaggctccctcaggagttgagggggccagacagagcttgaaggggagtagaaggctcctggaggctctggcagacctcagaagctgcagccacatcgaccaagctgaccccacccaccatctccaaggaatgggttaatgggcaccccaggcctctcaggtctctgcctctgccttgctcctcctccttcctcctgctgccaccctctgatggtgcttcagcctgtgccatttttctgggtcctctccaagtgtatattgaccctgaggtggcagcaggaggggaggcaggccccctccccaggaggagacccccttgatgaactctgagaagctggttgcttagcaagcccttttttctccaacaatacttgtgctaatcagcctagattgaatgagcaaggaattggcttttgcaccttcctgtcctctcttctcatatatatatatacacacacacacacacatatatatatatgtacatttttttcccttagagacagagtctcactatgttgcccaatctggattcaaagtcctaggctcaagcaatcctcctaccttagcttcctgagtagctggaactacaggtgtgtgctagagtgcctggctagggactccattctagaatcatggaatcttaggggtcccctgggttgcatcttgactcagtgagtgagtgggttactttttcacatccctccttgtacacctcctgtgactcctggcagctcactctctttctagcgactgagggcctctggacaaggtgagggggacagagcaatggtccagaagttagaagactgtggtcccagtcacaggctgggcaccataagtggacaccataactgacccatcctccttttgtgctcaaatgctgcagttcatccggaaacaaccaaaacattccagcttcacagctgccagggtttggagttgaaccctgtgtcccgtgctcctgccacccctgctccaggcacaaagggaacagttcgtcagtccaccacgggcctttcctatcctcagttgcagagtgggccaggacatgccgctttacagatgggaagactgaggcccagagagtggaagggaaggagaggagcccattccaggctcccggcctgggatttttcccatatgctccagcagccacccggggaccatcattatgacaatgatgactgatggagggcctagtgtgccgggcactgtgctgagagaccccaaggagggcgtagcatctgtgtccacaggaggaggctgtgaggctgagagtacctagggagagcagagctggagctggctgggctctggccatgcggctttgctgtttgctgtctgctgtttgccgtatcaaggggcgatactcaggcgggctcctctcagtctctcttctttggtctcacctctactcagaaaagccctttgctggcccccaaatactcctaccccgactctcttctccacccctccaggctcccaaggcccctgcctgcctcggcctccctgctgggttgaccacagtcagtcctggctggaagctgaccctctccacagctgccccaaaatacatgtcacagtggggcatttgcagttccagcctgggcagctgcccactaggtctctttccttcccttccctgggtctgcccccaggcccctggcctcattctggtcctgagctcccttctctgggccaaggagctgctgggcctcggggagggggaaccccagcactaggtccaaagtgatgtagcagggccactgtctgtgccggggcctggagctttcctctgaaccttaaggggcccccagatcagctccgtgcgggcctggggtgcagcttccagaatcttggaaacctgtttttcatggagccagatagaatgagcacccaggaggaggcagttccaagagctggtgcttcaggaggaaacctgcacagcagacaggcgtgcgcacattcctagatgctagccctgtggcggcgcacctcacgctcattcacagtacacggacatgctcacctgcccaccatgggtggtcaacccttggacacccacactcttctcacaccctcacacacacactctgcaccactcgcctagccccggccacgctcatgtcaggattctgaagacctcgagcacacacagacacgcacctggtcacgtgcactttcacacatacacttggcaccagggtggcagcagcggaggtgactgagaagcctgcttttcacagagaatcagaacccagcgggggctttagccacaaaaaaagagcatttcaaggagaagggctgcctgcatgccaagcacacgcccctcacctacccaggaccccttgtgggagctgagccccatggagaccccggggtacccatcccaccctccaacatccatccctacgtggatatacggccacagttgcagctgcggccatgaggaggggtttttgctcctttttagcagtgctccatcccccaccccagagtacagggggctgcccagagaccctcctggccctgggggcctgtgagtcagaggctgccagtggtggcctttcggctgttgctggggaaatggcagcacagtggccaccaagactaggactccctggggaggccctgctggccctggcactggtggcttggcctcacccagccccacctggcagatgtgccccttgtggctacccaaggactggccccctcctcatttcagaggtggagaaactgaggtaaaaaagtggagacagccagggcacccctcccacaaggccctgcctcatttgagacagagccctctgggaagcctgtgcattctgtaggtggggacctttggggccattttttccagaggcccagagagggccgtcttcttgcccaaggtcacacagcaagttcatggcataagctagccagcctcgtactccagagctctcctgagggcccccatgtgtctgtgcgggggtgttgatggggggcaggtgggagggaggaggtaaggctgatttgtttcccagcctcctccccctcccctgctcccttctctccctcacacggtttgtttggagaatgactcacaggaatgcagcaaaatcctgatggatgggaaggcagggccgcagtacccggaaaacctctccagggtagggaggcggggctgagccttggggcctgagaggctggtgataggggagccctgcatgcaggtggggcgactgaggccctggaagaactctggtcacgtcctggctgggggttgtccctcctcgacagaaacacacaggccctggctgccgcagcacccctggagcacccgtcccccatgatttccatctttgtgtccccgaggcatctggtgcactgtagctgacaaacacatgcattttggcactgagtgtgacccaagtcagaccctcctgtgtgtgccctgtcccccaggtcctcccagctccccggagttggggggcgggtgcttgccattcagtcctttcagaggcagccaagggcctacggcatgctggacactgccaggggctggggaggctgggatggagctggagggaagtgggaggtgtacacgggatggacacctcctgtgtatgttccaaatgtgctggaggcctcaacaggtcttggtacaaggtgaggcaaaccttagaggacctaggatgaagtttcacgtaaaggaacagtggctgtaagggctcccagaaagtgtagggaccctgggaaggtcccagtctttgaataaaggtgggtgggaccttattggtagcttggggcattagggcccagatatcaggcagcagcatgaggtgaggcccgggctctgtcccagggcaagccctcctcctgcgcaccacatctggggcctccgaggagggacaaagcattcaactcccgggacctgtgggtgggaatgtccccaggcccagccctttagtgcctgctgatggctgtcacgcggtgtccggccctgatgaccagatatgtgttttcaagagaagctggaatttggatttttatgtgaactctcctgattctcaaatgctggctccgttaacaaaaggcacagtgtggtttaaaccacacatgtccgcaggcagaggaccaccagtttctaatgtctgcgctgtggggcgcttgggtttttgcatttggttcttttacattccttattttattggaaacagcccaaatagtcactgagctgcaactctgtgctaggtgccggggctctatcagcgaataaaacaacatgtgacggagctgccattttagtgggagaagacagtgaataaacatatatcaggtgatatgtgttaggaagcaaatggaagcagggctccagaacagagagcggctgcaaggccaagcccacatttgggtggaaggggcagctagtgcaaaggccctgaggtggggctatgctaggtgtgttagaggcctgtgtggctgcagcgggagtgggtggggaagtgggaggaggtgaggtcagaaggtagcataggtcaaatggcataggagactgtgggctgtggtataagcttggttttaagtcttatgtgaggtgggagccatggaggattcctagggagggagggtcaggatcagacttggtttaacaggctctgtctgggtgttgtaatggctgagtggggcaaggatgggcctaggaggcccagaaggggctattgcacttgtctggctgagtgatgatgcggcctgaacaggaagggggtagtcaccagagggtgacctgaggaaactgtggtcaagcctctccatggtgtaaacagtaaacacgatactgattctaaggacttggtagtaacatggaaatggtgactgtgtataatgctatgtgaaaataggattagaaaattgtacattaaaaacacaccagcccagatgcaaaaggctgcagatcatatgattccattcatacgaaatgcccaggacaggcgaatccagagagacagacaggaggtgagcaattgccaggggctgggggtggggaaatggggggtgactgcctatgggaacaggtttctttttgggagggggatgaaaatgttctgaaattaggtagcagtgatagttgcacaacttcatgaatataccaaaaccctgagttgtcccctttaaaagggtgaattttatagtgagtgaattatacctcaaaaaaaaaattttttttaaggcatgtccagatttctaaccaaaattggatgcacatagaaaacattgcaaggagctgggcgtgatggtgcctgtggtccccactgcttgggaggccaaggcaggtgaatcacctaagcccaggagttcaagactagagcctgggtgatatagtgagatcctgtctctaaataataataataggccagctgcagtggctcatgcctgtaatcccagtactttgggaggccgaggtgcacggatcacctgaggtcaggggttcgagaccagcctggccaacatggtaaaaccccatctctactgaaaatacaaaaatttagctgggcgtggtgatacacgcctgtagtcccagctactcaagaggctgaggcaggagaatcgcttgaacccaggaggtggaggttgcagtgagccaagatcttgctactgtactgcagcctgggcaacgagagcaaaactccatctcaaaaaataaataaataataaaattttaaaaagattgtaaggaaatattcacagtaattgtcatagggtgaaggggattctggattttgtttgttttctgtgtacttttcaatttttaaaacttaaaagtaggcatttctctctaaaatcataaagactttgtgactagggccagagatgggggatccacttggaggggctcagcctctctctccagctcttgtggatccattcagctgcatggctttcacttgggaggttgggagcaggagcttgctctggtccgcgtctctgaccttctggaattccattcctgctcacatggccttggtcaagtcacaggaccagagatcccagcggccctcccctggagagtgtcccagccgcccacgatgcctccacccagaggctgccctgttctgcttgcatgccttcagccgcaggttgctcaccacctcccgagcagctccctccttccatttctgggcagccctgcctgctagcaagctcttccttatatggaggtgaaatctgtcttcctgttgcttcctcagctccctctctgaaccccagtttctgggtctgcagaagggggctcccaggcctctccctgcctaccttggccactgggaggttctgaagagactggaggaccagcagcccagagcctgtgtcggtggtcattcagctctcgggacaaagcgtgggtgggcctgtgccctggtggcataaccaagtaggatttccacattcagtgtctaggccatcgctgtgaaattggaatttgatactaatcctggagattgaaaactcaaacctctccataggccaggagggaatgataatcatcagtgctaacatttacggagggcttgtggcgtggccaactctgagtgacgtttatgcactcatttctatttatcaccagcaaatcccgggccctgctgttcttccccattttaaaggtgaaaaacctgaggctcagaaacgtaacgggaagcagctgggtgcgagcctcctggcacacattgtgggagtgctgtgggtcgaataaggaagctgagcagcaggcagcctctcccctgcagaagggcacagaagcaggactggaaggaaatcctggttgtgggctgagctcgggccatccacttgtcgtggtgggtgaagggtctggtccgcaggtctgctctccaagctgcctcgttgcaggtgctgactttgggaggattctccttgtctcggcctaggagctttcttgctcagcttggggagagaggtagtaatgtcgccttccacctcatggacttcccagtttagaatgctgcttcccatcccacccacatcaccctctgttaggtaagcaggagcagaaatgcagtccttcatctcagctctggaaacgggttcagagagggtgtagaactgcccaggggcacacagccaggacaggcccaagccaggaattgcactgggggtgagcaggggatggctttcctggcttaaggtatgtgggaggccaagagccatcatttttcccaatcctctcctggagagccaggggacatctgaagccaggggctctgcctgtttcctctgcactgtccctgtgctgggctgctctgagctgggcactggtgtggaaggtaaataagcagccccatgacaagctgtgagaccgggcagtggtttgggctccacccaggcccatgcctctctcttctgcttgcagagcctcagtgtctgcatctctcaaatgggctaaggacactcacctcagaggatggctgagaggattccatgtggggtgcttggcagagttagctccagctctgcatgccaccccctcccatggtgcagccacctgggttccaccagggcattctgggatgacaccagaccgggaggagaagtgcgaggagtggtgtggtcattggcgtctttcctctgcctctgcctcccccggccccttccattcacatggtagaaattcagatagcacagcagcaagtgtccctcccgctcctgaccttccagcagtttcttctccatccttccaggagtgatctccacagattcagatgccccccggaaagggctttccattcaaagtttcccctggactcattctggccccagagaggctgtgcccgatccgatcctcgcccctttgcgggtgtgaacttggaggctgtgagagggccaagttgcccctgggaatcgtacatattctgttccacatcctcctcctgttgtccgttccgtgccctcctatgtcaggagtggaggagtgctggaaggctgtgcaacacactgttacccattttgcagatgacaaactatggcggggggaatgggtttcccttagcagagagggaattgtccaagtcatgccaaagacttaagggcatgtcatagccagcttgagtccaggcaggagctgtagccaccagtcgggacaaagtcaggggacttgagaggtcttcacccagctgcggccaggagaaggcctggaaggagcatccctgctgccatcaagtccagggagggcagaagcccatggagctctgagctgagttgggaagtggctggaggggtcacttgtggggtggttaagccacccagagatacccatgagccctggggccagggaacaaaagatgtgtgaaggcaggtgactgacacttgggtgtgtgtggacttctacatagagaaatctccgtgttcttgcatgtgcatgtgtcatttatatgtatacatgtgtatatgtgtatacatctctgcatgtagctgtgtgtgtatgtctatatgattgcatgagtgtgtgtacacacagatgtatatgcccatgtttctggatgtgtgtgcccagcctgagggggggacagggttctgtacgtgtgtgtgtacacgtgtctgtgtgcatgtgtatgtggttttgtgtcttttcatgtgtgtggtgcctgtgtgtctgagtgcacattgtatggagggtctgggggctgcgtatgaggtaactgtgtgattctgtctgactctgggtgtgttttgtgttgggtgtgtctacgtgtgtgtctggcccacatgtgtctggcccacatatgctggcccagggcaggatggaggggcctcctgtgtggtgctgctggactctgttgtggtcaccacggccccgtgggcttagcgtggggcactggtggggctgatgttgccacttaacctcagggtgggatggcatggagcaggcccatcccgatgtccctgggtggcctggtggaatgtgcccacgggatgcccaccactgggggaccccaccagcgttggggctgaggcttaggctgtagcaggctaagaggtccgtctatagcagtggctagatgtctgtggctggggcctgtgcctgaggtcagaagtccatttgtggaagaggctgggagtcagtctgttgctgggattggggagggatcacagggaccagggtcaagagtcagaatgtggctgctgccatggctaagggtcagtctgtggctgcagttgcagatcagtctgtatggcacagaagacaggttaggcctcagccacaccactgtccccagccccttggtggcttcctggcccaggggtaagtttgagccctgggaacaaggggcagagagaagaaagcgcctgtgagtcctgctaccaagcaggcctgggcccagctgttcccatggccatggcagagaaccccagccagcccaacgtgtccagagtgtgtggcttcattgtagccaggaaccaagggtgcccaggaccgtgccagggtgagcagggcagtgcttcccaagtgagactgagagaagacccctgcctgcctctcagtgcatttcctcaggcaccctctggtgcctaaccctgtggctctataaccctccttctctcttctcctacccttctttcccctctcctttatctgctgtcatcctccccactccccaatctgtcttcctttgcagctgccctgtcctctctttcccccagccagcctcctgccccccacctgggccctctgaaccccagggccttgcctcttttaagttcagcagatttgacttcactcagacgctggcgctgaggaaggaagatgaatacccatagtctggatgccccaggagaaggaggctgcatggaggcccagtcacacgcctgcaggcgggggccgtcttcctggagcccatgtccagtgaagggtccacagcaggggtcaaggggggcttagactcggattctgccctgtttgagcctgaagctgcactgacctcatgggatggcctcctgcagtcaagtagggaaggatggacagacacacagatgacagggaaaactacagacagaaaagatcaaaggtcgttcagatcaaaagcaggcagaagacgcctcggtcttggcccagcaccagcattcctgtgcagaccccagcccagggcagagactgagatgtactccctctcccctctccccctgcttcccctggtcgggaggtggccaccaaggcaagccttctgccgtcactccagccagaacctgcatgggtcggggtgggtgggccagattagcctccatcctggaatcaggggagttgggacactgaggggacattcaaatgtttggaacatttgaaaatgttccaaaaatgtaagagaacttggatctctgtactcccgatgctctccacccccatcagctaaaatatcaagctctttgctttcaaagaaaagcattttctcgagtgttttgctctcagtttcacatggtagccccagcttgctcaggaagtgcttggcgttagagggttttgatggggagaaaagggaacagggctgtagttgttgaaggaccatgccagccccatgtgggcagggatgcctgttctgttccctgctgtcccacagtgccctgaacaacgcctggaacatggtgggttccataaacgtataccaaaggagatatgtgtgggcagttggtctgggagacaaaaccggatccatgggggcaggagggctggcagctgcagacctggatcaacatgctcataaaaaggggatattaaggctgggaaactgggaaggtgactggggtagatgaccccctgctgactcagacagggcacagctcctggtacagtcattaaaaatggggcctcttcagcagttttctaagctaccacattggcatgaagggcattaatgtgttggagcaggtacagtggaggctgaggaggggcagggttccttcctgaggcatttgctctcccaccagccccactagcatgaatggcagatcccagcagccgtatccatccttcttgcaagttgctcaggcaagatacatcagtgaatcctgctaaccctgccttcataataaatccaaaatccgaccccttctcatcggccccaccctggccaggcctcatcattgcccacctggactagtgtaggatgcaggcttctgtgctcctgccctggccccacatctgccctcttcacagggagaaactctgaccacccaagggaaagcgtgtcccatccctgctcaaaacactgcagaaatgcctcatctcgttcagtctaagagccaaagtccctacaatggtgtgtgtgcaagcccctgtaggtgtggccccccgtcctctctgcccacatctctttctgctcactcccctcaagccacactaacctcttggccattcctcaaaaatcccagcctggctgctgcctcagggtctttgcacttgttcttccttctgcctgcacagctttgcccccagacagctgcatgcctcactacctttgtctgtcaagtgtgttctcaaatgctcttaagtatgagctctgaccactcagtgtagaaaaacagcccctgcagatgctcccagcccgcttccttggctttatttatttttccatagcacgcttcacctaaggtaacatactacatcatttacttattcattctgtttcttgtctgtcaagactagaatgaaagctttgtctcattccttgctctgaatcctcaacacatagaatggagcctggcatctagtaggtgctcagtaaatatgtaccaagccaatggatgcatacttttgccaccttcaagttacgtgactgggagcaagtgcatttcctggacctcagtgatccagtctctcaaatgaggctgactgatggggcggggggagatacatagagatttgaagttgctgccccactactcaataaacatgtggaatagatgttaaaacctggcccacatctgacctcaggcctgcaggcttccagcgtgaggcttaccagaccagggctgagcttgaatgcgacttctgggtcttagtgtaccagcctggcctgatgggcctccccgtcccttgtttccacctgggtgtccctggtggcctgtcagtgagccttgtccttggctggctccactgcctgcattccctaggaccctgcttagagtccccagccctctacccaccctgcctctctggtcaacagctcctgtttactatttagctctggaatggcatctggacacacacttgcatgaaagcagctattgagatagtgcttggcaaacaaaagggctgacatgtccagacctaggttctccagaacacagcctcacctcaccaggaaggactgggccctttaaaacctgtgagcacccctaccatcccagcgaggagggaggatcctaattcccctggggcagactcttggtgaaaggtgaaatcagaacctagggagcaggaagcctgccagccaggcagcctcctctgctggtgttccagcaacatttgtgggtgctgggtgctggttgctggcaccatgatcccatggaatcctgccagtagggtctgatggagtaagcaaggctttggggtccatgcacacttaggtttgaattgtgaggttgccactccattctgctgcactgccacacgccatgcactgtgcttggtggaggtgagcaaagaatcttgaaattgagagtcggatgggatccgattgtgttgctgtggtcttggcaagttctttgcaggctctcagcctgggtttctcctctaggggatggtcagatcctgaccttggggtactgtcttgtgactctccatgataccacttgtggaagggccctggccaggtcagggtttccatcaccctctggcagatgtgaatggcagccctgctgaatcaagatccctccgtaccactgccccaggagctccagggagtccccagggagccagggaacaagagaggcccctggaacaaatgacaggctctgcccttttttgagataagccacccaccaccatcccatccctctacacccatccccagaatctggaatctgtgaagggtactcactgagcgacctggaatctgtgaagggtactcactgagcgacctggaatctgtgaagggtactcactgagcgacctcaggtgagtcttccgacatgtcctggccctgatgttctccatgctccaccccacccccattttatccaggggaactgttggctcaaagaagagaaaacttgggcttggtcaggcttatgggaggagggcttggtttaacttcattgttccatgcattcactcactcattcattgaacaagtgcttatggaatgtataccaggaaccattccaaatacggaagatacaccaaggaacaaacagacaaaaatacctaccagatacctaaatatgtaaattacatggtatattagaaggtagggaacagcattccaggcagatggatcaacaagtgcaaaggtcctaaggtgagagtgtgcctgctgaattcaggaactgcaaggggcaatgtgagtggggcaacaggctgggactgagggcaggagttggtggggacctgattgtgtgggctgtcatcaaccacctgggggactttctcctcctcatcactcagaaactgaggaggggagggaagacattccagccaggttggtgatccccagcgggcatttgggcttttccgttgccaccttaatggtatacacaatgcgcatctcctggttcactcagcagcctcaggactgagtgaccctggtccccaagacagatattgaagacagagactaagcagtctgacattttaaatatggggagccccgagtggggcggggctgcccaggaccttagggattcacttctggtagggagggctgctaccaggcttcagggaatgccagaaaaaaggtgcccgaggcccacctggcatgtaatgatgggcaggattggctgtaggatgtatagagactttagtatgggcagggttgggggttagtaggtggagaagggagattgggacatcattgagcagcaaaacccaagtgtgacaggtggtcggtgtgctcctgccagagcagaggggcctgagtaggaggaagtggaggtggaggccgaggagaatgagacagacagactcactggccagcgggagaaagtggtgggacgagccagggctgacacatctgtgtgatccctggtgcagtaactccggtagatggatggacacgtggatggatagaaaggtgggtggatgcagcgacggatggatggatgaatgaatgaatgaatgcatgcgtgggcggtgagcggccgggagaggggcgggccagctgagcgctcaatcacagccccggggctcggcgcccgccagctgcactcagaacccccctcaccgtggccctgccctgtggcgcctaattacgtgcccccagggctctggagcggctgctgggactgcagcgaagaggggcccgcgccacctccgccaggctccacgcgccggccttgagtgcgctcccctcggccgccgggaaacctagaggcgcggtttggccccaaggtccccggtcccgctcttctttgtctcggcctagttctcggctgtctccgggccgcgacccacctctcctggcggtccttgccgcatgcttctgtgctgcgccagaatcatcgagtctcagttctcgctgccttcccggccagtaggcgtctcccccagctggggagggtcccccaaaccctgtgcttctaggaccgcggggccggcaagcggcaggatctccaagctgcgtctctgatgcggctaggggaggcgcgcgatgaaggcccccctcttctccgccttctctctacgccccaccgctactacacgtcgcgctgcgccgcgaccccggcgctgcctgttggcgccttaagcggctcttctgccgcggtgcgatccccgacgccaggaggactaacccccacccgccaggcctcagaccccacgcagatccagccacacacgcaaccgcctgcagatacccaccacagccctttaagttaacccaaagccccgtacaggcgcactgcccctacatgcgcagccccacggccccacacacccaccagcccactcgcaaacaggcccacatggccacacaactgccctctggacactcagccccacgcaggcacaatcccatatacacacaaccgcacacaggcgcaatcccacccacgcagtacctcacggagtcacacaacccccctataaacaatcgcacagacacagccccacgcagcgccacatcattcagtcaaactgagacccagaaacacattcactagcttgtatccagacccccccccccaagccccgtgacattcactcgtaggacagaccagaaatatacagccacattgatacacacacggacctaaacgcacagccaagacctcacccgcaggctcgtaagtcactggaaaaatattaaagcgttccctccctcccctcctctatctttgacatacacacgcctgcgcgcgcgcgcactcttacactcacaccccccgtccctaagcgcgtcggagcctcgcagcgggtgaccccgaggccccgcggtgagagccaagggagcgtctccccggcgccccctcctcccgctcccttcccgagctcatctctcgcccccccgcccgcctcctccttccctgccccctcctcctcctcccttcccccgagtctggggcgcgggctgcgcgcagccaagccccctcatcgcgcgcccctccccgcgcgcgccccgcgccagcatcgcgcttaccgagtggatgcggccacggggccgtctctaattacctcctgacccccggcggcctgtgaataatggctactgagggcgctcgcaggggctgctaagaaggaaacgcggggcgcgagaggcgcggcgcgcgcgggagcgcgagggaaaggagcgagcctggggccgttgcaagcggctggcgagagaaaggattcgtgcgagcgctcacatttgtttctcccaag

SEQ ID NO: 112 - DNA, 2773 bp, Homo sapiens
  source 1..2773: mol_type = genomic DNA
gtgcatgtctttaataattcaatttctggtttatatttttatttctcttttttcgtgttgcctcacttagttcacatttggaaccctgtcttatgtgtgcgtgtgcacatgtatgtgtgtttgtatctctgtcttcttcaccttcttgcactaaaatgtataaaagtaacacttctatctgcctccctcctcatttattggttgtttgggggttttaattttgactgtgtgtgtgtgcgtgtgtgtgtgtttgtttttcatttatgtttttccttcaaaatgttgatctttctgctctcttgatttttttcctttgcttcagtttgcaatactctgaattcctgtgatcaggcctaagcaaaactaatgttaaattgtctaaaaactatccagtttataacactgtgttctataatgaatcaaggggccagccaatatcctctctcttgggaggccagttcgcctctttgtgcacatgataagcacgaaatagaagattctagagattgtggggagggaggaaataatccaaaactcgtgtagtttttaaatatatctaataccaagaattttggtatctaaatttttatggataaaattcttaaacagagggtatgatggctggctggcgaatgtactgtgattatgaccaagtctaccgcctggtattcaccagccctttttgataacacatcgaaggttaactggctcctttcccctttcccaattttttaaagtattaaatgtaaaagccaccattttgagtaagatgtctgcatattttgctttttttcccctcctttccaatggtttagcatttagggcccttcacttgactcactctttccatggtaactatacacaatgctggcgatggtgcccgttggcggtaagtgaacaaaagcactagagaagaagcttttaaaaatgtaattacaaaacaattaaataagaaagaaaaagtccatctgccatctcacattaacactacaaaatgtgatttgacttgttgttcctcttccttttcctttcccccttttattttcaatgctgttgagtaatgccgcctggattttggatgtacatattgttttgtagcggtctgagctgtttgattactgacttcatggtgatttttttccccttgcacatcttactcagagttactgaactccagtttggctggttttattaatgcacttcctgcccctacatccttccctacttttcctgtttcccaaacccccgtttgtagctctgactgttctttctttgcccgttacacccttcctgactttctcttttctttttccctaccttactctctttttccggatccttgttcctgtccctttccctattcttcctttcccatcccttcagttacacgcagctgttggtctcttttgctgactggtggtttctgattggttctggccatttttccttttaagtgcttggttgctttctgctccagcagctggtttcagctcttgctccattctaatccttgtctgtgagaaccttgcttttcagtttctcccctctttccaaaattgattgttttttctttcttttatttgtgtgtgtgtgttttttaactgcatgctctcagtctcatcattgttgtatcccattctttctttttaaatgtgaaacgtttatattatttggtgggcgaagctagagtaaatggagtttcaagctctttcctcatatgggggattatcactgtacaaatcttaaaagacataggaagaggttttttttttagttctaattctacctaaaattggtcttttcataacaaaaatttattaccatacaaattgaacacaatgtaaatttgaagaggcaaaaataagacatttatattttatgcttcttttttcaattggcatgttttatgacctgacaacacagtataagtcaagttctatggtggagctttaccctccttgcaagagctttgagactggttctgtcactgggctgcagtatgctgacatcttagttccattcatcttttcttcagcagcagcatctttgtaacacctacttactctagcactgagaatgctttaaaatatgcagttctgtaatgagggtggagagtaccataaaacaaaataaataaacactttattttctcaattcttttaagtgcctactttaaaggctttcttaaaagctttgttcttaaattgatagaccatgtagtctagaaaattcagaatggtcctgaaggctgtcagcaggggaatcttaggtttctatatttgtttacttacctcagacagtaaaaatctctgacagacatatttaaaatgctgaacattaggacaggtgaaatcagatttattttatcacctttccatcaatctatttcataacccatgtggcaagcctctgttttattaacagacttcaaagtgaattgctaatatagtttcctatttacttttttctgtgttttccttagtgcagagatttctctgttaaaaagatgtccaaagatcttgcaaatgtattttctttggagtactgatatttggaaaccaagaaactcactttactcttgttatcctcatttgataagaactttaattaaaatactatatattaatattttatattgctgtgttaattatttaaatcactgctctcagaaatttacattttaaactaaatactctgttattggatgtgcaactttatgttccctaatgtggtccacttcttccctgcccttttttctccttgttatttttag

SEQ ID NO: 113 - DNA, 4345 bp, Homo sapiens
  source 1..4345: mol_type = genomic DNA
gtatgttaaaagtcctgcgtcacagttacttggtgctttggtaatgatgaaaaaacacttcataaatttcaataaaatacttcctgacttgatattgtatcattattacacattttactaaataacagtaaaatccgtgcataactcatggattctattatcttccacagattttttttttttatatttagcctccagaaagctgctgcaaatgtaaggtatattttgaacaccactttcatacattaaattctaaacattgaaacttgtgtgcatgacgttgaaaagagtgtaatgataaatgcttatacttatgatgatgctaagccatttggattatattaactgcttgagacacaagttataaaatcctatgacttaaccagaaatataaattaaaaatgtgaattagggtttgatattaacttccttgaagcaaagtgtttaaaattttgtagtcctacttttgcctttctctgaccagattcttacaatatatcagctttctctttagttgcagattttatctgaatagttaacataatgtgtagcagtctggatctcagaatgccaaaataaagactttggggacagcttaatctgtgatcaatttctggctctgccatatgttaaatgtgttaatttgtgactttgaatttcagtctcctcatcagtaaaatgtggatgatgatgtttaggcataaggttgttgaatggattaaataagccttcttagataaaacactgatgtatttggcatgcagaagacagttaataaatattatcaatattagttgttttgttgttgttatttttgttaattcacatgtttttgcctttccatactgtaagtgaattcaaacaactgtcaacttcaactacttggaaaatattttcatgtaaaatgtattctatcccccttccttgccctcctattccctcctctccctatctctttacaaaccttctcccttgtaccccttcccaggtatgtgtgtgagtgtgagtgtgtgtagatgtgtcaagggagaagagaaaaggagaatgaaagcaaaagagagcaagcatacacgtccctttcttattgataattagattttctcttgagattggatagattcctggaataattcttttcctgtctgtatgcaaagatcccataatattattaataccaatacgaaaagcctgaaaatcacagccagaaaaaattcacagtgtagacgactgtgtacatcacagacaagtcagtattacaaaacccaattttcatagtgtcctatttcagtatcctaatgcaattcactgatttcaattgaatattaaactctagtacgttcttccccaacctcgcctgcgttagcttgcactccctcttccccccagctgccagtagcttgctcctccctgtccctccaggtaaatcttttgaagattgtctggccttccgctccttgccatagcaaaaccactgagaggaagctgccagtggttctgctaccgatgtcagcagcatgtctgctccctaaagcaggaagtagagaaggagacagggtaagtctaaatcaacagtcatgctttgcacttctgatagcattaagtttgagctaaataagacattacttaaaaaacctcaaatatccacaagattggacttgccaactaattaagatttggagttcaaaataaatgcacccacacctttctccatggaactatgtgacatggggttgcttaggatggaaaggatgttctaggaataagtgcaatctaggaagctgaagactgagagtgttttcgttttattatctgcagagcttttgacttgtgtatttgtgagaaataatggccaagtttttattctgtttttaatcagttatctagaatgaaaactgacttttctttattcaattgtatgtagacacattgagtgtgacatttgtcaaggttggttgttagcaatatcacatacatgcatactcaagcagacttaagatagtcctttttttttttttttttttttttggtttctgataatggtgcaaagttttcctggttgacataatctcttttcttggggatcctttcttctatgtctgattattgtttatttcacctttcctttttatgaaccaggcttgttgatccggttggcaatttttgttctccttctttttaactacagccaagtctccgttgtccagggtaatggatagcctcatgcttaatgaagcagtagtggataagcaaaaatgaaccatttgcgtttcaaatttttaaaagtgcaaaatcacatagaaatgttttctggtcacacctttgtgaaggatggtgggagggtgagttagaagcgcctgaagaatcaaggtgagccagcaaaagacacagatttactgtaagtgattctatgtggataacccatgcaggaataatggagatgtggctgcagttctctcctgaatgctttgctttgttttaaagtgtgagattccccccttttttttggaatgaataattgaatgattttattttagaacttaaacaactttgctccggttattcctactgtcaagatgagccacacctgctgaatttcattttttaaacttttctccagtttattttttttctatccagttcctgtttgcttctcgttatttgctaaatgacagctggcatggaaagaaaaaaccatattatggcagtatacagacaaaattaaattttgtagtttcttttttgttatttactgtaaataataatacctcctttttaccttcaatgtaaatataaggttatttgggagtttagaagtatttacaaaataactagtgcataataactatatttttctctgaattataaatcaaatattatttattgtttacaaagttatgtattaagggaaatggaaacaaactgggcacttgaagaatttcaatatccaaagagacaattgacaaatctatttttagtggaaattttaaaaacaataagcaataaattaatttacttaggaaaatagtattatagaattaattagtggcaaatgttgattagtagaagaaacattatcatctgtggttgtgattgtccttttatatgctggttccacctttacaaggtttagttcatagcaaactgtgccagatatggacagatgttccagttgccacaatagtattaaagtgactgactagagtcaactatgccatggatttaaaaagaagaaaccttccctctatttcagtgctaagaggtggtggccacattttggcagaacaggtaatagggtgtacagcaatgatattgacagaaaacaacaaattctgcatatttttccactcataagttgatgaagagattatcttgccaaaggaagatggtagacagtttttcacttcctaattccccaaatttctttgccaatattcaccaaatttcagtattttgggtgtgaccttaaagatctgtgcatttctgtcttctctcccaatgtttggttgaaattcttcttgacatcattgtacattttccttgaataaatgcattttaatataaaattttatgtcatgtttgatatgagagttatatatttaaatacatttaaataaatgtttaccatgaaaatgtatgaattatatgtatgtttcacctaaaatcctttgtatttttccagtaataaatgagttccactttgtgaaatgttgatttgtaacaacagtgaggactccagttccttaggctggggtattttctcttcttttatgccctctagttaaatgagaaatgtagagagatggaactttgttgtgtctaatatgcaagcctataatctaataaaatttaatttgagacttttaaactgagattggtgacactgacaaaattatctaattagaagatcaccaaaacatatctaatccaagaaactgacattcagtgtgactgattaaggttcttaggacatctcctgagatatctctgataacatatatacttcttgctctacctggaacatggatgagctttaagtgtatgcaatgcaagttctacccattagtttctagcagccttgaagataagtatcagacagtttagtgttgccaatagaatcttggaagctatgtttagccaggatacatttggaaagcttactagcctttctgtactgatcctttctatgacagcaaacccattgtaaaattttccctgttcctccagcagattaacccataatatcttttaacaactttagattttttaaattccttttaatttaaaccaaatctgcttaatagaaagtaagcagttttcatgaggattctaactttttttcttccag

SEQ ID NO: 114 - DNA, 682 bp, Homo sapiens
  source 1..682: mol_type = genomic DNA
gtgagtaactttgaaaatttgataagcgcaaaggagtgaaaatagtcatagtacaaacaaggtctttgtgtcatatattaaatgtagagctttcttgttagtcaagttaactatatggattgtgtattttaagaatacatattagaatacatattgcaatgtaaatatatccagtaaatgatcaataaatggggttatcttcatgtcatatagtctttctcttcatcaaaatgaagttattcattgactacaatttaatagcaacaactgtacttggattagttttgcaaacaaatgtgttcatattagtgaaaattacattgaaataaagcaacacgattttgtttcttaaaagcaacctttagcatatggcagcctgaggtctatagcaattccatttgttaaactcacagggctctatgtgccaaacccagcattaagtccttatttagtataaactttgccaaaactatcagtaactctgatttaattctgcaggtatgtaacagaatttgtaagcctaggcaatgtttcagcccttcgaactttcagagtcttgagagctctgaaaactatttctgtaattccaggtaagaagaaactggtgtaaggtagtaggccccttatatctccaacttttcttgtgtgttattgtgtttgtgtgtgaactcccctattacag

SEQ ID NO: 115 - DNA, 973 bp, Homo sapiens
  source 1..973: mol_type = genomic DNA
gtaagaagaaactggtgtaaggtagtaggccccttatatctccaacttttcttgtgtgttattgtgtttgtgtgtgaactcccctattacagatatgtgacagagtttgtggacctgggcaatgtctcagcgttgagaacattcagagttctccgagcactgaaaacaatttcagtcattccaggtgagagctaggttaaacaccgaggttgactttaattattgagtttgaaatcaatttatatgacttacagcattagccttgttgcttattattacagttcatcccgttaaataatgccaaatgatgtttcaatgtcagtttagctcctaaaattttataaattacatgcgtatttataaagtcagcctttgagtttaacagaaaattgcatgagacatcttcaaaaaatgctaatttgggcctcttgcgctctctctctctctttttcactaccatggctttactaacagatttggattttaccattcgctgcagatgtagttcaaaaatggatctccttttacaaaggagaaaatattattgttgaagagcatgtatatggcatgagacatgagacttacattattttaaaattcttttctcctctaaattactactgcttggaggctagagtaaagaatggattggtggaaaatggctgcatgaaacacaaaatctgaaatgaaaaataactccaagtttttttgtatgtttgttcagcatgtaaaaccacacaaacaaaacttcctgactagatatttaaaccttcatattgaatttccagcaagcacactgttcatgtgtaaaatctgctgttcatctatttcccaaatcatcaggctatccatacagctttggtgtctaaatagtcaagcaatcatttatgggggaaagagaatgtgtgtgactattaagaaatcatgatttctggcactcttcctcaggtaacctatagttctctctctgcag

SEQ ID NO: 116 - DNA, 1785 bp, Homo sapiens
  source 1..1785: mol_type = genomic DNA
gtaagttctccccttactttattggtgttctgggtgtgattctgtgtgtggagttgtactcctgggtctgtttgtaggtgtgcatttgtggacacagctgtatgaggaattaatggataaccatgtaaggccctgtgggcttatgtctatgattcttgcttgtgagggcctcttgtggttcaggcgatgataatgtgattatgtgggagaaggcaagcagaggctttacagctgggagagaaaggaggaggtgatttcccattggcactctctcgtattttattcctccttgtaacgatcacggtttgcacacctatcattacaaggcctctgtgaagacttgaaattttttagttgtaaactttcagctgaaaattagtttcctgggtatgtcttaccgtatgtaatttaataaggctggccaggagttgcagacttcagagcacattttagagtcaaaacatgagccaaggtacccacactggcacttcctgaagagttactaaccagaatttcgaactattgctcaagatcagtgtaactccacattggtatgttactgctcttgctcatttgtgttgttttagcaataaaaatgtatctttgggaaacttagctgatgatagaagagttatagcaggctttaatatttttatttccaggttgggaaagcgttttgtggtttgagagtgtagtgggggtggtgtataggttttgcatgtatgcatgatgtgtaagaaagagtgcatttaaatatgtattgatctgagcatctggtggaaagatgtatttcaactgtaaaatgtgaataaatgatatgcatcgaatacttgaaactgaaactgactttctgttatataaaggcaatgtcttactttctagcattatgaatacacattagtgttcatttaaaatttttaagtgtccttgctaggcacagagcttgtaattaaaatgagcacttaacacaatatttgctctgatcccatgatttggattttcctgagccctgcttttgtatgtcacaggccaaaacttcgtttatagacatgactacaatcatatgattacaactcctgattaagtcatatatacagacatttagtcaattttgccattgtcaactagggagttactttaatgtagatttgtttttgtggggctcctgctgcagaaatttgtctccctctcttaagaaattgttcgcaaaacctgggaacataagtctttgatacctcctggccttcctttttactaaaaaatgtgaatgggctgacagtaaagccattctgattgggatcagcacattactatgctgattaaaggagtaaatcccaaaaacctcctttctaatatacttttgaattcttcttgtccaattaaaaacaaatgttccttaaatgtttgtattttgaagcttttctttttcaaggaaaaaaaatgaaaccatagcttgtatataagaccctttcttccccccattctcaaaccctcgcccagtggtaccattacaagttaactttggtttgattctgcaggtatataacagagtttgtaaacctaggcaatgtttcagctctacgcactttcagggtactgagggctttgaaaactatttcggtaatcccaggtaagatggtccggggttggtgttaggtgttgggatagggccctgacgtgacgtattgtactttttgttttgttgtggttttgttttttcctttggtgtttgtgtttgtgtctgtgtttgtcacttgtgtctgtgtgtgacctcccttactacag

SEQ ID NO: 117 - DNA, 10720 bp, Homo sapiens
  source 1..10720: mol_type = genomic DNA
gtaagatggtccggggttggtgttaggtgttgggatagggccctgacgtgacgtattgtactttttgttttgttgtggttttgttttttcctttggtgtttgtgtttgtgtctgtgtttgtcacttgtgtctgtgtgtgacctcccttactacagatatgtgacagagtttgtggacctgggcaatgtctcagcgctgagaacattcagggttctccgagctttgaaaactatctctgtaattccaggtgagaaaatttgtacataagactgactttgccacatctcctctttctcctccattcgttttgtccaccattctaaagcagcatcagtacagttgataatggccttgcattctgcatgtttttcctgggagacattctctggaatggccgttgggtcctcaggcagttttctctgagtgcttgccaggcatgcagcccccattccatccatgctattgaaaaagcacgtgcttaagaatcacttggatctcaccatatttgaaaaaattgtcacagagctagctgtctctttgtatataaatcatttgcttcctggctccatggaattacagtaattttgacatttgccatcatttcattgcttgtgatttctaggcttcctatcgcatggtttgctgatgggacgttattcaaagaattatacatttactattactatattaatgaaattttttaatcacagaagagatctacccagttaactaatccagtatcagagacaaatttaagagacttggagttagtgaactgcacttaaataatcactgtctatcatgttctactgctgtctgtctcactagaataagaaccagtagacatctactgtacatattcagggttcattctcagacataaatcccaatgaaagcttatgcaggcactgttaaaaaaaaatcaaaggtaagataagatacaactaaaggtatgggcaacaaaaagtatagaagtttgagggggaaaaacagaatcagtaggtgagttgagagttagttgattgacaacctctttaaaatttgtgcctttttctttttggttctggttgagctagcccagtggttcttaaccttttgaaggttttggatccctttgagaatcagatgaaagttcacagaccccccccgaagcccatccatggaccccaggttaagattccttaatttaatttaaatcattgctactgggtaatacttatctttctaaagaccagtcttgaaatcttaaaggaaagatattttagttagtattgtgagcctaagatatactggcagtaacttggcagaggtgaagactgtgttgttgctctttggactttagttgtggtcatgggttttcaaggaagactccgtagagaccaggctttccacagcagtttcgtagaaataggaatgtggagaaagaacagaggcatcctattcttatcctattcctattacgtggctcttccccttgtggctgactcagaaatatctctctttttaaaatttatttttattttctagagacagggtctcactctgttgcccaggctggagtggtacgatgatggctcactgcagccttgacttccagggcccaagtgatccttccttctcagccttccaagtagctgagaccacaggtgcatgccatcacacccagctcatttttaaaaaaaaatttttttgtagagacagggtctccctatgtgttgcccaggctggctgccaactcctgggctcaagcaatcttcctgcatcagcctcccaaagtgctgggattacaggcgtgaaccactgcatctggcccagaaatatttctttttcccctttttaacattatctcaatagcagatagagagggaagcacaaagatagaatcctggagagggcagactggaatgtggtttactgagaacctcaaagaaggtaaattcatcttcaccacttacaaatttgggccatggagttggccagtaaatcagtgccctaccaaagatgaattcctatatttttagcgatggtagctgactccctatcaaccaaaggctgggtgtcagttggagtatatacttcttggcaaaaaactacaaccttaacttaccaagatttagttcctagccattttaaatctgcttaacagaaagctcagctcattctccagacagcctcagatagctcattgatggtggcctaatctttaggcaagccctgtcttattttttgaggcatctggaatgccacatctttactttcctttttcctatggtgtctctcctcctctggccccttttaaatatgatcttgtgttttctgctcacttccctcagcgtactctgcaaggcatctgtctctttatgttcctgtgatctcaaaacttctctcccagaattaaattggaaagctgtattctattcactaactagggcagcagatgctgtctctagtctagctcatagcttctgtctctgtctctgctatatggttaacttttgaccatggcatttctgcaagataactcttgattggtgtcacgttatttattctttgtatatatccttaatatgtcatgttatttatcctttatatatatatatatatctggaatatatgcagtatctaacacagtggtgcctggcccatagtagtgctccataaatgattgtagtagcagcacttatgattataaagaaacctaagccaatagaaagggtttgtatcaagatttagacatcagcttcacagtttgaaatagagtcccagattcctatttctagaagcacccccaattgagctggctttgggaggctaactggggtggaaaataacattaagggatagtaaagcgaataatagatcactgtcagtaaatggtatatttggttcttgaattaaaagtgtggctctcagtctcaatctttttgctcccgattctatgttttagagttagcaagagaaatccagtaatgaagtttccctcatgggaagttttctctcatcccatgggaaattctgaaattgctgattatgctttctcccatagagggctgttgtgctattcctacctgcctgctatgcagtctccttccaaggcgggagcaccagtgtatgagtcagtggatctgggccatctcttgcttggaagtatgtcattttgattcttgtgtggtagagctggcccatgattcccccttagtaaaaaccattgttctgtataccaagttttctcgtggatcacttcagtggaattgttgttctctttgtcttctcctcttcccagtttggttatagactactgccaagggtgccaaaaatagaatgtaagtgagagcaaccactgacctggagcctgcaaggtctcacaaagctccctgtgtatcaacttcctttatgagagcttttcctttcctagagcactcacccacccccaacctgggctgatactgtccttcctctttgtgtctttggtagatattctgagtatgtcagggccgccaggactcctgaagattggacagtaaggtgcatcagttagctctgcccttttctgtaagaaatgctttgctttacagctttcttgtagctcagaaaagaccaaacccaccttctgaccctttttactttacttgacttggatacatactatttatgctttccgttttgctccagaggcagcaacttggagaacagtgtacacaaggtctgtgctaaaagggtcggttatagaggagaccctttctaaattttctttagtctggaatttgtcaggttcaccttgacattgaaatattctgcctaaaagtttatatgtcttaaaactttgttttcactttgtatttgtctgagtcccgcataaagtgaacttctaagtgactctgtcagaagttttgtcctctgcatgctttgatcatgtgccacagggctgacatgcccaaagaaagggtgggaatctcgaaagagtttctcaggttcttcttagcagcatttaatagtataagtactaatagaactggttgagagaaactcacttgtcagtttcttttcatttctgtcatttaaatggctcccccaaagcactgcttatctgctgctcattagcacttatttaatttcattccaccttctttagaattgtactttcttgattatttttctcttggcaattttatttctcagctttcatttctgttactttcactcctaaccagtgggatcagacaggaagcagggaaaatgataggcctttctttttcccatcccagtattcacaaagaaagcattttctttaaacgtatactttgtgaatgtggcaatttctgctgcataatgatgggagatataaacggttttaagactatatcctgactcattgtctcttttaaactattctggttattctcttgcctttgtatttctccttttcccacattgcttcttaggaaagataaagtttaacagtggtcctaagtgaaaaaacactaaatgctcacaggatcccactgacccatctttgagagctagtttagttttggtcacactttgtgatgtgaatcaggtctcgagtaaataaatctagagtcccccaatctctttcaaattactgttgctctaaagaatcttcaagagctatcactgtaggctgggtgcagtggtacacacctatagtcccagctaatcaggaggctgaggcagaggatcacttgagcccaggagttcgaggctgcgttgagctgtgaccacacctgtgagtagccactgcattccaacctgggcagcatagtgcgatcttgtctcttaatgaataaataaataaatattatcatgaggattgcagttgcagcaggaaaagtcaacacagcacactactttacccctatgctttgtctgaacccaagcctaactctgggaacagggcagttgttctttccctgggttgagaactgcttgttattgctactgaggcctgtttcaatattaactttgtaggggaattagctcacattgcttcaaaccacttagatttctcaacctgagctacaaactagggaatatgaattagctttatttgtttattttatttatacatatatattttttgagacggagtttcgctgttgtcacgcaggctggagtgcaacggcctgatctcagctcactgcaaccgccacctcctgggttcaagcgattctcctgcctcagcctcctgagtagctaggattacaagcatgcgccacaacgcccagctaatttttgtatttttagtagagatggggtttcaccatgttggccaggctggtcttgaactcctgacctcaggtgatccacccaccttggcctcccaaagtgctgagattacaagtgtgagccaccgtgcctggcaaattaactttatttataatctggccatccagtggtggaagactttgaccccaatatgcttgactgatttttctggacatagcacataggcaggcattgttcatttgttcacaggattcctgggcattgtgaaacgtgacaggagattcagaagtacctttggacatagagtagaattcttcacctgcttcttaaaattccttaaatatccagctttccctcttgtcactgaccgttctctacattgaatccagctgtcttttcttggcctgtggtaaatgtattaactgtttctactcagacacgtaccaaagcgagctaatgttagccttttccaagagttctcactgtccaatttgcccccacgtggcttctgttgcacactctgttgtgtaggagtcttttgaagaagcattctgctgttttggataattggttttcagtcagtatcttgcttgttctggaatgtgatgttgtgagccaatagaataaaaagacagtgtctctgtatagccagaatgatggcattctacattctggcttgtgtcaggtcaggaattctactaacaactttttgcctttattgacaggtgttgatggtacgagggagcgctttcaggcagtcacagctggcaagactgtagagcttgagcttaggaaatgaattgatggcatcatctccataaattggcattgatgtctgcaaatatggccatttgcaatttatcctaatgcaaggaagaagagtcttggctgagaccaatgtatagttcagtgactgtttattatttaatattgctgtgtgatcatgtgccttcctttacctgaaaacatgaagccgcatcacctttcttcttctttttcctttgccttctcattttctcttggtgatctggatgggaatcttggagagtaaaccttttagattgctgtagttagtgttatttagtgattatccttgcttaattaagatttatctgaccctctgtgaagtataagcagctgaataccatttccaattaagtttctactttaaacatcttaaaagctaactcaccaatgagatgatctaagccccagacttcaaagctgaggcttgaaaaagtgtctttttagcttccttgactcatgtttacacatttctttagcaataacatctggtttatggagaagagatgttaaaccagctgattgtgagcatttgggtccatctccaggaaagtgaattccatgcaggcttgacatatcagattagtgggggtcatctctggttgcaagtagcaggacacaggaataattcagggaacccaagggctggaatgcacttgtgcttctgggaagccagtagaaaccagaatgcagagccagaaagccacaggtacaaggaagtactttgtctccatctctcttctctccacgtgtccatttctctctctcagcatactaactgcctttactgctcagtcacatcttaatataatgacagaatatggctaccacttagcttccaaatttatttattaccattctcaccacatgaaaatattactcaactgtctcttatcctgttccaaattcctgtaggaaaggatctggatttaggtcagatgtccacccagacatctgcaactactgagagaaggtgaccttgtacagacatggctgctgagagctcattcttaaggaacaggggatagttggagctcatggcctagaatttccacttatgtggacctggaactgtcaaagagctcccagcccaggaaaatcagattctactcatgctaaaattgtatgcttttcaaattatttacttacaaactcagtggtttggctattttgtagtattatactcttgttactaatacaaaagacagcttacagctcatttctcaattcagtaaaatagcaatggtaaagtcctttaacagtcatctggtgtttggaaaggtgattgtctgaatcgtctggagagatggctgtataggcttcataaaaaagtccaggaaaaagaaactgtacaaccatttttagtgacccattcaagtattattttttaaatcagtctatgactttgaaaacagtaaacttgcgtaattttagaagcctaggattgaattattgattcaatataggcccactccaacccagtcaaaatataatgaggacttctctgttccttagcaactaaatgaaaataaattccattacactggaacaatttttatttcttgatggctgccttctactttattccaccagtaccttcttacctagctgtgtgattatgatacgatttcccagggccttaggtttaaaagatagcttgaaatttcaattacttaatctcaatcaaagaaacatctctgccttattttgaaagacttttggagaagattcttcagcttctccactactgcccactgctgtgtagtggtgtgtttatccatgttctgtagatgagaaaatgagactatgagaagtaaccttaaatttgatttgaaacacaataggtcaggccgggtgcagtggctcacacctgtaatcccagcactttgggaggccaaggtgggcggacgacctgaggtcaggggttcgagaccagcctggccaatatagtgaaaccccatctctgctaaaaaaaaaaaatacaaaatttagccagggcatggtggcgggcacctgtaatcccagttactctagaggctgaggcaggagaatcgcttgaacccagaagacggaggttgcagtgagccaagatcgtgccattgcactccagcctggacgacagagcgagaatccgactcaaaaaaaaaaaaaaatgaaaaagaaacacaataggtcataagtagtgattgagccagggccagaataccagctttctgattccctgtctgatgctctttctgcacagccctgtgaggagaaaaataatcagattataaatgctttgtttcctggagcccaagcaagcgcttcataatccctttgtggccacagtctccatggaaggctcactctaagaaagcacaggactctgcatcctttatctctacagtctacctcttggttcttttttctttaattcctcttagatcccttttaagatatttgtgtaagaggagagaactttctcattcatttactctcccaataaaaatgtattaagtggctgcctttgtgccaggtcttgtgctaggcagagcatccatttctattattggactcagaaaattctattgggctcgactttgaaaagtctaggtgattacttgcaaaatacagcaaaagaagaatcatgtccataccacccattagatcaccattatatgaggttagccctgagcagtgccattttcccaatcatgtccctttgaggagggtaccatatgtaaaatagtgataacaagtgttgagtgccagctatgtgccaggaactttactaggtattttatataaattatctatttaaacctaacaacaacccaatgaggttggtattgtaaatccatttttatagatgagtagactgaggttcagacaataatggtcaacatttgactcatttgctatgtactaaatgctttgtgaagttttttttgtttttgtttttttgttgttgttgttttgtttttgagacggagtctcgctctgttgaccaggctggagtgcagtggcgcaatcttggctcactggaacctccacccccgcaccgggttcaagtggttctcccaccttagcctcccacagtagctgggattacaggcgtatgccaccacacctggctaatttttgtatttttagtagagatggggtttcaccgtgttggccaggctggtcttgaactcccgacctcaggtgatccacctttcttggcctcccaaagtgctgggattacaggggtgacctactgctcccagctgctttgtcaggtgttttatatgaaccacacttaatcctcacagcagccctatgctactcaactataattttccctactttaaagatgaaaaaacagattctaagaggttagaaggcgtattgcgtaagtcagacaagtaagtggcataacttagttaagattagtgattatctacccaggcacacccttcaaagccaggattaggattcccttgaatttcagttcagtggtcttgccttcagaagtgagcagggatgagattcttcctgaggcctgtgtgtcaaggcttagcgcctgcctcttgctcatcctggtgcattggctaccaagagtgctcagtgctttgttggccgtatcctatggatagcctgatatctgggcacgtaaagactcatttggacccaaaaagcatgaacctacaaccatatttttctgtctcttctgtcactgatctctccatgtgcaattaagaaatacaccttcagtctacatttgagccagtgtcttacatttaaactttaaattaaaatgtttttaatgtttttgtttttaatttaggacagaaaaaagatcattgtagaaagcagggaatgtatgtgatacagaagaagtatatttttaaatggaaaaagacaaagtataaatactggattaataataaccttttcaataccttggcatttccagaatccttgggaaaatattattgtaccttctcatttattattggcttttaaacttcccagtggttttctttctaacctggaggcctcctcaattcctgatttttccatttgtttctttgacaaatatttactaaatacctactgtgggctaggcactatagatacagctgtgaacaaggtagatataaaaaatcaattataaccatgacaaatgctacagaagaaagtataagatgctactgaaacactagtaacaatggagaggaagaagagttgcaaagtcagagaaggctttctggaagaattgacgtttaaactgggccttgaaggatgagtaggatttaggcacagaggacaagataatatagcagggagcattccaggcagagggaacagcaggtatgaaggccctatggcaagtaagagctgggctcatatggggaaccaaaaagtagtcagagatgggaaagtgttcccaggaagaaaggagccacatgttggcagaagaatctttcttttgctttttaagatgtattcacttaaaaatggatacttctggaatattgataattttgctgacctattattattctcatggcataaatataaagtggccatatttcaagagtggtgctgtggggaggagtagcagccagtggctaagagggaggcttggggaggtggggagggctttgaggtgcctctgattccggggattctgtctcctcag

SEQ ID NO: 118 - DNA, 6286 bp, Homo sapiens
  source 1..6286: mol_type = genomic DNA
gtaggtgtcttgctttctgtttcccaccccttccagcaggaacacagaaacaggggtctctctttttctaatggcagtagctgccctgggcccaggttatagatcaagatgtagatgtaggtgtgggtaaagttcctttcatagcactgagatcttcatattaggaaggggaactctgaagtccctgcatttgctccagggggactaaccaaccaactctttagtctggtgggtttggcttaacttagattcagagattaggagaagtggaatcactggtctcaaaggcccttgttattaggctggggacaggaaagttcttgccccaggccagcaggatgtcttctttttgtggctgggagaaggggtgagagaatgagatgggggctgttgggacgaaggtggtagtgggatctgtggtctctcctgctgaccattcccatgaacacttccatccaactcaagtcttgataccggactcatccaaacaagtcagtttattaggtgaggggagttcatactgaaataaaatacccccttcttcccacacgttgccattctacagtgatcatgaaacttgagaaatccttttttcctccaggttccaagactatctccgaggtttgctggccatgacctcctgtgttttttccaggttggaagtgacatcctctctttctcaccccaccatcacttgtcccttgtcagctttactaaggatgatgactggtctcttattctatgtaataactaaagcttctttctttcagccaagtcagcattttaaagaaaggatgaatgggatttgtaggaccagggcctgtggaaaatttacttccttctgagggctgttaagtgccaagaaagtagaacggtggagactagactggtcatgtagaatgcaggtttcattggctgcatggtgaactacctgtagagtacctctgggatccaggatagagcagcatagaaatctctctgatggcaagtgcccaatactgagccatgatttctgctctataaatggatttcttttccaatacattgtctgcaatttccatggttaatgacccccttcccagaactgtcactgtgccctcagttgcatccccatttcaaaaagccagcctttgggaaatgcctaaatgaggtgaggaccccagccctagagggtaccaacgtgagaccctcgcagcgagagatgttagcatccctccagcaactgttgataccatcctgtggtggaaggacctgtaccccccacagacagaaagctggagctctaagacttaaagaatgggattgagataagacccagagagccaaagtgagactgggccagttctctttctggagaaagggcaagtgccatagagtcttcatttcacaatagctcctcaggactacctggcgtcaggtgggacacctgaactcaaactggtactcccagctgcctggggaggctgtgatttgaaacagagcttccccaccatgacctaccctcaccagaacacgttcttctcttttccctagggtgagctacccagaatttgaggatattgatcaggtatcccacatgcccctgctaaacaaataagctgctaaagcactaacagtcctacacattagcatttatttattttttgagatgaggtcttactctgtcacccagcctcaagtgcagtggcgccatctctgctcactgcagcctctgcctcctgggctcacacgatccttgcacctcagcctcccgagtagctggggctgcaggcacacaccaccatgcctggctaatttttgtatcttgggtagagatggagtttcaccatgttgcccaggctggtctggaactccttggcctcccaaagtgttgggtttatagacatgagccactgtgccaagccagcatttatttcacaaactttttttatggctatacgcaaggtggaagggggtaaagagcataggacaggcatgcagccaactgacactaattcataagctcctctagcttttgggggttgcttgatcattacattactgtggtgcccaactggctcctgtgaagacctctgtgccagttattagtaaataatatagttgaatgccattatctgtgtagaattgctccagaagcaataaggagaaacagaggttatccttgttgcaagcatgttcccagcccctggggagcttacactagcttccatagcaactatgtcctgactccaggcttgtgctaggtggggggacattcccaggccatcacagtggctccaatcgctgccgcttttgaattgtggatgaacaattagtcttggactgtcacctgaacagttggaactgctggactttttggtgtccatttgagtaaagtgtctgatttctttggcattttagaacatccagaaggttaggtcctaacttagcaccatccactggtgacttgatgtctgagtctgttactcatcgcatttgtttccctaattgattttcattcttccttgttgcctcttaaagctgtgagtacttttcagagtcatgggattatccagatgacttccaaggttaattccttttatttataatccatatgagttcccaaacaaggaaaacattctgttttgctcaggtccttggctgcattggagattgtgtcctgtaaaagaattttggcatcttttccccaggacatttatcccactgtatgtggagatcagcaagcctgtcagttctggaggtggggacttgcagagactacttgccttggcctgaattcagactgctgaaaacattccccgtttgaaaatattcacatcattttggaaaaatcacctaatgtctttccccctttttttccagcctgcaaccatagatgccctgaatttattttttttttcatttttaaaatttttttaggtaggtctcaccctgctgcccaggctggagtgcagtggcacaatcatggctcactgcagcctccaagtcctgggctcaagcagccttctcacctcagcctcctgagtagctgggactacagacacgtgccaaggcgcccagcttgatgccctgaatttgatgtctcctcaattccttttttttgttgtttgtttgtttgttttaggtttgattctttccttaaagaatactttaagcaatgttaggattatctccaggaggggcttaacagagactcagaggattataagagagccctcaactactaaagaataacccagataagacccttattgatcctgtcctgggccagattaatcagctgagtaacagcttatctcccagcaacgtttagagccagccactgaattggcctttagacctcctccttcattctccacactgtgggcctatttgttatcagataagtcacccaccctgaagagctgggatcttcttaccttatatggtgcctatagccactcaaagcttagtttcttgcaatctttacctgacaaagtttcgtaagatgaagctgacccaggggactgttgagtccaggtacttggttgagaaagaatagcttcccttcagatatacttattaaggcctcatgaagaatctggcaactttcaattcttttggagttaagagttggctgcacttggcaataatagggaagtagatacctccatataaattcttattgataatgatggatagatggagagaaagggattagttggtgctactatgttctagatagggcttttgtggaccatagtttaggcagacattgaactctggaccatctgccttttcatgaaaattagggtagcctaatagggcaacatttacttccggatttgctttggacattgcccagggcttcagagaagataactacactggtggattatgagcacatgcatagatcaaggtccatatccctttttattttatttatttatttatttatttgagatggagtttctctctttttgtccacgttggagtgcaatggcaccatctccgctcactgcaacctctgcctcctgggttcaagcaattctcctgcctcagccttccaagcagctgggattacaggcatgcaccaccacgcccagctaatttatttttgtatttttagtagagacggggtttcaccatgttggccaggctggtctcgaacttctgacctcaggtgatccacccacctcggccacaacacctggccatacctgtttttaaatcgaaacctttaaacctgctcatcctgacccttgctaggtcatacaccttccgcttctaccccctgccagtcatgctgcttaattataaatgtcttcatttttttaaaaattgtgtgtgtgcaattcacagacacaggatcaaagaattaaagccctaggatagagataaaaagcagcaaatgaaactaatttgtagattgtttctttttttttcctctctaaattttctttaaaatatcatcaatttaagtaagctaagctgatatgcaaccaccacttcccagtaggaagaatttaagagctgttgatggaaatatcttaacctatcctagaatttgtgttgtaagaaacccagaacccagccaggcatggtggctcaagcctgtaatcccagcactttgggaggccaaggcaggcgaatcacctgaggtcaggagtttgagaccagcctggacaacacagtgaaaccccatctctactaaaaatacaaaattagccgggcatggtggcacatgcctgtaatccaagctactcacccaggaggctaaggcagggagaattgcttgaacccaggaggtggaagttgcagtgagccaagattgtgccattgcactccagcctgagcgacagagtgagactttgtctcaaaaaaaaaaaaaaaaaatagaaacccagaccccaaacattctggagtttgactaactaaaggtatttttaggtctgctctcccctgaaaaattctgtaactctcagctcaggcccaggaaggcataaatgtagttagcatggtgttgagaaagcatcgtggtaactgctctgagagctctggtagaacaaggtaagtttgcctctggcagagcaggaaagtgtttgaccatacgtctaagcctggaggtctgcaggcttcttccccctggtacggcaacatattcaactctggattgtccagatagtcctgttggaatgttgttgtgtaacctgcccactggggacgtgacctgtctgtggaagaaaaagcattggcctgggagtcaggcagtggaggtctttaatcttggctgcagaactgccagtgtaaccctgggcaaattcttgtgtacgggtctcaatttcctcatctatcaaattttgttttccaataattcttccaactgttattctaatgataaaagttatagaagattgacatggaaatgacagacctgaggataattcattttggactgttctggaaggaaagaatgagaattataaggaaaagtgtggattcagttgtccagactcacccaagttcttgtggccatggaggggtcctggttgtagttaaaagtcagaaggttattttagttaaaagtgagagatagaaggatgtatttaaaagatagagatagaactcacttaagcgagttctcatggagccacagttcttgggaactgcaagtcagccatggtacttattgaacgttttcattgttgttaatgtcgtgacgcatcagattctcaaacaaatggttttttgtcaaccaggagtaaaagagcttgtccctcttggaaagccaatggtgaatgagctgaggagggggcagcttgtgtggagtatgtgtatttatctgtattcttttccataggtaccattaaatttgtctggcttaatttaatggggacttctgggacctgcagagactgtaaagggcgagggtaaggctcttgtcgtctgttcaggctcctctccttccagtggaacttcctcactctctccctctcctgtcagcctctccccttttccaacttgtgtgtatgttctaccgccttctcgattttctcttccctgttgttttttcttctgcctctcaaccacctttccttccaggtcatttgagtcaagttgaaataggcagctggtgttacccacttcctctacctggggggcccaatctgtgtctgcagtgctaggggctttattctaacactctggaacctctgttttctttctttttttttttttttttttttttttttttttttttttttggttaccttttttgtttttgtttttctcttctgtttctgtgtag

SEQ ID NO: 119 - DNA, 935 bp, Homo sapiens
  source 1..935: mol_type = genomic DNA
gtaagaagtaattggtgtgaagcattaggccactcataactccaactatttgggagttgttctttgttcgtttgtgtgtgtgtcgtcactgtgtgtataaactcccctattacagatatgtgacagagtttgtggacctgggcaatgtctcagcattgagaacattcagagttctccgagcattgaaaacaatttcagtcattccaggtgagagtggggttaaacaccagggctgactttgatcttttgaaagaaagacataaaaaaaacctttctttatgcaattttaattaaatttgatttcttctgttttccacaatcattatcaaaagtcaacctttgagtttaatcaattgcatgggtctttaggatgaggatgactacttggctcacatctcaacttgaaatcttccctcctgtctgagggtttgtttttccatttgcttatacaggaaggaaaatttcaatccattttaattgattttaaaatacttaggaaagagatcataaatatcagcatggggatattgcatgacattgttttttattttttctcagcaaaccatttctttattgaaaattattacaaggtgtcactatatgctgtaatttgttttggtgccatttatagagaagtggtttgtttgacaaacattagaacttacaaaaattatttttaaagtggtttgaatagccaaattgttcattttgacaacctaggtattctttgagaatatgttcctatttttaaccatttgctgtaatatataaaaacaaagtatatataaaatagcaaacccagaaggctttttttgaattaggttacttaaggtcattgatttgatataatgcatgactttctaggaaagcttgtgttttttgtttcgattcagaggctttatgtcattacaaacacttttttctcccattttcag

SEQ ID NO: 120 - DNA, 8283 bp, Homo sapiens
  source 1..8283: mol_type = genomic DNA
gtgagcagggcggtgcggggagggatccgtgccttgtccgtggccccgtctgtcattcctcttgtctgttctctggctctcctgttcctccttgttctgttccattccttctgtggcaacccccaacccgcccccgccatccacctctgaatccggtcttgcttggcctgcccgagagaggaggttcttctgggcgtctgacacgtcagggttgctgctcactgtgtccctgttggtgccagaagtgggagctgggctcccctcagagactcaggttgggcatgaggcgcctccatggccctcctggaggctcttggccccagggattcctgtgagttctctctctccctcccgacacaggctgtctttaccattaagggttgttttgtgttttactttggaggtacgcctccctcctcccatcctctctgtggccatgtggctgcccagtgtggctgataccctctgccttacagctgcctcctgccttgcttcctctggcggcttggagcacactgactccttttcttttgggggatctgccactaactccctatttcccatcccagaaacatttgtctcttggcaccaccttagaatcccttaaacatggattcccgtgtgtcatttctaaagtgcagtaagaagatagatggaagtcacgccatctccctgcactccatctgccctcttgccttctccccaccacttccccgtctgtcctgcccctgcccagaaggatctgagcaggggcctggcttgctgctgaggctgtcacagctgccagagccctgggctgatcccataggtctttccttgaggacccgactcccaaggctccttccaaagaggagcccttcgggcccgtgggctgcatggatgctggcggcagagctggtcatcccccacccgcccccttgtctgcctttttaaagctgcttttgccttctgtgcccctaggtctcccctctcctctttgggtctgggggggtggtatgtggatgccacctcttgactcctgcttcttgctgcctggaagaccaacctagtgggccccgtactgtcagccttggaggacagagttcacagcgtagcaacgtgttcagaacttaaggactttgcaggtcttacaaaggcctggccattctaccttctttagttcaggattcaaaagacaggtaggagcttgggaagctcatgaggcctctcctaaggtcccgggatgctgcctccagctcctgtcatcctggggaattgctctggggtcctctccccttttagccttttccaactctcagccaaactggaaagccctcttcccagcagtgcagtgttgaaggtgcccgtagaatgggtgttataatcagagtgagcagcctggtcctaggcctctgtacaggaccagacccctgaggctggggtctcctgacccacacctgaccagcccccatcttccctctctgcttctccctccgctcttctctgcctcttggtcttgatgaaaatcaaagccattttaaaaagtgcatagcacagtgcctggcctggttcgggccctcaataaacatttcttaaatggatgaaagaacaaagcaaaatgcaaatgctgtgttttgtgatttgagatctagggaggtggcttaggacaaaaacccacagaaggacttactcagcgttcagactcatcaggtgtcgatcccccatggtcgggctcaggtgggcccaggtctcgtcattggctctgtcctctcctgtgaggcagctgcagcagttgcagggcagggtcaggggattcctcagccggaacctctggcacttccccttctctgagttcatcctcccacggtgctctttagcattctgtcttgatcagggtacggttctcttagcccttggctctggctttcaccaggaccctgtttgtttttctttctcagatgtgggatggggaaggacaagaccagcagccctgacccttacgtgacgtctgttcttttactcagtagttcctgcaaaattctgatctctgattgggttcatgtgggtcctctgcttttccctgactgatcactggggtctggggacatagggctgtcatcggccaagcttgagtcctctgttctcccaggagccagggggatgggtccgcccacctagcaagcaggtgctgagagtgaggggagggggctctccagatggaagtccagtgctgtcccttgagtaagtagatgctggacagcctgtagcaaccaatgttctgtgacacggcccccactggcatcagcaactcacttccttgccggtcattggcttggagccatcagagggccctgatgtcggtgctcaggaggtcacagcttagtgctgtatccctcccctgtgaagtgtatttacagcgagccaactgcacaggctatcgcgaggctgcacacggcatcacctgtgaagcacctggtaggcccagggctggggcctgtggacccctcactggtgtgagctgccattgtctttgctgtcactgacgacacctaggtgaggtcttagagtcctttgtgggaaaacaagcctgttggatgcagcactggagacggtcctgccgtatcagtttgtcttcacaccgttctgttagacggacactaacagaatcctcatgttccagacaatgaaactgaggtaccagagagcttccttgcagacagaaaacggtggtctgcctgaccatgagccctgctctctggctgccgtaaccagggccgctgttgttaagccccttctgatgacacacaatgggcttttgcccagtaacgcccctccacagaagtggcaggtgtgtgcatggcacagactcacccccgctgtttactggtcatgtttgtcataagtagcacctggtgccacctgagtggcctacccgggcctgcttttccttctcagtttgcctctgtgttaccttctgttccagctcactcttcctttcaccctcttgcgctccttctcgccctcagacctgggctgaactacagccatctggaggggcccctgcccaccctgggcccttaacttccggtgcttctggctgcaggcagcggagcggagcacaggacacttggtgatgtctgagtccagtcctgtttcagatctggtccttgtgtgcccaccgtggctgttgtcagctcttgtcctgcggcccctaatggctggagtccggtactcactgctcacttagggataaaactgctggtggaactgcctaaagtgtgggaggttctgacatccaggtatggctgcttccttcccagggccagtcgtggcagaggcgctaggtcaccctcagggccataccctgagctgtgtctccagccccttgtgttccacagtgtttgtctcccaggcccatccttctcctccctgaccgacaccatgaggaagggaatgcccacccaccttttccagagatggctcattcctgatgtgctttagccacaaggtgttctgtggcctgagagctttctggacaagttaagctgtcctgtatgtcgtggaaccaaagctcggtaacctgtggaaaaatgatgagctctggggccacctttgattttcaggggaacctggaggatgtggcactctcatgctgcctctggaaggtccaggaccttcggccttttgaatcctcgatcccagattgtccacctgctctgtgctcccagctccaagtctagctctgctggacagaccattcatctgcccagagcccctcctcggtctctgggccccacacctgactctgaggctacatttgggcatgattcagacctgactccgagccccacaactggccacaggcaccccatctgtctgaggctctcacttgtctctgagaccctggcttcacacctggctctaaactccatttgtcttccaggccccgtgctcggatctgaatcccatgtggggtctgaggtccatagtaaggctcacgtctgccttggcacttagctttacatgggactctcacatctggttttgtaggtaaagttcatggcaaagtagctttggaaacacaaaaagaggttctttgctgcagtacttctggtgcctttgacaagcttgtgtggaggagggcactgtgtgccgtggtctccagacctgctagagtcagttcctaggtctcccagaagacccatgttcctcaaaatggtcaagaagccctgccctggtggcctgctgcagaccctgcctgctaatatatttgtcagggctctggacaaagcactgtgtgcttggtggatcacactggtaagcagggccaaggccagcagggcctgctcttttgaaacccagactgaatgtgtcacatacctgccagtgggggcccctgcaggccacatgcagctggggcaggtgtgttcccaggatccctgaaccctgttcggggagtaggaaggaggtacagaggaggggtcataggacactggggcccatcagagctggagctgggaacaggcggggtgccgaggagcaagacgtgttaccgcagaggatgcactggaagcttccgagcccatgtctggttttgtgctcctctgagaattagttcccttaatgaggcccctagtttgcaaaaggccacaggcctagaccggccccacgtgagtgcagtggcagaaggcccgaggcagtatcccgggcccgagtgtggacattttcctgcctgttggccctagtgggctgactgagttgggcacgcctggcagggacatgtcatacatactatttttgcattttgttagtgcatctcgtattcctggctttgtgctaggtaccaggaggcaaggagaactggtaagaagtggggtgaagggcctgagaccatgaacggtctggatccagaaatggcaaggggtaaagagaaggtctgggttgatattaggagttagccattggctgtagggtaaaaagaggagctgatggtggctcccaggctctgtgtgtggcaatgacagggtgccgttcactgagttggggatggagggacatgtgtggataccccagtagaggtgttggactcatcagaggctgtctgggtctcacatgtagcattcctgggcacactggccatagcaaagggtgtgagtggataatgttgcccaggagaaactgcaaactaagaggggagctctccgaaaatccatctaggaaggaagaggcctgggaaagaatgtctcgaagggaaacatgaacaggtcagcagcggggtcttgctgaccgcctggccaactgtggggcagagggcggagtggggagggtgtggcaaggccagacctctctcactggctgagagtcactgggaaacagtgagacggtgcaggattcaaatgtaggtggaaagacgtggggccgtgggggcctcagtgtgatctggactcagcctcttcagcgtggctgctggaggtgttcgtgggtgacggtgcctggtgaagtatcatgtgttagagggtgggtggcccagaagctctctgggaggctggcaggtgctgtgatgtggctgtttggcggccggagcctggccagggaggtggccagacggctgagagtgacagtgggtgtgcagagaggccatggaaacatggaagtcagacatggacactgctcgggtttgtgccctggggatggtgtgggcagtaccctcttccccaagagaaagaggagaagcagacacctgggccatgggtgaccccaggcccctccctcctgtgccctggggcctttggcaggcacagccttccttgggcgttttctcttggcctcctgacatctccagcatgctctgggaggcgggagcaatgtgaatggctctcctcacatctcttgccctcgggcccctggctccgtgggtgcctctggagccagcctgccctctgcccaggtctccagctcagcccctgccagtactacccagacaggcacaactctgctctgcccagctcggacctcctggagcccagaccctgctctgggctccggccgagcctcctggctgcgctgcccgcgcctgccctgtgcctctgccttcactgctgtggtcctgcaactcatcagtgtgcttcagtcacacctgagactccaggtacacctgccatcacaactccactgaaagctaagccttggggcaggggcagggccagggtaggtgtccatcctgtgatacaggtccccaggccagggccactttgttggggctggtgggtggaggccaggtgcatattcctggtcctgcccctctctgggtgtccacagtcaggtccctctgagtgattctctcggagtctcctctggcaagcccctccagcagtcaccaccacctgggcacccacccccaggggaccccccgacccaacaccacctggcacctccccttgggaatccccccaaccttggctgcctccccactttggcccactgtgcaggtggatccatggaggccaggtccaatgggagcaaagacagcttattctggtggttggtgcctgtgctgaggcccacctcaggtgttcttgaagcccctttctgtttgggggcacagtgtggcctcttcaggaagttctgctctggatctgagcagctgggaggaggcagtagggacagaggctgaggagaggacagaaatgaggtcccatgggagagacagagctcagatctccacagagggctgacctctcacaggtgggagacaaaagacgaaacctgctttaaggggagccccatgcgtgtgtggggcaggcactggtgatgctgtgtggtgaggacagcctttaaggggagccccatgcctgtatggggcagggactggtgatgctgtgtggtgaggacagcacagaggttggggtggggggactcagcctgggcaggggcagggagagggggtgggagggccactggagaggggcccggccaaagaggatgtcaggggctcagcacccccaggcggccaggcacctgccgagcactgcagccacgcttgtggttcacctgcacttggagactctcgcacaggcgcctctcctccaccagcagctccagctttgtccctcccacagcagctgggccctctgcacctgagttcctccctccacacctggctgcccattgtgtggttgcagctgtgggtcgcgtgggcctggccggctaactctctctctcattgctctctcctgcccatctgcatgtggctgctctgtcgagctgcgccgtggtcccgagcgccggctgtgtaagtgagcatgcccatcccatgcctcttgccgtccacacgctgtgcctgtctgcctgggtctctgctctgcgtggctgtgagaggctctggtgccactgacagccccttgaggcttcccctgacacagtggggatagggatgggaatgggaggacatgggagtgggttttctctggagctatcaccccaggtaggcctcccaccacggcagagccaaggaggggctagagctctagggtcctgtcaggtgaggctgggaagtgagctgccatcggttcttgtgtgtgtgcgtgcgtgcatgtgtgcgtgttgcgtgtctgcgtgtgtgtgctgctgccaccgcagcatgtctgtaacgcgtgtgggcaccgttgctgctgttgtgtgccgtctgtgcaggaggctgcctttgtgttgagggtgtgcacggcctcacacctgccctgcatgtgctgctgctccatacgggtacgagccctgcctagtgtctgtctcctgtgtcacggacctgttcaacctcgtgctgctgccagcctttatcgcgactcagctgtccctggaacctgcccaggatcccctgggtcttctcatgagagcagagctgtgtggggggtgggcggtgaagggtactgcccaagtctcagcgtcccgggtatctgtggatcccgccatgcccagagccggtgtcggaggctggcaggagggagaagcccgccctttgccatgagaggctgtcttttctttggttgggctgcacttggagcctggatggagtggagggggccaccagtcattcctcatattccagccagtcgctggctctggtcccaggggccaaagaaaagggccagggtaaccgtaggatcccaccctttatttcttcctctggccgggctactcccgccagccgcagccccagcccgtttcctcctggaccctgcccgctcccctccgcccgtccccccttggctgtgcgcccctcacctggcgctgacccctctccctccgcag

SEQ ID NO: 121 - DNA, 42278 bp, Homo sapiens
  source 1..42278: mol_type = genomic DNA
gtatgtttatttttaattattttatttaattctttttgtttgaaacagctttcttttgctctaatgaccaggaagtcattaaatgtataccttcccatctcttaggaccattttctgtacttactactattattattacattatttgagtaataatgtagttccttcaatcattgtttcaagttggggattcaatatgtatatatttgactcttttaaagaatgctttatcgtatcagagaactattattgtcaacaaggtggtgatgtgcagatgtatgagagtatttatatgcctttggtatttttcaaggcagctgtaaaattgtgagtaaatgtacaacatagctctatgaacgttacttttctataatctttctttctgagcaaatcgcctttaaaaattcacaggtgattccaaagccccaagaaaggcactctgcaaaagctagaggaaagaaactgtaccatatagaatcaaataggacacgttgcagaatgcctttggattctttttttccctaccagtcttctctgcttccattttgttggaacttttttccctccttcttttgaggcaggttctcactctgttgctcgggctggagtacagtggcatgatcttggctcagtgcaacttctgtctcccaggtacaagctatcctctcacctcagcctcctgagtagctggtatcaaagccgtgcgccaccatgcccagctaatttttgtatttttttgtagagacgggattttgccgtattgcccaggctggtctcaaactcctgggctcaagccatccgcttgcctctacctcccaaagtgttgggattacaggtgtaagccactttatctggccttctgcttacattttaaaaatgggttttccttaagctgtataagattgcaatggcttttaccattacacgaagaattttggactctgaactcttgctaatcaaacaccaatgtctgctaatagccaaagtataatgtacaagaactaaccttctctaggtaaactgtaaaggaccttgccttcttccttctctaggtaaactgtaggagactttgcttctgtccctgctgcttgccagcacccttttgacagattgcagttacctatcactctgaggtggagttctctagctctgaattttctctatttattggaatcttcatgtgtctgattttcccacatgcagcagtttgagatataacccatgtataatgtctttatgtacttcgaatactctcagttttcactagcactttccttttcttatttatgcacttgtcacccaatttttttattatactttaagttttagggtacatgtgcacaatgtgcgggttagttacgtatgtatacatgtgccatgttggtgtgctgcacccgtcaactcgtcgtttaacattaggtatatctcctaatgctatccctccccactcccccgaccccacaacaagccccagtgtgtgatgttccccttcctgtgtccatgtgttctcattgttcaattcccatctatgagtgagaacatgcagtgtttggtttttttgtccttgtgatagtttgctgagaatgatggtttccagcttcatccatgtccctgcaaaggacatgaattcatcattttttatggctgcatagtattccatggtgtatatgtgccacattttcttaatccagtctatcattgatggacatttgggttgattccaagtctttgctattgtgaatagtgccacaataaacatacgtgtgcatgtgtctttatagcagcatgatttataatcctttgggtatatacccagtaatgggattgctgggtcaaatggtatttctagttcaagatccctgaggaattgccacactgacttccacaatggttgaactagtttacagtctcaccaacagtgtaaaagtgttcctatttctccacatcctctccagcacctgttgtttcctgactttttaatgatcgccattctaactgaactacaaaccactgctcaatgaaataaaagaggatacaaacaaatggaagaacattccatgctcatgggtaggaagaatcaatgtcgtgaaaatggccatacaaggtaatatatagattcaatgccatccccatcaagctaccaatgactttcttcacagaattggaaaaaactactttaaagttcatatggaatcgaaaaagagcccacattgccaagtcaatcctaaaccaaaagaacaaagctggaggcatcatgctacctgacttcaaactatactacaaggctacagtaaccaaaacagcatggtactggtaccaaaacagagatatagaccaatggaacagaacagagcccccagaaataatgctgcatatctacaaccatctgatctttgacaaacctgacaaaaacaagaaatggcgaaaggattccctatttagtaaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaataccattcaggacataggcatgtgcaaggacttcatgtctaaaacaccaaaagcaatggcaacaaaagccaaaattgacaaatgggatctaatcaaactaaagagcctctgcacagcaaaagaaactaccatcagagtgaacaggcaacctacagaatgggagaaaattttttcaatctactcatctgacaaagggctaatatccagaatctacaatgaactcaaacaaatctacaagaaaaaaacaaacagcgccatcaacaagtgggcgaaggatatgaacagacacttctcaaaagaagacatttatgtagccaaaagacacatgaaaaaatactcatcatcactggccatcagagaaatgcaaatcataaccataatgagataccatttttttttttttaatggaaagaacctcctgtaaaatgaaggccttgatgactgggagggagcaggcagggaattaggtgatctacttgttgcagtattctggaggattgttggattatgccttctctctctgttccagcggcagaaggtttcctttttaaccttcttacctttgttttctaccctaaccccaagggggattctttgcttggtaggaaaatgtaatgtatgagcagggtggtgcaggaaaaggctgggctatatttcacactagttcatttaagctgaaactatgcaaaacacagacttatgccagcaagcatttttctgtggaaaatctagttgttttttcacctcctagaatggctcatgtttcagaggaagtgtgaccaagttcacatgcaacatggattatctgccttaatatttgagatcagttttttgtaatttggaaaaattttaaactacagaaaaaaaaatctgagtcacaaaaaagttgagagaagaatatggtgagcacacaatctatacccttcacctagattgactttttattaaaatttttaccatctttgtgctgtctttgtacacacacattttctacacacaaacacgtacacacataatttctttttatggttggaacacttaagtgtaaattgtacacatcacaatatttcagcatttatcttctgagactaagaacattctcctacataaccccccatgctattattgcacttaggagaattaatgatcatgtcaagtatcagctaatgtctattccatatttaaatatactagaactttcaagtatatttgcagatctggtgtgttcacctcccttcccaacctcaaatggctctttgcctattcttgtttctttctttttttgttttttgattgaagattatactgcagttagttatgtctcttttactctaaaacagaacagaaatattatattgtttttcgtgatattgacttttgaaatccaggcgagttatttggttgaaggtcctgcattctggacttgtctgattgtttcctcattgtctgattcaattcaggataaattctggggtataggttaggagctattctatactacccattgtatctcctcaggagggatcgtgtccaggtgttggtgatgctgtttgataagttggtgaagctggcatccacctgatatttccattgtaaaggctacattttgttgttatatgagtagataatttgtgggatgatatgtcaagatcacatggatattttctccagcaacctttcacctgatggttttagcatccatgatgattctttgctgaaccggttattctattgatgtttaaaaggtggcgatttttctaatcctataatttctcctgtatatattgtccaacattccttggtaaacagaaactttctttcctcttcccccttttctttgtcttttaatcttttttatcaacataaattactggatttgcatactttaattctgtattatactccattaccagtatgcccttacaggcaaagcgtctcataactggtcagtgggagggctgggcctcaagctggcttctcattctcagctttcaggtgctccttgcttttggcaaattagttgttccaggctcaccttggaccgttcctgcctttgacctggaaatcacttttccccccaacaagaagctctgattccttttatttaggaatggtgcttaggaacaaagctctgggcactggcttattgttaccagggtgttactgcttctctgacttttcagtgaaaagagctgggaaatatataaactttaaaaaattgaaagttcataataacatctccttttaaatttaacattacaggatttttctttgttttttaaattttgtgtctctctctgcgaaaattttggttgctacatacattaatatgtttatgggcctttatttgatagaattggaagacctctgaaggtataagaaagagcaaaaatgtttaaaaaataaatgaataaataggctgagcgtggtggcttacgcctgtaatcccagcactttgggatgccgaggcaggcggatcacctgagatcaggagttcgagaccagcctggccaacatggtgaaaccccatctctactaaaaatacaaaaaaattagccaggcatggtggccgtaacctgtaatcctagctactcgggaggctgaggcaagagaatcgcttgaacccaggagctggaggctgcagtgagccaagatcacaccattgcactccagcttgggtgacagagcaagactctgtctcaaaaataaaataaaataaaataaataaaataaaataataaaataaattggaataccttctgatgtgctttgtgttctattttatcccccttcccattaatagacatgctttttctttttttaaacatataatatccaaaaatacagccttacatttatcagataacaatgtgtaatatatattttacatatatagtataacataatgtgtgtattttctcaaaagcttgtgacagatttgaaaggccgactttgttttcttggttttatcgatgagataactgaagctcttggtatttaagcagtttgtagctaaaaggtgctcaggcctgtcaggttttaaattccttggccttttcagtgttctgagctgcctcttctcataatctcacagtcctcttttgacattttcttttagattttgtattatcttaaatctcagtgttttactgtgacacagaaaatgttagatggccttaatcctttgccctataacaaaccttttagttgcaaaaactgtgaacatctcagttatttttttcctttcatttctagttggcgtgtagtaattgtacatattagatacagagtgttagttcagtacatgtatataatgtgtaataatcaaatgagggttttatatcaatttgttgactaaatttagttaagtgtactaagaagcatttttacgaaagcccgggaatagaagctgtattttgaattctgttactcaccttaacaggctgaataatggccacccaaagagatctattcctaatccctggaatttgtaaatgttaccttatttggaaaaagggtctttgcagatgtcattaaatcaagaattttgagatgaagatattactctggattgtttaggtgggctctaaattccatcacaaatgtcattagaagatagaggcaaagggagagttgacacagaaacagggaagaggaagagacggggtgaccacagaagtagaggttggagcgttgcagccataaaccgaggaatgcctggagtcaccagatgctggaagaggcaagaggggattttccgcaagagcctttggagagtctgtggccgtactgaactcttgatttagggcttctcatccctagaactgtgatagcataaattttgttgtgttattatgggaatttgttttgtttatttatttatacttatattttattttatttttagacaaagggtcttgctctgttgcccaggctgatctcaaattcctaggctcaggctatcctcctgctttagcttctggagtagcagggattacaggcatgtgccactgaaatcaggtatttatatttctcttttttttttttttggagatggagtcttgctctgttgcccaggctggggtgcagtggcacgatctcagatcattgcaacctctgcctcctagttcaagtgattctcctgcctcagcctcctgagtagctgggattacaggggtccgccaccgtgccctactaatttttgtatttttagtagagacagtgttttaccatgttggccaggctggtctcgaacttctgatctcaagcagcccacctgccttggcctcccaaagtgctgggattataggtgtgagccaccgcactcagccccagctatttatattttctaattgacaaaagttgaatatatttatgatatgcaacatgatgttttgaaatatgtatacattgtagaatggctaaagcaagctaattagcatgtccattacctgatatacttatttctttttgtattgagaacacttaaaatctactcttagcaattttcaagtatacaatatatgattattaagtatagtcaatatgttgtacaataggtctcttgagcttactcctctaactaaaattttatattgttggaccaacatcactccagggcctttccccatactgtccccttcccccaagggaggccctggcaaccaccagtctgctctctgtttctatgagtttgacttttttagattccatgtgtaagtgagatcatgtagtatttgtctttctgtgcctggcttatttcacttaacatattgtccttcaggttcatccatattgtcacaagtgagaggattgcctttttaaaggcttaatagtattccattgtgtgcatgtatcacattttcttcatccgttcatctgtaatgggcacttgagttgattgcatatcttggctatggtgaataatgctgcagtgaacctgtaagtgcagatgcctcttcagtgtaccagttttattttcctgttgtaatttgtcacagcagccccaggaaatgaatacactcatgtagctgttttttccgggacgttagaaagcttatagttgtgaagaattttctttgccaagggccagcctgatccggaaaaaaacctttttctagtggtagttttggcttgatccagacattttccagtcagtgacccctgttgtcaactgtctctgtgagggcatggctgcttcctaaagacttcacctatgtgtgggctgggatggaactctgggcagggaatttaaatgcctgtgcacttacggccttaacacctccagcttgctgagagagggatcctgttttctgtagcactcttgtttctagtggaatgatgcatgagtgccttgggtacattggtcagccttccatgttggagcttctctctgaacactctccagttattcagcagctctttgggaacctcatctctgtgcttggcacagttgtgtatattgaggataacatggtgaatggaaaaaaaaacacagtgcttgttgccctcttggagcttctaatttaatggagcagacaggtattcatcagggagcctgaaataaatgtgaattgatgtagtgatactgctatgaaagagagagatggtgtgagtaacaccaaataagggcttcatttggactgggaaattgggaagactttccatgagtgacatctgagttgcaggagttggaggtgggagtacagaggacagagagttgcaggcagagggaacagcagttgtaaaggtcctgtgttttgaaatgcagaggctggcttgcctggagcatggaagtgcagggcatggtggtgggagaggtgggctgtgcccagactgtgtagggacttgtacctcatattaaggattggggttctttatcttgagagtgctggagagccatcaaaggctaatttgaatgaggggattggcacgatttgcctgtgtaacagcatacttgctgttaatactctttgttgtgtttagacctccctgcattccactgttttaatctacttaatgatggatttaatcaatttatgaagttccgtaagggagatgagaggagactttgagtgtctagggctggaagccttttgtttttggtgggccttaatgaatgaagagggcttgtcccagcatttgaggaggaggtgggactctaaggacttctcagggcctagaccttactgtaccacgtaactgaactgtaccttttagatttggttgtgattattattttttcattcaaaatgagaataaagctttgtatatcttctaagtataatttttatacattgttcatacaacttacctgttaagagcaaggtgaaaattcttcctttgatctttgcacacgttctatttgttgttgttactgactgttatctcgttaaagggagtcaaggctaaagaactgtcttcacttgtgactgaccttctcacctgggaagaccacatgggactagaataagctggaggtgttgagtgcctgacttactgagggttacgggtaccaagcactgtctgtgaggtgggcaccgggtggctcagggatccagttggcttgctagggtcacaaaggaatttaccacacatatgtctttcatctccagtgtggaacctctttgcactccatgtgcaaacagaagttggcacttcttttggaaaagggaatgttagatatctcagtttgctagtgatgaagctgacagattcaccataccgccttgtcagccccctgccactttgttgtaccaaaatgacagcaatataatcaaacccttaatttttttttttttttttgagacagagtctcaggctggagcacagtgggatgatctcagctcactgcaacctcccttactgggctcaagcaattctcctgcttcagcctccccagtagctgcgattataggcatgcaccaccacacccggctaatttttgtatttttagtaaagacggggtctccccatgttggtcaggcttgtctggaattcctgacctcaagtgatccacctgcctcagccctcccaaagtgctggaattacagacgtgagccactatgcccggcctcagataattcctttctgttcagagtaaagagattgagtcctgggacagttcctgttttgatgcatgaagaataaaggcatcaaagaagaaaagatgaaaaagaaatctaaagtttagaaatatgtggcctatataaataaagcatgttctctgcctttcctatgtttgctattctttttctgaggaaagaatatatggccttttaaagatttcacaaggtgaaggaggatataataatgttgatgataaaatcatttttatatacctgttttcattttgtgaggctgtcgtgatgaaatccaggccttggccacatgctgggagttaatgaggtttacaattggcaatacttaaagaatattagggtaatatatttaaacatcagcagttcacagcctgaagtgctcatcatctgtcaagttataatacagaatcaataaggggaggtctttcaatttgctaatgaggaaagttttctatactattagggtagacatagatttcagataaacatctaaaattcataaactatagaatttggcgaaagcatctcttcgattaaaaagaaaccttgataataatcaatagcagtcacctgagaagcttagattttcttcttagtcatcagactcccaaattaatctaccaaaacaaaaagcctcattaacagctctcattgaatcagtgttattttttcctttctctcaaggtgtctgattaaccccctttctttttgcattactcactttgtgttaatatttgatgtctgaaatcatggggcaggggaggggttgtgcaatgtggtggctagacactgtctacaagcagtaaattaaaaagaatttttaaaaaggtttgtattatgttgctgatgtattagaaaatctctaggaatgtcaggtgcctgggttttctttttctttttaatttcagaaagggttgattgctgattgggtgctgattttgcttctcattcatatgtacagatagcgctcctcctcctcttacccagctcctcttgcttaccaatccaagccttcttttggagagttttattgaaaaggaaaggtgagaaataaggccataactggagggaaaagggaggttgaaggagggtcttttctaggtgaatgccaatgggaaagactcacttgagagtagataagattgacaatgtaggagagaaaggaaagacattctggagcattgtctaggaggttggcctcttgtaagagcatggagagttcatccagaacacctgacctcaaagtgtagccagtggactcctggaagtccctgagaacttttcagaagtccaggaggtcaaaactatttgcacagtagtaaaagcatgatctacctttttcaccatgttgatatttgagctgaggtttctaaaagcaatagtgcgtaaaacttctggtgtcttaacagcaaataaggttttgtctgaacattgatgtccctccaaaattcatgttgaaacctaacctgcatggtgatagtgtgaagaggtagaactttggggaggtgattaggtcatgagggctctgctctcacagataggattagtacctttgtgaaggaggcttgagggaatctgtttgccccttctgccatgtgaggatggagcaagaaggcaccatctatgaaggagaaagcttttaccagacaccagacctgctgctgccttgatcttggacttcccaactcctagaactgtgagcagtaaattctgttacttataaattaccaagtactaggatattttgttataataacctgaacagaataagacagacaccaatccaaacagagtaagcaatcattattttcttcattacacattcatcatcttcgtcatactgattctgcttcagaatgtccttgaagaagcagtcaaaatcattgattttattaaatcttgctcttgattacacaagattacattttaaaattctgagtaattaaatggcaagtatgcataaagaactctttaatgtagtatggtggttgtctgaggaaaagtacttgagcagttgttttgaattgctagttgagctagtcttctactagaggatacgggataccattcttatttgaaagaatgacttttttgaaagatttaaaattttcatgtttcatcttcctaatacttaaagactttctgatgtcattggtggtgatgttaatgaatgtggcttttaaatatagtttaatgaagtttcctaacatttggatgatctgcataatatagagaaacagtattttcccagttgaccggtgtgcatggtgttacaaaattatgcatgggtaacagatagtttgaaaagtgctcatagacccatgaattttaaggtaacagagaggagaaaagttcactgatacagtttcagattgcacattgccactagtctttaagaaactttacttgttgggatttggtgttgtatcaaagaagaacatccccagttatctaaaaaggccattaaaatacttctttcttttctaactatgaatctgtgtgaggctgaaatcctttcatattcttcaaccaaaacaacatattacagcagattgaatgcagctgttttccattaaagtcagacatttaagagatttgtaaagatataaaactgcttttctcactaaattttctgttttagaaaatatagttctttggctgggtgtgctggctcatgcctgtaatcccagcactttgggaggctgaggcgggaggatcgcttgaggccaggagtttgagaccagcctggctaacatagcgagaccctgtctctacaattaaaaaaaaaaaggtatagttctttttcatacaaatatatttatattaccatgtaatagagttactttttaatgaaataaatattttctaaatttcccaattttaatttctagtatggtaaatatgatagctataatccacataaataaaagctctgtggggacctcaacaatttataactgtgttaagaggtcctgagacctaaaatttttgagaaatgctgagctagaagagaagatagagactagagtagagagagagtgtagatgtagtggtgagatttggggacaggttgtcttttggtttctttgatttttttccaggaaatagatgagatggaggtgcaggttgaggtattggcagtttgtggagagagattcgtatactacatagttatctagaagtgggagggtgaatgtgtgaggaacagcatgatggctgggcaggacccacttgagtgcttacctgaggattagtggtcatgaaatttaaagtgagaccagttagtgtggctgtatgtttttcagataaggccagtcgttcaggcccaggtagtaagggttggatgtagctagggttgaggtcatggccactgaataatccagagtaggtgaggttccagggaggtaggtgcaggggcgtgcaagggagtaattatgatgatagactatagatttagtctgggcaaggagcaaagagaggacattgggtaggacgcaatgagggatggtgagaaggtgacatgcttaatgaattgtgagtttcagcatggttgaaggttgttgatcaattgggatgtgtttatgagggactgaacaggaagactagaatatagtggccataaagtgagatgcatgaaattgagaaaaaggagtttttggtaatggcaagtaaagtctagagtgtgaccatgggagtgagtggctgaggaaggatgaaagaaaggccatcggaggagatgagttaatgtaattggaggccttagtgtttgaaggatcagtatattgaaggataagtatgttgaaaatattgagaactaagatagaagttgagagagtgtcatcgagccaagagctaaaatacggggtgagaggggaatccagggttattagatcacagaaacaagaggtatgctgagtggtatagtcagatgatgggaatatttgaatgggtgggggttaggaaggagaatatgggatctacccaacctgcttataggcctggtgcaacctaggactgcaagaggaaagctcatccctacacgtaagaggggtctacagtggaagcattgtcctcaagggacagccaggtattggttagagcaagaaagtgaagagatattttatggaaggattgaggaggagattttggtcactatacactgaattctagagaacacagttggagggtttctgggagatggtgacagaataggcaaagtccagggcctctcagggattagacgtgagtggtaaagggtaacctgggtgtccgggactgttggtcaaggctgacattcacggaataaagagaagaatgcagttagtcctggtagactccagattgtgcctgctggttgatagggatctttgcagagaggcaaggaagcttggagaggggcaacttttattacttaaagaacttttaaaataaaaatattttgtgagcagtagctctgctgtttttttttttttttttttcctagatggttggaccaaaggatgaaggaaatgaatagttactgagcatatatagggttccatatctggtgctaacaatttccacctgttttcttatttaatcttcatacaagaccttaaaataaatattttcactgcccatattataaagggaggtggagaattagagaggttaaataatttgctcaaagtcatatagctaatgagtggtggaactagcatttcgacccagttctttctggcttgtgctcaatctgctctaccatgaaactttctatgcatagagaagaatatttaaaattgagctttgcacgagaactttgcttatgtctttgcttagaagttctgatggcctttgcaagattctttgcccttgagactagtcatttagccctcatatttggccaacataaggtgaatataaaacctccatgagaggctcttcgtcacccatacccacacttatgaaaaactggccttgcttacctcttactctttttttttaaactgaggagtagtttttggaacacttttccctttttactgttcttatattgaaccttgagttaccattgcgtatcatattctcagaataagaataagtatcgttactgggccaacttaataccaacagttcttccatattcttcccagcatatgatgctgcttagtgaatgcctgaaagagcaaatactgttctttcctctttctttgtttggtgttagtgtagaaagataagctggattaattgtttgatttgcttgatctagactgtaggtgtttaaaacataaatctaaaattttaaaggaaaggaaatcaaatgtaagctctgtttcctagctacttgagaatctgcttctttaccactgtcagaattagaggtacaggatgtggagttgcttaaattaaaacagtcttgtactgagctatgaggaattcatgaagcaaaactgctatagtttgaatgtgtcctgaaagttcatgtgttggaaacttagtctattgcaacggtgttgggaagtggggacctttaagagatgaacatattaatgcttttatcgcaggcatgtggtatgtgggagtgggttctttatctcaggagtgggtttcttatcaaaggatgagttggtcctcttccccgtctctttcccttgcccatgtgatgccttccatcatgggacaacccagcaagaaagccctcaatgtcagtgccttgatcttggacttccaaatcccacaacagtgaggaagtaaatttttaaaatgaattactcagtctcaggtaattctgttctagaagcataaaatggactaagacaaaaatgttaggagatatagtacccaactttcccattgattgtggcataattgtgccatgattgtcagtgagttgcttcctagtaaatacagtgagattcagagattttaatgaaggtttttgagagtaaagtaagacttctcttgcaatctgatgtaaaggttttgagatcttcagtctggaataagcaaaaggtgaaagaagataactgatgaaagaacttaattgtcagaaattttagagtaacttagtctgaaataaatgatatatggtaaggtaaaatggccttctgctacaaatctgagacaaccttgatacttgaaaaatatagattaatttcagatttggtaactcatttaacaaatatatattgacaccaactatgtgccaggcactgttctaaacagtgtgcttttatatagcaaacagataatgtaaacaaaagatatatatagatgatatagaggtaggttgttatatttattaaagtgctatggtcgataaagtggtcagggaagatctctctgaaaagtgacatttgggcaaagacttgaatgaaggagtaagccatgggagaccctagggattgagccttctcaatagagaagaatagaggggataacaggtgcaaagagcctgagaggggagggtgcttggcatgtttgagaagcagcaaagagaccagctagtagagagggttgataggagagtgaaagaagtataaaatgtatcccagggccaggttatgtagatgttgtagaattgtattttgagagtagtagaagtcattggagggttttgagcatgggaatagcatgatctgcattacattttgaaaggttttgcctggctgatttgagagaatgggatgaagtgggtgacagtggaagaaagggaaattaggactgtgctgcagtaatctgtgtaaaaggtgatggcaagactagagttgaatggtaagaagtggttggatttgggattttattgatggattagatatgaaatatggggaatggcgatataagcaaatgagatagggaatgttgggggaagagtaggtttggaagcaaaattaagagttctttaggacattagaatattgacctccctgttaaacatgcaattagagaggcaggctgtgagatgtatgcttagagatgagagtcaatgtaattacttatttggtctgagccaattctcagcataaggagttggtgctgttgtaacttcagtgagttgtgttttgtagggtgggggaattggggtcttttttgtattgattattatgaacttacaggtttttatatgtttgtgttttaattgcaatatctcatctttggccagtaggaacccttttatattatctcttttgtcctttttgatatgatccattgatttttggtagcttccttgtttctggcaaaataggttgttattttatatatttcctgccctgaacctggaatcagttgctctgcttgaatctcccccttttttaattattattatattttaagttctgggatacatgtgcagaacgtgcaggtttattacataggtatacatgtgccatggtggtttgctgcacccatcaacccagcatctacattaggtatttctcctaatgctatccctccccttgctccccaccccccgacaggccccagtgtgtgatgtttccctccttgtgcgcatatgttctcattgttcgactaccacttatgagtgcgaacatgcggtgtttggtttgctgttcctatgttagtttgctgagaatggtggtttccatcttcatccatgtccctgcaaaggacatgaactcattctttcttgtggctgcatagtattctatggtgtatatatgccacattttctttatccagtctgtcattgacgagcatttaggttggttccaagtctgctattgtgaatagtactgccataaacatacgtgtgcatgtgtttttatagcagaatgatttgtaatcctttgggtatatacccagtaatgagattgctaggtcaaatggtatttctagttctagattcttgaggaatcaccacactgacttccacaatggttgaagtgatttacactcccaccagcaatgtaaaagcgttcctatttctccacatcctctccagcatctgttgtttcctgacttttaataatctccattctaactggcgtgagatggtatctcactgtggtgttgatttccatttctctaatgaccagtgatgatgagctttttttcatatgtttgttggatgataaatgtctttttttcagaagtgtctgttcatatctttacccactttttgatggggttgtttttatcttgtaaatatatttaagttccttgtagattctggatgttagtcctttgtcagatggataaattgcaaaatttttctcccattctgtaggttgcctgttcactctgatgatagtttctttcgctgtgcagaagctctttagtttaattagatcccatttgtcaattttggcttttgttgccattgcttttggtattttaatcatgaagtctttgcatatgcctatgtctgaatggtattgcctaggttttcttctagggtttttatggttttatatcttacatttaaatctttaccatcctgagttaatttttgtatacagtgtaaggaagggatccagtttcagttttctgcatatggttagccagttttcccaacaccatttattaaatagagaatcctttccccgtttcttgtttttgtcaggtttgtcaaagatcagatggttgtagatgtgtggtgttatttctgaggcttctattctgtcccattggtctatatatctgttttggtactagtaccatgctgttttggttactgcagccttatagtgtagtttgaagtcaggtagcatgatgcctccagctttgttcttgttgcttaggattgtgttggctatacgggctcttttttgtttccatgtgaaatttaaagtagttttttctaattctgtgaaggaagtcaatggtagtttgatgggaatagcattgaatctataaattactttggtcagtgtggccattttcacgatattgattcttcctatccatgggcatggaatgtttttccatttgtttgtgtcctctcttattttcttgagcagcggtttgtagttctccttgaagaggtccttcacatcccttgtaagttgtattcctaggtattttattctttttgtagcaattgtgaatgggagtttgctcatgatctggctctctgtcttttattggtgtataggcatgtttgtgatttttgcacaagaattttgtatcctgagacattgctgaagttgcttatcagcttaaggaggttttgggctgagacgatggggttttctaaatatgcaatcatgtcatgtgcaaacagagatcatttgacttcctctcttccatttaaataccctttatttctttctcttgcctgattgccctggccagaacttccaatactattttgaataggagtggtgagagagggcatccttgtcttgtgctggttttcaaagggaatgcttccagtttttgcccatttagtatgatattggctgtccgtttgtcgtaaatagctcttattctttttgagatacgttccatgaatacctggtttattgagtgtttttaccatgaagggatgttgaattttatcaaaggccttttctgcatctattgagctaatcatgtggtttttgtcattggttctgtttatgtgatgaattacgtttattgattatcacgtatgttgaaccagccttgcatcccagggatgaagccgacttgattatagtagataagctttttaatgtgcagctggatttggtttgccagtattttattgaggattttcatataaatgttcatcagggatattggcctgcaattttctttttttgttgtgtctctgccagattttggtattaggatgatgctagcctcataaaatgagttagggaggagtccctctttttctattgtttggaatagtttcagaaggaatggtaccagctcctctttgtacctctggtagaatttggctgtgaatccatctggtcctggactttttttggttagtaggctattaattactgcctcaatttcagaacttgttattgatctattcagggattcaacttcttcctaatttagtcttgggaggatgtatgtgtccaggaatttatccatttcttctagattttctagtttatttgtgtggaagtgtttataatattctctgatggtagtttgtatttctgtgggatcagtggtgatctcccctttttcattttttattgcatctatttgattcttctctcttttcttctttattagtctggctagtggtctatctatttggttaatcttttcaaaaaaccagctcctggattcattgattttttttgaagggtattttgtgtctgtgtctccttcagttctgctctgatcttagttatttcttgtcttctgctagctttcgaatgtgtttgctcttgcttctctagttcttttaattgtgatggagtgtcaattttagatctttcccgccttttcctatgggcatttagtgctataaatttccctctaaacactgctttagctgtgccccagagattctggtacgttgtgtctttgttctcatttgtttcaaagaacttatttatttctgccttaattttgttatttacccagtagtcattcaggagcaggttgttcagtttccatgtagttgtgtggttttgagtgaatttcttgatcctgagttctactttgattgcactgtggtctgagagactgttttgatttccattcttttacatttgctgaggagtgttttacttccaattatgtggtcgattttagaataagtgctatgtggtgctgagaagaaggtatattcttttgatttggggtggagagttctatagctgtctattagttctgcttggtacagagctgacttcaagttctgaatatccttgttaattttctgtctctttgatctgtctaatatggacagtggggtgttaaagtctcccactattattgtgtgggagtctgagtctctttgtaggtctctaagaacttgctttatgaatctgggtactcctgtatgggctccatatgtatttaggatagctagctcttcttgtcggattgatccctttatcattatataatgcccttctttgtctttttggatctctgttggtttaaagtctgttttatcagagactaggattgcaccccctgccttttttttgctttccatttgcttggcaaatattcctccatccctttattttgagcctgtgtgtctttgcatgtgagatgggtcacctgaatatagcacaccgacgggtcttgactctttatcccatttgccagtctgtgcctttgaattggggcatttagcccgtttaaggttaatattgttatgtgtgaatttgatcctgtcattatgatgcttgccatttattttgcccattagttgatgcagtttcttcatagtgtcgatggtttttacattttggtttgtttttgcagtggctagtaccagtttttcctttctatatttagtgcttccttcaggagttcttgtaaggccggcctggtggtgacgatatccctcagaatttgcttgtctgtaaagtattttatttctccttcacttatgaagcttagtttggctggatatgaaattctgggttgaaaattattttctttaagaatgttgaatattggcccctactctcttctggcttttaaggtttctgcagagagattcactgttagtctgatgggcttccctttgtgggtaatccgacctttctttctggagcccttctttttagtaggcagttgtatttatagaccacaatctggggattaggtatgtttccttcttttgagttgtcactactttgagaccttttgtttttctcttctctttatttattattattattttgagttagggttttgccctgttgtccaggctgaagtgtagtggtacaatcatggctcaatgcagcctcaaccgcctgggctcaagtggtcctcctgcctcagcctccggagttgctgggaccacaagcacacaccaccatggctggctaaatttttaaattttttgtaaagatggggtttccctgtgtttcccaggctggtcttaaacttctgggctcaaatgatcccgccacattggcctcccaaagtgctggaactacaagtgtgagctaccgcacctagctgatgccttttcaattcattagagaaaaaattttccattcatgctgatatttcaaatgtaaagataaattgacacagttaaatccaaagtaattttattgttttgatttttctatctccgctctttcattgaaaatcctggttaccagcaacattcacagtattacatatttgccatgtgtaggatatatccaaaatagtaacacctttattgctgccaacaattagatactgaatgaagtttaagatttctttttagttctgttgtacttagactgtgttccacaaagtatatatagttaaaatactgtattctaaagttattggaaagaattcatttaattctgtgtggttttgccaccaacttaatatatatatagggaggttcattttttcagtttattttcaatttttagggattgtcttttttattttcaacttaatttaatttttgagtatgtaaaacatatgtttcccaaatcaaaactatacaacagaaggaaggtatgctcagggaagtctgtcttaacatgcccgtccttttcaccctgactcttccttcctttttataggtcattcttttttgtattagttttttggtttctcctcccacagggtattttttccccaaatataagtaaatttatatgtgtatttgtgttcatctttccttccccattcgtatccaaaaggcagctctatcaactctatatactatatatacgctcctttgagggagtgtgtatgtgtgtgtatatatgtagtatatgtgcatgtgtactagggtttgctcatgaaacagatccaatagggtatatatacacacacatatgtgggtatatatgtatatttatataaagagagacaaatacacatgtaaatgtacatgtaaataataaatgaagacatttattataaggacttgtctcacatgactgtggaggctgagaattcccagtatcagctgtctgcaagctggagatctgggaaagccaatggtgtaattcagtttgagtctaaagacctgagaaccagggagccaatggtgtacttcccagtctgagagcaggagtagatccatgttccagctctaacactcaggtggagaaagcaagttatccctttctccacctttttggtttattcaggacctcagtggattggatgttgcctaccacattgggagggcaatctgctttacccagactgcctatttacatgcaaatctcatccagaaacacccatacagacacactcagaaataatgtttaatctgactaccacatgttgctatcgaggtaacacataaaattaaccatcacagcatttgtataatgtttgtctccagggaagacagacagacagacagacatgcgcacacacacatacagcacacacacacagttgcttttatctcttagtcgtgtgttttgaagataattctataaatatgtaaagaaatcttcctcattcctttttatggctgcatagtgtaagcatatacatttataattatttttccagtttattccaatatctgttaaagtttacagaccagtgcttttaaggtttacattatttggctcatcaggatcttttcccaaaccattttagggctgttgtcaaagagcaatggacaaaccctaatgatgagatgaactttactctcagaataccgtctcacttgctcctatgttctgcattccctgcaccaaacacttcctatgctgtctgcttccctgtccactcatacaggaaagggcttcgatgttatagagtcactcttattgctcctgctaactgctgtcctgataacaatgggtcttttgcatgggaaaagcattatagagtgaaaggatcactgatagcagtcaaaaaaacacattttactatgtcttttaaaatctgtgggatcttagacaagtgacctatcccatgtgagcctgttttctcatctgattaaatggggttgttacttgctcggtgaatgcttgtgttgtcacccagtgaaataaactccagggaagtttagttagctttcccttctcaatttacctgcagatactgtttcaacattcctctctcctctcattccttccctctcttattcctttcctcacctcctacttttcttccccaattcctggcatctttcctggtggcaaacagaccttccatgtgaagaaaaactcctcataattgcactttcctcttcagattctgccccatttctcttctttctgcaacactcatcaaaagcactgtctgttctggcccttacaattaattcctctgcccattgattcttttttgagatggagccttgctctgttagccaggctggagtgcagtggcatgatctcagctcactgcaacctccgcctcccgggttcaagcgattcttctgcctcagcctcctgggtagctggaataacaggagcatggcaccatgcccagataatttttgtatttttagtagagacagggtttcaccatgttgtccaggctggtctcaaactcctagcctcaagtgatccacccacctctgcctcccaaagtgctgggattacaggtgtgacccaccgtgcccagcctgcccattcattcttgaatccactctccccaagtttcctctgctgctctactatgctctaatctgcccttgttacgatcttcaaagcagaatccaatgataatattagttctcaggttaacacacttgcctcttacccctttttgcaatactcacttcacgttcattataccatgttcccttgcatccctcagacctcactggttctcacatctctagtttttcctaactactttttgggtgatcttgtcccatctcatggtgctaaatacttcataacttctacttttatgtcttcagccctctcctccctgctgcttctgtgagagtccatttgcgtacctaataggcccctcaaatgtcacatgtcctgacctaggctcctgagccttctctctccaagcattctttcctattgcttgctcagtagattctgtcttgcagttgctcaggccccaaactctagggacatccttgcttccttcttttctttcacacctcccttcaaatcttacatccagtctagttggcctcactatcagtatatgtatcgtcagtactccctctgcccaatttcttggaaaggtgacagtagcagcaactgctgttcaggcttcatgataccagcaaggataatacaaaaaaaggaagatgctggaaagttgaccaagaaagagacccagtaaataagtctggactcaagtccccaaataaaaaaagattcaaaggcaaactctaagacaagctctgtttttggtcttgtttcataaagtcatatagaaaaaaaatataaagacgtttccaactgtagttcataactgctgtattcatctgtgaaggattgatgacttgaggctctctgaccagggtgtccaataagaagtgcttagtaaagactcatcaggttggtttccaacacacagcccacattcagtctatacccaaaatagcaaagatggtgctacaccaactgctagtgaagatgcttcaaatgggcagtaagatagtaaatgtacacacccctgcaggtctgcttcacttttattttctttccaagtacagtttcaagaacagtttattaagtaaagcaaaaaaatagaaaagaaaatagtacgactcaatcagttcactccatatcaatgcaaattcagatgcaatgcaactggtgattggtgtgtggcttccagttggccagttctgtagaatcattcccactgagtgattcaacacccaatgatgtgaccctgcattttacttgatttactttttaaaaattctgctcagcattatggaggatgttactccataaccagacgcaggcatgaccatctctcacctggattattgtaataacttctcaccaaatcttcttgtgcagccagagtgattctgttaaaatctgagttggattatgtcactctctggctcacaatcctttatggctctccattttcactcagagtaaaagccaaagcccttctcgtggccaacaaggccttgtggtactctctccttacgttacctccccagcccctcacttcatctgctgctctttcccttaattactttgttctggtgacattggtcttcttgccgcaccttgaacacaccgtgcttgccgtgcttggtcccacctagaggccttgtacttcctcttccttctgtaaggcacttcccctaagaatctcactcacttcctttagggctttctcatggtggttatcttgtataatacatgtgggtttcattaattttttttttgtctcctcctctttcccacacacttgactgtaagctccacgaaagcagggatttttgtctgtttagttcactgctgagtcagcagatcctagaacgtggctggcacatagtagcactccataagtatttgtctaatttgaatggattgaacacataatgttccatgcacatgtgaggtattatccagaagaggtgggattcttagatttctctctatggttccttctttgaatttttacatgttaaaatctctgctgtcatttttctcccaggaccactgtaatattttatggagcctctttttttttttttgtaacaggtctaaaacttttagcaaatcttttttcttctcctgtcttcacttttctcctccccaagtagactgcttccacagtattttggggttgttctagtttttgtaaactttttctgaggaattctttgtgttgaaaaaaccacctatatataggattagattctcatatttttgagaatcctgccccattcttcagcatccttacaagggactggactcatgtcccaaagtgttggtggattccaaccattcggcatgtcctcgctcatttatgtcttatggtctggtaagttaactgccttctgccgtagagttaagtaaagacagccatgtcgctgctcttttagtgaattttggctgttcacattattcttcaagttatttagaatataactttttagattcactgaggatattgcatctacttgggcaaaaccctgaaagcccctaaggatttagctgaacatgtaattcatattgaaacccaccttctcttgccttatgattttctgattcagtactttcttctagagttttttttctttttttgagacagagtctcactttatcacccaggctggagtgcagtggtgtgatctcagctcactgcaacctccgcctcctgggttcaaacaattctcctgcctcactcagcctcctgattagctgggatcacaggcgtgtgtcaccacacctggctaatttttatatttttggtagagatggggttcaccatgttggctaggttagtctcgaactcctgatctcagatgatccgcccgccttagcctcccaaggtgctgggattacaggcgtgagccaccatgcctggcctagagtttttttttttttttttgctaagttaagaaataaaacagtaaccaatttctgaaggaaaaagcattaaaatattgatgttgcttttctgcaatacttataccaagaaaatgcaagagagtctcaaaagttgtgtagcttaatttcctcttgcaaaaatataaagtactcccaacagtttctaattttgatgatcttttacaattactgttctgtgttgtaatggcctgcgttttaaaaaagcttgaaattgttaggagacctttagacatagaacttggtaagaagtgcagagataggatggcatagaatggggaaacatgccagatcaattgggacagaaaatttttcttaactgcttttcagcatttatataggttcttccatgagcaaaataaaatatgaacctaaatagaatgggctcaaacagtcataataaactcctttggttattttcagaaaatctatattcacaggtggcctgtgttaataggtgaattcattgtattttggtgtggctatttgtataacaaaacatgactaaatatgaaagatgtgtatgtctttttctttaccagatcttgcgccagtttttaagcaagcaaattatgttcatgtagtaaaattttaatctgtattgggaatagaggtgggaatagtagtattctgtttactgtggatttggagtaaaatctagaaatgctacttaatcagcatattgtaagcagaaattactttttgtcttttttacaaaaaatggacatgagagctcactccgttgcccaggctggtctcaaactcctgggctcaagcgaccctcccacgttagccttccgagcagctgagaacagaggcacgtgcaattgtgcccagctttagaaatcactttttattttaattcttatttgtaacatttcataaggtattaggctacttttcccagtcactaccgtttatacaatttagttttaatttcttaaaattttatttgaaattgtagaatgtcttaatcattcagaatgtgaattgtcatggaggtgtcagagatgcaatttaatttctcctgatagcagtatatcttgaaaatattttgcttaaagatttatttatccttgctgtcaatttgtttcttataatttgcctcatagaaacattcattcaaaacagagtgctgaaaccaaaatggaatatacaattaaaaccaaataatttttttcctgctaactacttcccagcccccagactgaactcgtgattgaggttctatttacttttgcaaacagatgaatatttttggagcagtggaggtaggagcatggtacctaagtccaagttgcaccattttgtgtggctgtttctttcttattttgcattaggaaacaggtgcaagaaaaagaaaaaaaattccacttcatcatcgtagtagtatctggaatctcattccccataaccaagaagaactcatttattcttggccaccctctctcttttgttattctaagttgactgtggacagctttgatgctgcccctgaacttctatgagtccccctgcccttgctgccaggattttagaatctacccttctcctatactaggagtggtaagaaaataaattcgggtagtagtgccatttgatgattcattttctttttatatgtgtcctttaaaattaacattgacaatttggagcccctttgtaatgtggatgatagaggaaaagctgtgattgcttataggctgaatttaggttcatctgaaattatgatgtatctcagaaacatcataattccttggtttgggagtggtaataggattaggactgttgagactgtagaaaaagcacattgtttttcttagatgtggatgcttgtttggggtggtgtaggctgatggagagtatttgagacagcggctactctttcttttttttttttttttcccagctgctactctcaatgcagacattgctctagaacaccctgtataaactatatattgccacatctaaaccatatagtacttcattaaattttgaacatttaaaatattttaactatatgagacaactatgtggtgcatgtgttaattagcttgattgtgataatcatttttcaatgtatatgtatataaaaataacacattgtacactttaaatgtatacaatttttgtcaattatatgtcaataaagctgtaaaaaaattttagataatgcacaatggatcccatactttgtatttattcctatataccttgatttttaagcaccttattctttaagttcattttgttgccgaatttgagtgcattctccctagtccttattaaagagggtacaataatctttcatctgagatacaattgatggaattattttataggatcgagtacattttaaagcctaatctttctttgcttacattgaatattatgaccataatattatgaaatgttattctgaaacttggtctgagttctcttacgtcatcagaaatttctgcaaattcaatctgaaatcaacacatgggcactttttttttcttttttatggtcttaaatacagaaaatcataatctattttaagcttagataaatgatggaacacttgtttacatgggtaaaatgactctatctaagtagtatattgaagttcatgttaatgtttgctatttaatgacacctaatgatattcagtgaagggttatgctaaaccggagagaaaatgtgttacccaggcaactgcctctggcagactagagattcgggcatatggctctatagtacacattatttcagcatctttaagcataaagaaccacacatgtaattgactgtgaaaaattactgctcagttactgtattgtatggtcataatagaagtaaatgaatacgtcattgttgttggaacaagtctgttgggaatcacttgtagactctactatttaagaagcaaaaatacaataagaagaaaatagctggtttaattaacatgtaaaaattgggttaatttgaattcagctggcacagcagatattaatgttggcttttttttgtgatattctggctcaagcctgggtatttttatttcttcttgcccacaccatgaataattttatttcttaaaatgataagggctatttcagtcatttaatttttgctttgccagggacttttattacagtcacatcaagagaggttttgtgtgtatccaaaatgtaggaattacagttgaatgaaagaaaatgccaaaatgttcccgagtaattgataatgtttctcaaagaggaatcagtataattttgatttcatgtattttttaaaaattttagtttactgctgatgtatttttatttttttaacagtgacaaactaggaattgatcaacggcagatgcaagaaaatagcatgttcttgtcactttttgtgtgcctatgcttatgtgccttttgttcgttttagaatattgttttaatcatcattaccttgcttcagagattcagaaaaacctattgagaaaggcattgtgttccaattaaaaaatcgtttagctcaatcaatttttggtattttaaaatgttatttgagctgagaacaaacataggtaatatgggcattaactaaaagtatgtatgggaacattctgttccttgggctgtgccttcggtaccctgtaggtacttttgtgcttttcagccctaaatcaagggaatgatcaaactggagactatggttagagaagtgaaggatttggcagtgtgtgcccttgcatgcaggccagtctttctgtccttgggtgcattcaaagtacctggttatccagtggtaatgagaataaaccaacatgctgctttatatagtgtaggccagtatacgctgacaaattcatatgcctgctggcttttcagttactgatttcttatttgtggtttccccactatccttcttcatttgccattttaataacattgagacctttttatccagccttaattagtagaacaaagaaagatttaggaaacctaggtttttaaatctgctttatttgccttaatcagttttccatcatggtttacaattacttttcccttttttcctcaatggtctttctttacctcttttgatttcctcctgctttgaaggcaatacgtaatttaaaatgaggtatttatggtgttttttgtttgtttaaacttagtagacttttcctttaaaaagaagtctttggtagatctcaaaatatccatgatgtaattaaaatgcagactatttgtcatgcacattattaaattctgctctcagtgttggtaattatacaaaataggaacaatgtagtataataagatagcttttcggggtttttaaatgatgtctactagtatttaagaaataaaggatatttatctaaagaattgtggagatggtgaatatgatttgtctctagttttaaaagcttgtaggcttgtagtggttcttttccttgatgtagaatcatctttgtagggattggccgtgatcggagcatttttgtgacttgaaggttaaaagagaggttgagggaggtggcaaggacactggggcagattctcctcatctcattgagtaatggttattttacagggagggaaagaataaatggggtataggaagagtaaagacattttctagtgttacttgaattaactacgtactagcaagtgagaactagaaaagggatgaatcatacctgtcaaatgtgcttgatccatcttataagaaagagaatgttggaggtataagaataccccagtaaatccccctggttggcacagtcagccttgggcaacttgactgctgtttggagtcagctgcaaggcgatgggctgccaagtagagctggcagtatggacagatcacttactgagttaagctcacaattacgagagcctatatatatatatatatacttttgccaatatggaggcagtgatatatgcagaggtgatatttataggccaaatttgtgataacgatacagtaaaattgccaataaaaatctttaataggtttttaaagccaggcagtagcctgcttgtttgaacaatattcaatctgccagatttcactggagccaatgaatttaaataggcccttggcaaacactgcagcgagatttgaaccagagtacatagtagagctgaagagccctgctggcctcagaacacatgcactccagggaatgccaaggtcctttctggagccagggtgggcacagaatggctgcctgtaacctaaaatggaagaaaacaggattttagaatgaaaggcatccgagaaaagcaccttttatggaacaagaaaggatatctgttccaacttgtccaacaaggtcattcagccagttaggcaaaggtaagaccctataggactcagcttctgtccaccttattcctgatggtttttagaagattgggtaatcactcattgtctcttttcagatcagattagaaacaatagtcatgaatttgcataattggagtcgtgagtcttcgtttgtgtgcttgctgaccatcaactaacatattaaataaaaatctttacttaggagcatcctcttcatctgcctaactggtagtttccatatcctcagtgacttccaagcctcagagtctgtgcctgtgactgccatagcccctggccactgggcctcctcttgatggggaggggctgagcagctcctgggctttaaaaactgcttgctgtgacttccaggacaggacccccccagaccccacgtaattaagccttaacagctgtttagaaaatgtatcccagatttgactgctccttggttctcttgctacgacccaggtttagcctactgtagccgcttctaactgggctcactgcttcacccggcggcccgtgctccacagtgtcttgagtgttcttcgtaacctttctaactctgaggcgagtcacatcactcccctgcataaaacccttcaacagcagctgatttccctaggaataaaatccaggcatccttttatgcccggcacctccctcatcctcatcccctttcccttcccctgccttctctactctccagctgctcgaggtctccctgccctttggaacttaacaagggtggcctgctttgggcgctggcactgatgtttctcctcacatccctgtcctccaactcttttcctggccgctgcttttcaccattcagatctcaatacctcctcaccagaggcttttcctgaccgctttaggcaaagtagccttatctcccaaccccattactctcctgaagttgattttcaagcctggctatgtagtacaatcacttgagaagtttaaaaaaaaaccaaatgagtgtttaggcccctctacagaccaatgaaatagagtatctggggctgagaagcatgattccaaggcgttgctctattttaccctatgcagtggttgtctaattctggaatttttatgtatgcatgtgctcatcctccacccatctgcaaatgtggttccttgaggacatagatgttgtcaattttgaggtatccttagtgcctggggcatggcttatcatataataggaacagggtacacatttgctttgttatcaaaaagagtcagactctggggccggtgtggttgctcacacctgtaatcccagcactttgggaggctgaggcgggtggatcacctgaggtcaggagtttgaggccagcctggccaacatggtgaaaccctgtctctactaaaaatacaaaaattagccggggatggtggcgcacgcctgtaatccccagcttctcaggaggctgaggcaggagaattgcttgaacccgggaggcagaggttgcagtgagccgagatcacgccattgcactccagcctgggcaacaagagtgagactccgtctcaaaaaaaaaagagtcagactgtaaaatattggaagagatttattctgagccaggtatgagtgaccatggcctgtgacacagccctcaggagatcctgagaacatgtgcccaaggtggtcggggtgcagcttggttttacacattttagggagacatgagatttcaatcaattacatttaagaaatacattgattctgtccagaaaggtgggacaactcgaagtggggcgaaggcttccaggttataggtagagttaaacattttctggttgacaattggttggagtttacctaaagacctgggattattagaaaggaaatgtctgggttcagataaggtattgtagagaccaaagtgttcattgtacagatgaagcccttaggtagcaggcttcagagggaatagattgtgaatatttcttatcagacttaagatataatgagacatgtccaacccccacttcccgtcatggccagaaacagtcttttaggttaaatttgaagagtgccttggctaagaaggaagtccatcaaggggtcttagaattttatttttggtttacagcttggttgcctgaataatgtgtatttgcaaggaatatgggcgggaaagagaagagctataaaagccaaaagctattaaaagatgttaaaaatcatggagaccaaagctttggataaatttggataaactggtgatcacaggagagtccagttccagatttttcttaacacccacatatacttgtgtggtctgatggttagaactgtgtttttggagttagattttactttcatctctgccattgaccctggacaattgcttggcttctgctgtaacacacagaagaggtataaggagaagttatttttgtgaagtactcttgtggttaggaaccttcagtaaaagtggtaattggattttgatggtacattgtctacaaccaaacttcctgaagtatgaacagaacaattcctatgtgctgttgcttaaactttcgtagccacagagttggcctggagataggagccaggcaggagatgaaagggatcacatggggtctaagcctctgctgagtgagaataagcgaggacagagaggaggagaagaactggaggttgtccgttagtgtgattctttcagatcctttgtttcttttttcaatttgtcttcctctccccaaatctcttatatagtcctcctgccactatctaagttgaggactttgctattttgtttcatatgaatttttatttttttcttactgtaagaacagtgcagtatgtatattattgaaaggattagaaaatatggacaagcagaaaaaaatcttaaatttctaacaatttaaccacctagagatgatatccactgccaacactttggtgtgccttcttcagactttgtgtgtatgcaaaatattattgtccatttttaagaaacaaataattttctacacatcattgtgtaaatgactttttacttactaccatggatttgtttataacactttttagtggttggatagtatcctgcatatcaatgttctgtattcagtccatcacatattgttgtatattgaggttgtttgtacttttttcaccattaccagcagtgctgggtaaatatccttgtagattaaagtttgcacgcatttatgaattattttttaggataaactcctagaagtgcaattgtggtggctgaggagtaaagaggtgtttttttgtttttgtttttttctaactgcttcttgtggggcagggctaacccataggctacccagagtggccataaagacatctttgagactcttgctgtgttgtcaaattgttctccggagatgctgcactcccagcccttggtataaagtgcctttctttctttctttctttctttctttctttctttctttctttctttctttctttctttctttctttcctttctttcttttcttttcttttctttccctcccctcccctcccctcccctcccctctcctctcctttcggctttcgtagctcttccctggattctgccatcgcatctcctcaactctggtctcttccccttaagttcatttaacactcctctgtcagattaaatgttctgatgcacaaattgatcacatcactaaaattatcagatcttggtctaccatcacaggacctcataatcaggatgtgagcaactttgtagggtttttttctttcttttctttttttttttttctagtagatggtgtctcactctgtagcccaggctggagtgcagtggtgcagtcatagctcactgcagtcttgaactcctggactcaagtgatccttctgccttggcctcccaaagtgctggaattatagacatgagctgccacacccaaccccggcactgtattttctgttctagttttcctccagcaaatatggatttcttgtgattcttcatctctggtcttccttccttggtacctggcttaccttctgcccctctggaccaccatttctggggagcagagattgcgtccctagaactgccctctgccaaacatgtagaataggcattgaagtcaaactgcagctggtggactctcctcccgcatctcccatctttacttgatcacatttcacttttattgcaagactgagttcatgttcaccaaacacatcttccttctggtgtcatgtgttcgcaatttcagtaaggctttctccatctcctttcactcaacatgacagtaatctttccctcctctgaattcattgagtcatttatttccagttctcttatgttacttaacctactttttccataatatcacaatttttagtctgtattctctattatatttcagatatctccaggctaagtgctatcccttgcaaagctggggggaggagggacctaaagttacgctacagtgaagaagcaccatcatcattttggtatatatcttgtagtacctttccacatatgtgataaatgattaatatttacattgtgtaagcatagcatacagatgcaattcacttttcaactctttcttctttggcccagtattttatagtactacgcagtgctttggctattttattattacttggactataaaggagttacaaagtcgctactgttataaatggcttccagaaggagaacagcagctctaatgctttgtaaaacaaaaatgacttgcttacagaaaatatctagtagcatcagaaccatgaaatagagtagttagaaacctaccctcccctaatctctgagtggtataggcctgtggaaatgtgacttgtacatttgctttcatgttagctgacccatgttctactattagttcctgcagataagtgtggtggcaaatactgttccttagattctagtcatagagttaatcagagctgcatgattcattttaaagggaatctaacattgtcaaagaagttctgggagttgcgggtggaaaaggaactaagtgagttcaccagccaggtctgaacttgattaagcttgaattctttgttgtaacttacgttaatgctcattaaatctgtaaagcaagacggaagcactgtttgtctatatatatatatgtatatacatatatatatataaacatttttaggtatcatgctgtaaagtaatatagtactacataattattctcatggccttctagtcagattaccttgaaaatccaaaatgatcttggtgaacaataatacattatgattttatggttcatctatatacctcctgcatagatgtataatactcatatctaacaggattaccaaattacataccttttggtatcagtaacatgcctgaaataccagagtatttattggctattctcagttatgaaacattaacattgccagacaaggctttgtatatacatacatacatatatatatatatatatatatatatatataaaatatatagtcatatatataatatatattatatatatgtctttatatattataagctttgcatatgtatatggtctcctatatatgctttttttatataagccttttatatatattaagcctttctttattcagaccatgaaaccaaaaacatcccttttctagataacgcatagtgtgattctatttaatgaacctaatgtctgtgaaggggtaattaagcaaatatgattgttttcggcctcaacaaactgccagcaagttcccctggagagcagcactgtgtggctgcgtggctgtgggtgcctgctcagcagggttgggggatgtgaggaggcgtggcgactgggaagcaaagggccagaaacacatttgtcttctgtccggcttcagaagtctatagtgtggcgggcctgtcggtgaattcctcaaggtcttcttttattacagcatgtcttaaaaggaaaaggaaaaggaaacatctctaaatgaaatgcttgtgggcacttttattcacagctttaagtaacctttctttaaaaactgccagatctgtgtttccaatcttggcctctatattagtttcctcaggctgctgtaacaaagtactctaccgcaaactgggaagctttaaaaaaaaaaacaaattagttgtcctaagttctggaggctagacatccaaggtggaggttcagcagggttggtttcttctgagggctgtaagggagaatctgttccgtgcttctttcctgtcttctggtggtgggcgggcaacctttggtgttccttggcttgaagaagcgtcaccctgatctctatgttcatctttacttggttttctccttgtgtgcatgtctgtttttaaatttccctgttttataaaaaagactccagtcatattggattaggtgcctgccctactccactatgatctcatcttaactagttccatttgcagctaccctatttccaaataaagtcacattctgaggttctaggggttgggatttttggggacgggggacacagttctgcccataccagcatctctcttgagtccattgggtctcttttggcttctggctggacactgtactacatgtcccactgttacctcaaacacagtcacagttggttacattctcccacaggtcccttctttccaatttttacctttttttcttttttcttgtttatctttggtggtggtatcatcatcccactcagttatccaagttggaaatgttgggaacatcctggcctgtttccttggccttggcctccaacatccagtcctaaccacattttataatttctgcctctgctgtgtttctctagcctttcttctgcttccattcctagggcccccactcaggtttagaaccctgtgatccctggctgccaggctgtctcccacatctcatctctcctttaaattcatcttccacaccagttctttttctaaaacaaagttttgaatgtgacatttcttaatccagaaactgagtgatttttaactgtctgaaaaaaaagtcaagattctgttgcttggcccttaaggtccaccctaggtggctggcatctcgctcttgccagtcttttgctcctcatgacctgctagatggagaattggtaactcctacatgcttctccaaatacagcacatccatttgttttcatctctgtactttgcttccccagtgtagaatgtcctctctctacccttccctcctctctccattgtcaccaaaccaaagtcggtccatttgcctgcacaaaatggaaagccaaacacaaagcaccagttttttgcagcaagaaagtttattgccaggcaactgagtaaggggagaggagtcacactcaagtttgactttctctaccagccttacagccatagatttaagggagggcttctgagtgtggagtttaggtggtgaacagtgattagtgattggctgaaaggaaagggggtttggaaagtgtcttgggcatgctgttgcccttccatgctgcttcatgggttgcacctttggacagtggtggcattagcttgaactgagggtgagtttttggccctctaacgtcaaaaggttactcaacaggagaagaagtctattctgcccagactccagtcagctatgttggttccaaccagcctcagtctgtcagccaattttgtggcaaacagagagaactgtaacaaatggttttcttctctgctgtcctgcaagacaagcttaataaatttttgttagttaccaaattctttaatcctgtggggcatggtttcaccatcttcccacagcagttggaattctacccaggttaaatggaagccaggagacctggttttcaggccaaaatgtcagaagccagttgttttgcctaacccaggtcattaactttttccagtttccgtttcctcacaagtaaaatgaggaggttgaagtagataatccctaagatcttctcagctttaaaatttgttcttcaaataccatgccgccatgaagcagtccccaactcttccaggcagaataattcaccccttttatgccccttagtgctttactttttcttttacagttaactcttaatttctagtggttatgtgtgctcatgactatctccccttcctccaaacagctggtggtaagctcctggagttcagccaggaatgcttgactcatatttgccccccttcttgcctcctacgcagagtctcggtgagagagaccttagtagaggataaaatgtccttgggaagtactcccctgtaacacatgctcttcctgagtgttcccaggcattgagaagcatgtgttttggatggttaatgatacagagatgctatattgaacacactgcgtttttcctttctttgtagcattattgtaattgggtgacattctgggaaacagctaagttcactttgtaacagtttttataaaaatgtgttctctctataggatgtttagaagtaactaagttttctgtaaaatatatgaaaaccattcctattttcttcctccttccatatcctccggaaacttggagtatctcaatgtatcattaaagtatttggatacttaaaatagcagttgttaaaaaataaaatctaggaaagcttttatggacccatttcctctttggaagtcaaaacgtccttggcctctcatgttcttcctaaagcttagatttgacccacattttgaccttcggaaagttaaagtcactcctttttcctagagaagaatgaccaggcccttttctttcttcaaggccacctctggtcctatatttctaatcttattttacattgttcttttatgcactccactgtccagacaaaatctgtcactcatcagtttccctgtacactccttagctttcttgcattagccttctgcctgaagtgccctctagtctacacccattaccgcatatccaagttgtactcattttttaaggcctagctcaaatgccatttctgccacaaagacttttattaccatactagttcttgtgttatgatttgtccttcctctatacactagtctgtttctagaccagtgctgtctgcctcactagactagaagtcccttggggtcatgtttcatgtatcatttatctgtattccccttgtactagccctaggtcaattcacaggtggtcagtaaataccagtagtgaatcaatatctgtgaaccgttttttgcatggtgtataaggatactaatgcataacaaagttgctctattttgctgttaggcagtcacatcttagtctaaagtatctgcacttttattatagaacccaaaaacatgcctgaaggaagactgaaacatatatgatgctggataaaacagttatatttgaaattataatgtatttagtgtgtaacttcatggtcaatgctgtcatgtcttttagattctgtgcattattatttcagtccactatatgtaaaagtaaatgctaaatgtttataaatgttttcagtttgaattttatgttttggcagtgatatcttattttttccctcagtgtatgtttgtatatgcttctgttttccacaagctactgacttttgctttatgtttgttttatgttgcag

SEQ ID NO: 122 - DNA, 1789 bp, Homo sapiens
  source 1..1789: mol_type = genomic DNA
gtaagttgtaacttgccctaatgaagtggtttaactcagtaaataaggaattataaaaacaattcttataagttatgtagtgttttttttctgttgcaaacactaacattttaatgtgatcacatacattactaaactcaaacaaagagtgtgttttggctagttttagtgggtaggttaatttgttgtctgggtaatacggaatatcttcgagaaatacattagctttttaaagataaaaggaaaaacagatttgtgatctcatgttaattttgttttagattttgaagtatatcaagggctgatttttgctaatcttcttagatgctctaaggcaaaaaaaaaaaaaaaatagtgcacatgtatatcatttgttagagtagttagcacaacagaaactccaaaccttagattccctttcaccgtgtatgtgtcgaggccacagagttacatgtgacagcagagccctgcagttgtgtttcatggagcctccctcctccaggtgtcagctgctgtccttccctcatgggccctggggatgtcctgcaacattctgtggtggtggttcttaagacctgctcgtggagcaccagaatcaccactaaaaactattaaaactacagattctgagatctcttctaggcctatcatacaccatctataggcgatgaggtcttagaatctaattttgtaaagcttctgggtgattttggtaataactcagttttaggaccaatagcccgtggtaactctccttttgttaatcccagggagaatactgttttcaccatcatctgggtttcccacagtgcttaccataggcaggaactcagagtagcctttcagtttcctttcttcccccaagtccttagttctagagacatggtattccaacgaggcctcttccattctggcactgtgttaatctaactccttttcttgggcgcccccttctctactccatactaaactttcatgtcagctattttaaatgattactaagtgaagatttatgtggttgttaccttgtaaagaagtgctttcctaataaaaatattttgccttgctagggaaggatagaatttgaaactccaaactgaagtctcattcataatggacattctgtctgtttcccttgtcccctgtgaagaaatatggtttcttaaaaattctgattatcagaatttttactagtcttaaccccccatgaaagtatatggcatctcataattttaccataatatgcttgtttgctagaaatcccaccaatgtaaagtctgtacctaaatgattatttattactggttataagtaacttgacaagtcttgatattaatgttacattgactacttttcatagtatgtttgcattgatacaatacagtttttcatgcataagcacacacatgtgtgcatatgtacttatagtttttgcatgtttaagcctttaagatttgctcattagatgaaataaaccaacttataaaacatttccaattgaaatttgaactctaaattactactagtcctgttataatcctacacatgtatttatttagttttctaggagttgtgtatggagagtacaagttctggtcatgattagttgcagttgcttctaaaaatcatttatagcttttttttaatgcaaaagaaaaatacttatagtcatttcttcttgtacatgcatttttgattactttcaaactagttttagatgtatgtacttctgaatcatctataaatcttttgtatatttttcttctctcttgttttcaatttatttgag

SEQ ID NO: 123 - DNA, 4282 bp, Homo sapiens
  source 1..4282: mol_type = genomic DNA
gtgagcaaagaggagcaaacttgcattctggggtttccttagcaggataccccaaccctgttccacttgcagttgcctttgcggcattggtatctgacttaaccatttttctgttttgcaccaaaactctcgataaattttaaaggctgtaaagagaaattgcttagaaatggtgtgataaacaggtatttggcatttgctcatttcttgctaaggtggagtgatttcctaactgcaccagaagcctaatgctccgaaaacatgaaggaggtcttttctcctttcttgaagtctcatgttgagagatgtagcgaaagaatcccgtgttggtgtcactgtgcctgtcggcagctgcacgttgctaaatgaaagccgtctttgctctgtggagcagcccttcatcagcgcatcgtctaactgccatgccttccgtttttctgaatatcaaaatgagataattttgtttagtctggagttacagtttaaaggctttcagacctattttctctgtgaaaggattcataagttatatggaaacaattttaggaatgctaaattttattttatggttaacagaaaccaatctcttgaagttgtgggagtcagaaacttaagacatggaactttctcctttaactcttacccagctttctgtagatcaggattagagaagaaaagccttcatagcatgtgttagtaaaataaatggtgtttgtaaaataaatccactcacaggcgagtgtcgtttttagaaaaatttctccttttaggcagagccatctctgaatcctgtgagacttcgcagtttctggcatggagctctgggtttgtacagagacgccagtgtgaccacaatgggttgctgcaggctacacttttaggactgtcagaccttgagccagggcccccttcttttagctctttcccacccaaatgcagcggtgagttttgtgtgcagcatgcaagtcaaagtagtgggtgtgtgctcagtaaattctaacgagcacctctggaaaaccagctggccttgcttaaaagaggaagccgatttctctgagtgcaggagaaataactataatcacgtgtagaggtggaagcaacactgctctcccttccctttgatttttaacactgcttaggagatgattatctcttcgtctgtatgccaccagctattgtagaaatttggggattaagagaagcagagaagttttttttagatccctcctactcttcagctggcagcggcttcccacaatttttcctttaagctctttgcagcttttgagagtttatgatgggtgcttgttgatactggccatgaaagggttagaccagattgatgagatttatagcaggaaatgattcgctgccgcttagaggtttagagcaattcacaatggccttacctggaataggctttttactgcatgaaccctagtgggcccgacaaattcaagcaagggaggtcgtccacctgtgggcacagcgctgcctgtccagcactgtgcagcacttgtagcatttatcctggacagaggagtgaaggagcagagttttgtctcatttcaagaacatgctacagttctggctttggaaaagttaaataaaagtctaggatttcatttgtcttttaggagaggaattaatggtggtggtaggtccctcctccccccaccctctataattttcagagtattttcactcattattttgatgccagaacatttctaagtattgcatatttatatccctgtaaataaaatattgcttctcttttggatgcatctgtcaaaatgaaggtactattgatttccatctatatagggctacagttggaaacaactcatagaatttgcaaaagaaatgttttgtatcttaaagaggcatatttctatgtaaagctattttcagttaagtgactttgaaggagattccaaatgatctcattgtattagaattgtgttacattgacagcaactaaaattcagtgggttgatagctggggttgctgattattttcattgttcactgattttaattatcatggattctgaaaaacaaattttattgaatgtatgtattcattcaacaggtatttattaagcactgactatatgtcaccctcatttgacaactctctgtgacataaaattactgttttatttatgcagacagagaagtgcagcactctgaaatgttctggcatcaaaaacactgtgaggataataggtcaaaagaaccagaaaacaatgactgactgacctgaagtatgaatttagaaaagatggacaaaaaaagagaaaaagtaacgatcaactgtaatacagccacctagttttagctactgtaaatgttttgagtatctctgggtggtagggaggcaaaatattagtattaattttatatgcatatatatgtaaacctcttacaagcatttttaataaaaagtgacatcattttgtatatagtcttaaaaattgtttttaaaaaaattaccaggaaataggtcaaacatttaaataggtacaaagaatcatatgacaaatacctatctacttaccatgctctttttagcctatgttttcttttataattccttgtgaacatttaatatcaaatattcttttacagtatcattttgaatgatagggttttgttttaaagttattatttttaaaggctatagtcctccgttattggacatttagaatatttcccaaatttttgttctttttgtttaaagagcaaaaatttgggaaataatcgaaatttccaataagtactacaaatgttttttaagtgctacattcttgtagcttgttacatgcatgattatcttctatcctaacttttttctttttgagacggagtttcactcttcttgcccaggctggagtgcagtggcgcgatcttggctcactgcagcctccgcctcccaggttcaagtgattctcctgcctcagcctcccaagtagctgagattacaggcatgcgccaccacgtccggctaattttttatttttagaagagacggggtttctccatggtggtcaggctggtctcgaactcctgacctcaagtgatccacccacctcggcctcccaaagtgctgggattacaggtgtgagccactgcacccagcctattctaacttcagaggttatgtacattttaagggtttgggtgtatattactaaacatctctctatttatgcttgctttaatggcaaatttcagaaggcttgttatcaacttttgccaggctgggtattgccacttaaaacaaaaacaaaaatacatacaaaccaaaaacctgccaatttgattgatgaaaaatgatgtctcattgatgtttttatttgctttatttactttattttattttatttttttgatacagtctcactctgttgcccaggctggagtgcagtggcgcgatctcggctcactgcaagcttcacctcacgggttcacgccattctcctgcctcagcttcccaagtagctgggactacaggcgcctgccaccacacccagctaatttttttcttttttttgtatttttagtagagacggggtttcaccatgttagccaggatggtctcaatctcctgacctcatgatccacccacctcggcctcctgaagtgctgggattacaggcatgagccaccgtacccgacctatttttatttttgagatagagtcttgctctgttgccgaggctgaagtgcagtggcgtgatctcagctcactgcaacctctgccccctgggctcaagtgattctccctcctcagcctgagtagctgagactacaggcacatgccaccatgctggtctaatttttgtgttatattatagagatgggctttcaccatgttatccaggctggtcttgaactcctgtgctcaggtaatccgcccgcctcagcctcccaaagtgctgggattacaggcgtgagccaccgtgcctggcctcagtgatgtttttaactgtgcattttttttaatgagaatttgaaaataggcttataacatcatttttgtcaaaggatggttttgattatattgaaatttggttttaaacattaatagcactaaaatctttttattaataagaacttatgaaatccattcctacttttttccttgacattttagttgtatcatggatttagaacccaatgagtaatgtttaaagttaatgtatggtcatttttgttttatcttcttttctgtcacctgttttcctgctctctgattcctgtgcatgcaaagcag

SEQ ID NO: 124 - DNA, 12752 bp, Homo sapiens
  source 1..12752: mol_type = genomic DNA
gttagtgccacatgctcaatacctgttaggtgaaataacactcaaaggtttggtttctcatcttagtgcctgacatgaattagcaagactgcgttaaaatggaaatacagcagattttcaattatccatgctaatgggagtaggctggaggcatctagggcttggctaatcaaaacagcccataatctgaaaattatttatagtgctctgttgtatgttttatttcttaaaataataaattatttttataagcatcttccgtgaatttttgaaaggctcacattgtttgcatccttgaagtactctattctccagctaacagggaaaggtattctgccaccaggacaaagcctactcaggattcatgattttcctggaatacaccacaaaaaagataacgaagggttcagtagagctctcttttgctgcttcatcctgaattaaagttgccccttttcttcatctgactctcaacccaatggagttgattcacacacccctctagccaaggtttccccccactgagacagcctgaaacaggtaatccttctttctccaccttttcctttaaccatctaaggttcattaagcaatggaagtagtagcagagagtatgtcatcactgatggaaaggatcccacagaccctgactgcttttccactggcattggccgaaggagacttctcaactgttctttcggggattgccttctacgagaaggaaacagtgtttctgcatcagttaaaatacagtatcacaaggcagttcaaactcagctgctttataatttggcagcggcaaagctggcagagttttccctcctctcccctactaatgctctctctagatgaagaaaacagtatttagtactctgctgaggtggacggtgaaactggcagacatggaaacctgtgcctctgggcctcttctgccatctgctgactctagtcttcaaattaattaccccagttaaaaaaaacaaaaaggataaacctttcttgaaacctctcaccttagaagccagaaagtctcaaactccagagaagttccattttgcaggtcctattgtgtaggtaggtagcccccatcaaaggccttttgatctttgctctgccctcttttccttatcccctgcctcttcttacaatttggaaggtctttgacctcaggtgattgatgatgaccctttcagggtcactgccttccatttgaaatgcttttcttccctgatggcaacaactttgcaaatgaaatggcttccaagtagtacaaggttaatgtcacagttcctattctgcagtgagtcaggcaaaattggccgccttacctgtccatatgggtggtttttggaagggaaatctcgagtctcaagtctgggcagacatctgagcattgcttcataaactactttttgggcttttcttggtattagattaaatgtcaaggatgcctttagaattgtaagaatgcttcccaacactgctcagtgtctttaatttgcttaagttgattttttattttgagtccttttttctcgatctttgaccatacctggcaggtctgatttttggttacgtctatatttcccttttgcaacctgtactgttggcaactagaagtgtgcctgagtactgagtgctgagctaatgtgggctatgcaaagaggcttccactcttgccgtttcagttcttttatctgtaagatgagagtgactgcttttaacttctcagaggagtagtaagtcaatatattaggtacagacagaggctcactgtaaacacccaagtggcagctcttcacccttttcctggtttagaaatggccatttatctttgggtgccccaaccttaagggcaagagacagagctgtctgtcaggatgatgagtagagtgtgaatataagattagttctaggagtcacctgtgttcatttcttcctgatatcttttctggtaaaccattttaaaacaaaaaatttactgtaaaatttttgtttagtcccattctgtaatttggatcatcttgagagcaaaatgatgactgacagttcaggttaaaataataatgatacataactttgccatgaaaatgacttgttcctattcttgattggtcagggatcagttctctttagtttcttgtacatcatcaataattaataattgtatataactgcatatttgtaagtgcttattgggtaagagagatcagatgaaaatgtaggtaactcatggttattgttgttaatttaaaaaattacaatataagtaaaaaagacctgacatatttctgagactcagtattatcacctttatgtacaaagtcacattatgaaatacctatatgtgattctttgtacatttctcataaaatgtaactttattttaaaattatattattccagaggaaaactgttacgtttaaattaggaaaatatagtattgctgctattaatgctttcacctagcaatatttgagaaggtatcagagtacatctttaattcatacatgtttttaaatattgagcatagtttttagtattacagaattttgctcaacatgtaatttttctctatcaaggcctatgtaattgctcatatttcctgaatgagataatttgggaatgttgcagttgtaagatctttctcctactttaaaattacctttgtgtatactttgaaaaaagttggcatctggcctcaaagaaggtgtttttgtagcatgcgatcttattatgaggttaataaatatctctttttcttataacaagaatatcagaagctgtttttgcatttaaaagcctttccctgtggcattagaatgaaggttattttaaaagaactcttgtagtgctccaccacaagttttgttctttgcctcccccgcagctggctgcatcagaatagttgtggaagttgcttggtagtcatgagagagtgcctagcagtgctcttcaatagaaatatacctcagagagtcatgagaggtgttgtgagttggttaattcctgctctccatgtattggtataactccgttttctttatttccaggagcctctctcctatttttgtgtaagttttagttgctggaaaagagctccttaaaaatcccatgagtctggctctgcaaaccttctctacagtgcaaactacttttttcctaacaagaaaatggcaaattttcctagtttgttgttgttgttgttgttgttatttctgaaaatccaacccccaggccaagcctgtctgtattaagggaaatcacacctgagataatccaggtcttcctgaagtcacttttaaaattctttctctgtttcctccccagtcttcagagtgatttaatgtgctcaggtatttgaaatccttaatgaattacctgacaacttgtttggtttgaatgactggcataaccaaatgaatcagtcattggcctgctatagatctggcgtattaaagaacaacaattgattgggtaatcatccataattaaatgctcttaatgttccaggaataaataatttctgcttttaaactttgttgcagtcttctctctcagatctttcaggtgatgagatgagcagccttagacactggaaaatgttttgggagaatcttggggaaaaagatgtattaagagaaatatggccgggtacggtggcttatgcctgtaatcccagcactttgggagaccgaggcgggtggatcacctgaggtcaggagttcaagaccagcctggccaacatggccaaactctgtctctactaaaaatacaaaaattggctgggcataatggcgggcctgtaatcgcagctacaggctgaggcaggagaatcgcttgaacccaggaggatgcagtgatctgagattgtgccgctgcattcctgcctgggagacaagagtgaaactctgtctcaatttagaaaaaaaaagagatagaaatcagggtctatcagaaatacttcttagacgaaaatttttgtttctattgatgggagaagccctaaagaaaatctcccagaaagagtaattagatcattttatgaattaaacttaatttaagcagtgcttaacctttgaggaaattggcaaaaaaaaaaccacattttttaatcagcccattgatccaagcttgcagagttgtaaatatttctatttcaagttgtctgtgtagtgcaaagcagtcatcttccatcctggaatgttctcaaggtgacatctagaggatgttgtggtgatatctcagggagttattgatacttttatattgcagagggaagttttggcaggcagctagtttaagccaggtcccttatcattgatggtactataaaagggagtatccagattctttagaatcacagtgagattcttcattcttgcataattcatggggataaaataaactttaaaattctggcaccaaaataaaatgattgaaatttccatgactgttttgcattacttaagaacacatgcatcttgaaacaaaccatagttaatctgtgaactgcactcatgtccatccatgtccaccaaaacttttaatgattgcaaaatggataggtttgagtctttattttcttggccaatttctgcacgttttcatttagagcattaagctataaaaatatcagaagacatgtatttggttataggaagccacataagaatgagcagaagatttcaacagatcatttgttgggttagccaatctccagaaatctacagtgagctaactttagtgagcacagggcattgtaatctgagactgaggcgacacacactggatctaaggtgggtgagagaattgttagagacttgagagtgctacagtaacaactgatgaccttagaaaattggaaaaatatgacaaaaagatagacgtgtaggtatcctagagaagaggttaatgaatgaattagttccacacctcaaaaatgataatttataaccagctactgttgctgagactaaaacaagggagatagattaaacctcagtaggagggaaatagtttagatagaagaaaagataaccaggatcctgaacgttctcatgtactatggtgaaaaactgcaggagtatctgatcgttttccccaattctctttacttctagaaagccccagaatagaggagttgaggaactgatttttttccagaccataatcataatcacttattttatgttttaacactttgtctcccaaaggcatcctgagccatagctaagataacagacagtgcttgaaattttgagtgtaaataatttaacctagataaactggcatttaaatcttcatttctgcatttgtccctggctatttccccagctccactgtacagccaccttggggtagcagcccaaagagcctgtcagaactgggttgtaatgaaggctttgaaaggcgatagtgtagttgggaaggtggaaatgcctcatgcctaggggcaatctgagtcaaaagcagacagacaaatgggaggaggaggagggaggaaagaatgcttgagcaagtgaagagagaagggcatggcaacaggagcaggaataaaaagctctaaggcagggcacacaaagtgctgatagctgcagaatgaaggttaatctgatgttgaaagcaaaggggtttctcggggaagatagggacaagtgttctggtttcaatagtgaggtcagaagggtaagaatttgacatcggaggggttgctaccaggtggaaactagataacacaacagtgtgctggctgtggcttcagctacaggaataggggtgtcttctggattaatttttccttccaaagtttactgctcgtctctgccctgaataccttctgccctctattagatgctctcagctgtctttctctggtttgggctggcccctgtctcagttctatgctgagatagaactggtaactactgccttagttaccaagtttcttccttggtagtagcccctccacctctgtggtcctgctagcgttgcccagcgtggtcctttggcaccctggccactctgggttacagtagccgctcagcgtggcttcaacccactcctgaccctgcgccttcttcccagtatattcctgctctcactggttcaccaggttataacctacagcttggctctgacattcagtgccttcgaggttttaaggagtctaatattcaccatctgtagagacgggggaagcatgatgtggatgcctgctacatgggcaccatccctttgttgtgtacaagggtcaggcagggcagggtgctgacccagcctgagctgaggcctagagaaaagtttcagaacagtctagttgggaagaaatgcctttccagggcagaggaggaacttggagcagtaagtctgttagagaaaactggtaccgcagagaattaaggagcacagagccctgatttgagagtactggcaggcctgaattcaactttgagtgctactacatagtcgctcagaagttagtgacttgaaacaagctgcttagcctgtctggattccagtttccatgaaggaggaggaggaagaataagtgatagtgatgatgaagatcaacaacaacaacaaaaatccatttctgtagtctttactgtctgtacttggtactggtctgaggattttgtgagtgttaactcatttcatcttcacgactaccccgtgaaaatggcatcatgattattcccattctacagatgtggaaactaagatacaaagagattaggtaacttgtccacaattacacagctaacaaatagcaaagtcagaattgaagctcagcagcctggctccagacctcgtgttcctaatcacttggctcttttgtcacctggtagaaattacattgtgaaaagttgcttgtcagcagaggttaaggatcatttaagtttttaactataatattttatttcagcttaataacatagttgaaatgtgttgttttgtctgtgccactactttaccttgcccaaagtatacagggcccctggacacttccagaccacatgtgctctcactgcttggggacagctgttctaagataggcataatgtcatgggcacagcatgatactccttagctaatggtggactgtgaacatgattcaggctgaattgcctcttgcaaacaaaagaaatcaaggctatgtattgaaaagataggtagaaagaagcattatgtcttttggaatacataacatatgaggtaaatagtgtctggttctttgtacacttattcatataattatcaaaataaaccaatagatagtaagtagcacccttgttttgccaagagggaacctagaattcaaagaattactacccaagatcactcagtgtgaaagatgcacagacctagcattctagcccaggtctgtccacctccaaagcccatgccctagattgttcattttgctgccagcccgttggaaatagcctaaaattagtttaaattaggccagcaatattgagtttctttcataatcccttccaaccctgaaattccagttatatttctaacaggttcttaagaatagcatgctagccctctagttgaacacagtgggcccaggaacctcttttggggatgtcctgtgaagcttgagttggagacccctgatctgggcttggtccccacaccttcagctccttggtttgcgcaagggactgaattcagaggggatagtgtgatttatatctccaacccatgaaatgtgaagacaaaatactacattaatactgtaccctgtaaatcttttctcgcattagcagccttctggtagagtcgagttgccaaggaagcattgccatatgtgctgatggagctgaactaaaaggagaagattggaaaactaaccacactaataaatttcttttgaggcagttggaaaatggactgctgttttgacaagttagaaacaacacacacatccattctctgtttcaaatggttaaagtgaatttccaggacccaacagaaacatcttatattagaaacctgatttttctgctgaattacccagatgtcagatatatatgcactttagacttaattgtggttgtgatgaagtgcctcacctagactctctgctttaggcattactgggctgtgctacctctcctccctctgaggtcaaggtacaaggagggagtttggaattcccacctctttgacttttcattgtttcacagatcatgaccttcttacaaagaccatttacccaagactcatgttttcaaggcccacatctgtagtgggcctcagattataatccagtcaccttcattttcctgtttaaccagacaaggtagtcactacaagaatggttcttatcaacaacttccgtgagtggcagcatctggcctaggtcttaggaatggatttgtgctttggttttattctaagttgaagttaatcatttaatataaggaagctcggggcctctaatatattaccttaaactcctagtttctctagcttcctcaggtctctgctcttgcaaactatccttcacctgcctctagaactttttactttttgaactttactttttaccctaaaagccaccccatgcatctacagaatttggtgcatgctccttagtgggcctgggagagaagttgtgcagcgtaccaggtaagagcacaggctggagtcggacagcctgggtggaaccccgttcccccatcaaacagctgagccaccatgggcagctcccttaaagtcggcctcagtttcttcttcagttgctgtggataaaacaaaagccactgtttaagtaaggtattgtgtggattaaatgtgttcattcacataaaacacacagtactgtagtatgtggatatagcgagtgctccccaaatattggctgttgtcattatcactactattaataatattgttatttattatctggtcttctgtgatccaagcacagcctccagtgccctgactccatgccatagccttaagatgttggtgcctttgcacaccaactgtttcctctgcctgggtcaccttgccctccattctgctcattgtctcatctttccggggaacctctgctcacccttgaagtcccagggcaaatatctcctcttctttgatgttttttcccctcctgcaggcagaagaactggttctctccactgggttctcatagtcctgtgatgcccctggggtctggtatgcagcacctgctgttgttaggtggtttgtcccccatctggcaggtggagacaactagcgttccctttccctctaaactctgagcttcttagcggggaggcaccagtctcactgtgttcatcccagttcctctcagtaccaggcagacagagaaggcatttggtaaatgtttgctgaacaaatagctacttgttgccttctttgtagtcttaaatacggggttttcccttctgttttttgccgttcacaatgcattactaaatttatggtgagaaggataaatttcagtagtttgaaaggctggctgaagtgattgtatctaacacagtagtcattaggctctgtggcctgtttttttattagtcatttaaaaagactgtcacaggatagttatggagacaagagttcatcatttaaatcacagtgctttcaacccatccacaattttggtctacaatttaatgatgagaaaaatacatctagcaagtaaatgtttaactaagcattttgttacttgatgtgaatacagggagaaagatgaaaatttcaattgtgaagaggtagtttaaacaggcgtatgcccacatattactagtagaaattaatgttgtacttttattaggtaataaccaagccttctcctattatagatatcttactgaaagatcagtgagtgagtgtcatgagtatagtttaggagagaatgcttgctttggataagaatgcttgctttgcccaaatggttgcatattcccgttttttctcatatgctgcctcagctcatttaaattctaaagagcacagccccactcaagctagcaagagcttaggggggcttttgataaacattcacacaagagagaaagaaggtagaaatctcagatccaagagcaggagctgcactggaggctggcctcagtgggacccaaaggtgatggggacaggcgctcccacctgtgtgcctttcatgggctatgtgcattctctttttaatctctattccttttgctccacattctcatctgtccaccaatgcacttcctctgcttattcatggtttctgcttccttgtgatattagcacacacgtgacttccaattggctgctttccttgctccacccatgacatcttttcatcttgttgcttctgtgctaacttgtcccctcttctctaaagactgtcagtcatcctcctggagaaggcatcctaattggccagctctatttttggtagcaggctcaggttgctgaactcttgatttgcgtgtcttttaggtgttttacattgtccagtcagctgtggccctggggatgaagcaggcttagatgttatagttgcttagtgaagggctgcaaactcaggacaggtgagatggctcacacctgcaatcccaacattttggaaagcctaggcaggaggattgcttgaggccaggaatctgagactggtctgggcaacatagtgagggcttatctctttgttaaaaataaaaaatgagaaaaaacaaaaagaagcgttgcaaactcaaatgctgataggatctaggcaggttatataagtgaacaaatgcagctgggtgtgtgagatgcaggtacacatttgcacattaacacagagttgagttgtatataaagatacagattttttgagtaagatggctaaagcttgtatcccagtctcaccacttaacagctaggtaacttggaagaaattactttatctctctatgccttggtttcctctctgtagagtggttatgaagactaaatgagttaatacattttgtaaaatggtacctggcacgtaataaacgtgatgcacttttaaagaaaattttcattaacatcaccatccttatccttgtttaattccacaatgaaggacttcctcccatttttccatgaaaacatgaagctgtattcatctttttagttttccccctttataaggctatgagcaaagaaaaaattttatcaattgtgacgatatcagtaaagcaataaaaatagaaactggaggccgggcgctgtggctcacgcctgtaatcccgacactttggaaggccaaggcaggcggatcatgaggtcaggagatggagaccatgctggctaacatggtgaaaccccatctctactaaaaatacaaaaaattagccgggcgtggtggcaggcgcctatagtcccagctactcgggaggctgaggcaggagaatggcatgaacccaagaggcggagctggcagtgagccgagatcgcgccactgcactgtagcctgggcgacagagtgagactccgtcaaaaaaaaaaatacaaactggcgcttgtcctcattgaggtacgggcctcaaagcagggtgggcaccaccttgcatggtttctgtctgaaggatggagcctcatgcaatagagcagatggctgggatgtcagaaagaggcccggggtcagtcagagttcggtcagaactgagcccatgaactgactgttaggtcagtgtgttcattgatctttttttttttttgaggcagagtctcgctccattgccgggctggagtgcagtggtgcaatctcggctcactgcaacctccacctcctgggttcaagcaattctcctgtcttggcctcccaactagctgggactacaggtgcctgccaccacacccagctaatttttgtatttttagtagagacagggtttcaccttgttggtcaggctggtctcgaactcctgacctcagatgatccaccctcctcagcctcccaaagtgttgggattacaggcataagccaccgtgcctggcctcattgatctttcttacaaggaggtcagattatgtttgaaactttttgttactcaataaaacacacttataggttggatacatatggcattcaagctagtgacctctcaggctgctcctttaggaagagagtgtgggcagggctggtccctcagaagaggctgtgagtggactttcttacatagataaattagaaaattgtacttccaatgaagaatattaccatgaacctctctcagtatgacacagggtgcaacatgctcctaccttcagggttagcttggtgtgtgtttccaagaaaaaacaactgtgatttaatttttttttctttaagaagaacaaatgaaaatgatgacattttttagttcagatacgtagctccactaaatgttctaactgccttccccaaaattggtccttgttttagaaaatcaagtggtccactgatttagaaggcagaagggaaggagcagactttgggggaataatgagatttcctatatcactaatactgttgatttacccaatgtgcaaacgatccagaatgtgagatggaatgtacttgggactgatgcggctgttagaagttagtacttaaacattccatttcaaatattctcattaagggtaatagcagaaaattgcagcagagattaagcagtttttaagtggtaatcccctctgtagaactgttgatttgtttagttaatgctaatttatttaatatacttctactttttgttgatttttag

SEQ ID NO: 125 - DNA, 23348 bp, Homo sapiens
  source 1..23348: mol_type = genomic DNA
gtaagtaccttttgaagctctcttcattgaaaagacttgtttcacatatatatcactaccatggtcaacaggtgtggactaaggcttctgtttaaccacagatcctgcacaagggcagagtctactagggcacctcggcttttcctagacaggcgaaccattccagaggtggaagggtaaatgtttctgaccttactgcctgttaagtcatgcctgttaaattcgtcattgcttatggtttgttctgcaatggaagtcatttgtggcagaagtgtttggcctttgaaaaatctttgctaaccttttctaaagttaatttttagtacattctttcctcatggcaccctctgctgggtcaggcactaaaacttgtagtctgaagtcagcaaccgtagctctctgcttggctttgccttgcaagtggcagaactgttcaagcttccactgcttttgggagaacaatgctgggaaataactggctgagtgtgcgctgcattgtcaaaaatgcttggaatgattgtttccttatatggatgaacaacttgcatcttgttctgaagctcagcaaaacattgtgtctcgttttatctcgtactggtttgttcatgcgaatgtaaatactttaagtaaattaaactcttatacaaagactagtgttatttaaagataagattggttaaataacaggctttgatcactcaggcgatacaatattggttttttttatccgaacctatttcttataaaaaagatgaagtcacttttttaaattggcttactctgggcaggaagtagtattcctaaagtaatttttttcttgaagatccttgaatgtagacgttgggcaatgtttgtgtggaaagggcttattgtcctatctaatggtgaatgatggtttcttaaatgtagcaggacctaagaagtcctagctcctggtattctttagagatggatggaatttggctactgcctgactctctgtttgatcactgacctgttggagatgggcaggcaggatccccttgttctgtaactttaggagcgttcaggatggaaaaaaaggagcctttaatgtcctaaatataaagggcacacaataataatcaaagagaattttagaagttgctcttccccataactactctccatttaaaacaactctgtagtttccatttgagtaagtaggttttctaatttttgagtaggtatatccataggctgtgcctagcctagtccttcaggttgttgcagggcccaggatatagcagggttttttggtaggtcaggtggggttgttgtttttttaagttacattttaaactttctgaaaagatatgattatagatttctgtaagaattaaaatgtaaaattaattatgtgatactactcaagatgttggcaatcatcatggcatggtgcccagaggtttattttctttttaatgaaagcattttgcctgcacatacctctgggtgccaaggagattggttgtggcacgtattttctaggtgccatctgtaggtggtcttgtttttgcatatgcggccgcccatttcaaacacaaagcacattggcatcagaagtggtgcctagttatgtaaagagatgtagcccttttcaaacctgatctaaacacaggcttaaaattggagccacttaggctttacagctacttaaaatatctgtgaaatgaggtttgccatccttcatctcaaagaggtagacagtggtccttagcttttcaagtcttctcccttgcctttttcccccccaatcattactttaagaagtaagagtttattttcagttaagcaatcctgtaggtagcagacaacccaggtccctttagatctctgagtagatgaatggatggttccattttctgtgtgtgtgtttgtgtgtgtgcacacgtgctttttttttttttttttttttttttttttttcagacagagtttcgctctgtcaccaggctggagtgcagtggcgggatcttggctcactgcagcctccacctcccgggttcaagcgattctcctgcctcagcctcccgagtagctgggactacaggcacacaccaccatgtccagctaacttttttgcatttttagtagagactaggtttcaccatgttggccaggatggtctcaatctcctgacctcgtgatccgcctgccttggcctcccaaaatgctgggattacaggcatggggccaccccgcccagccatgcattttttaagtaatagcagcatctttctttgcaggctttggcaaagtcttctctataattggagtcagtcacacaccttagagggttgttgtgagttccacagcctcatctgtcctattgggaatacaaagggttttgtaaggttgtgtcacatgagcggttcctcatcttagttcatccaagcattgctaggtgttgacttttaagtccctggggagctcaccttgcttcatgattactgagaattagtacacatggctgacttttgcacttgtaaccaaagctgctcatttctttgaacaaggcttattctgttttatgatctgttttctgcaaaaatgaggaaagtatgtagggagatctttgtctcataacttcataatgtttagctaaacagcctgttttattgtatatatttttttagaatgaaagtgttagtaaatttggaggggaaaaaatgattgtcactaaaaaggaataaagtttatcccatttcttatttattatttttgatataataaagcctgtaactgaagagatgaaaaaataatcttctgtttcactgacatatgtaaaagggctaactttcacgtctaactttatttttaaactcattttttgcatttgagattagttttagtttagagcactgttaaaaattgacttcagttttctgagcatttttatagattcacactttaacagtagtgatatattcagcatgttttaagacaaaactcgatgctgagactggggtttacaaactctaaatctgaaagaatcctttgtggtttgtgttttctccctaacttgggtttctgcattctaaattagggttgtagttgtgggagttctgatggagacttggaccttcagtcttccctgcatgaggtatatatatatatgtataccttctgtttttttccatcttttcccttcttggatcaaaaacttggcacctttagagggatgtgattgaaaatctgtgttagtgaccgtgtgtgtcagaagacagaggttctgttaccactagccacttccagttaggttcccaatgattctgaaaattgatgtattacctctgaatatattgtttttattgcttttttgctgttactttaagaaaaaaataaaaaataatgtatgtaatgcaatatgatctgtaggctgcagtgcttcattcaacaaagtaagtgtatgacttttatatatctagtgtaatatgcatctaggttgaaatcttgaggagcctgggatctttagcttttgatcctttgatctttaaaaaaaagtcaccagataagaaatacaagtggtgcaatgactagtttcaaggaagaaatataaatatgatgattaatttatttggcctgaaaataaatctaatattactaagaaagaaagtcatgaaagtatgaacatctgtcttataaagccatatttagtaaaaactgtttatataacaagagaaagtaatagtattgtgtagtaatttttggaaagacaaattaacatgttttttaaactatggtcctttgataatgggtccagggtattttttcattgtgatgcacacatgtgtgtgcgtgagtgtgcatgttgtaaatataattggtgtttatagaagtttatattcattttgactgcattttgagttggaaaaacagtttatatgcttgtgtcactggttctaaaagggactggtgagactaacactgttgggaaaacatggaatgaagagtaatcttaattacactcccctataaataagtaggaccctaatgcagtttcctgcctgattcctaccataatggtgattcccatatgcatgatgtgtttatgccagtttgtccagccacgtatcaaatactgtttttaaggcaaggttttattactcatctcatacattacattcagttgcagttaatttatattttgaaaaattttgaaaaacacaacaatacagacacaggtgtgcctaccacttagattggtgacaaacttgacagtgcagttggaggcccttaatgtacctgtccaaattgcttttcattcccttacctctgtctcccaagagaaaactctgtcctgacagtggtgtttttcattctaagcatgtctctctactttttattacctgtgaatatcctaagcagtataaatgtttgtttttgaatgcctcatcctaacccagtgctctaggaacacctcatatgattcccagattgatgcctttgcattttttcccattagtgcaactcatgtgctttgcttatcagaaaataatagtaaatgggagtattacattcaaagtgttggaatgcggcagatactgcgtatgtctgttacagatgtgtgggtttctagatggacttatggttggaacagtgtattcatttaaccaagtttttggttacttggggtttctccctagacaacagtcatttcttcagtcttatgatttaaacttatacatgatacttagtttaaaaatgttaaccctccccactgccagcatacgctccctatctacctatcagcctgccttcccatcatccctcccttcttcttctgctgccatggttcttaccaccttcaaacattctgtataacttacttatttttcatgatttttgtttattttctgtctccttcatggtagagtacaagttctgcaaaagcagggatcttcttattcattgatgtatcctgaggactgcaggcattgcatggtaacctgtagactctttgtaaatattggttaaatgaaagaattttaaagctaaaatcactcaaaagtgatcttgtcaatcttcacagccaatcaacgacaaatctgataatggactcatttatatcttttctttaatgttagtcaaaccccttcccatcattaacaataaaacttatcacctgtctctccaagccatacttaatgataattcccaaatcaccaagaatagaaagcatatagatggagatcattttacaaagtgaaagtgttccttttaaaaccttgccattctaatttttgagaattgccaacagggatgctgctgcttcttttgtgtgtgtgtgtgtgtgtgtgtgtgtgtgtgtgtaaagttaatccttttgaaaatcatagccatttgtagtaaaaataatcacatctaacaagaggcagtccagtttcctgtaaagaacatgggcttttagtcggtttggggtcccaaggccttcacctgccagatgtgaatcaaggattagacaacttagttgacttctctgagttgcagctttcttgtctataaaatttagatagcaactttctctttcagttatctattgctgtgtaacaaacccctccaaaacttagtggtttaaaacaataatctgttctttttcattaatgctgcctcctttccgtggtttctgtctctttcccatggtttcagctggagtggtgaggcagctagaaggtccaaaatgtcctcacacaaatggcaatcagcttggagctcagctggagccatggctgggggaacaggttctccacatggcatatctgcgtgagcttcctcacactatagtgtcagacttaagaaggtgagttctgagagcagaataagaagctgagaaaaatctcaggcccagtttttgaggttatgcaacattaatttagccacagtgtgtttgttaaaacaggttataggccagccggattcagtgccagggaaaataatctacctctgaatgggagatgtggcattgatgttgcagccatctttaatgcaccacagttaccttgcctgattgtgggaaaaattaaatgagataatatgtatgaaagaattaaatcatgacttaagtactagtcttcctcctcttctggtgtctactttttaacttctaatatatatatatatggagagagagagaggatgttgtgaaaatgaatgttttagtttggctttttgggtgaaggggaatggaataggtgtattggagtttggatatggctgttgaggacctcagctacctcaggtgctcctgaaatctctggtcttctttgtgaacctgcttatttgccatttctctactgattgatttcctctgctgggtaacatagcatctttattctaaaaatgactttaatttcatcctgtgtccacagtgcatgccaatcccagttccaaggctttcctcctaacaggaatgatctcagtgtttctccatcattgaggaggagaagtgttctgattatctattgctgcataacaaataatctgaaaatttagtggcttcaaatagatacttattattattctctcttgtggttctatggattgacggggctcagcctgggagggttgtacttgggatccttatatggttatgggctagtggcagctggggccagactcatctgaagggtcaaccgggatagatatccaaggtggctcactcttgtaactgaacagctggggctgtgctccagagcacctgcttgacttctctgtgtagcttggtcttttcaaacattgacaatttgattctgagagggagcctcccaagagcaggcatcttaagagtcctgggcagaaacaagacttcttatgacctgaccttgaaggtcactgccagtgcattctgatggtcagacaagccagttaggctggcccagactcaacaggagagaaattagaccctacatcgtaataggaataatagcaaaggatgttttaactgccactggaggattcagtaagctgtgttgtgggctgggaacatcttcattgcccttcaccttgtgaaggtttcatagcccatctcatgccttctctgagggtctgttgctgatcctagaacccattcattctctagattgcttctggtagcagggggcagaaactcaccaaagttggagttaatcaaatgaaggtttactttaagggtacccattaaatgaaactgaaggctcttgagaattgaggcagcattaggaactggctactctctccattttctctacttggcctttgtctctctcacagtgactttgcatccctctgcacatcttttgactattctaatccataacttcttctcttcctgaagaattggtgttgactttctcaagaattcccttcatgttcttgccagccacctagcctttctctacagtaggagacagcctcttttcatcccttgccccagccccagctaattagcttaagttgttcagttttgttttgttttccatttaattattgagagaggaaatctgattggcaaacctcatctttgtgcgccaggccatacatatggcagccttgagtcatggcgccacccagatattaatgactttgcttaacatttccatttgtttcaactacctgtaagtgtcttcaaacctttcttgtactgttttgtttttagctctgaattctgtaagtttgccctgaatagtattgtgtatactttggtcataaaatatactcaaagtcaccattccttatgattgaacttgaaatcccttaagatttcatactcactcatatcaaaccaggaagaaaatttcctcatataatgaatacatatactctgacaatcagagctgatgagacagattgcctgaagtggatttaagtcttacttcgcgatctttttcttcccaggatttcctgtggatacgtagcctcatagtgtggttttcttaaggtagaatttttatttcactatgcaagtctctgcacatatcttacttataaatataagatgatgtgaggcttaatcattaggttgagtttttatgaagtcactcttgtgtgacatgtgaattaatcaagatacattatgcattatagtgatgctatagcaataatgttaatttttttaatgcttgtatctttacagtcttttgtagttcagtgaaaatctagtgattatattgttttcaaatgttattattgttattgtttggaatattccctgggagaactttttgcctactccgccaaaatgtaagaccatattaaagattttcttgatttgtacttgcactttatctctgccttccatctcctcttgacttggagggttggagactgtgtctggtattatatgacctgctgtctttgtcaaccatggtcactgctttgccacttgaggagatcttccttcataactttgtgctgacaactaattgcatctcacagaccttgagtaaatggctgaactgagacatctataaatatggatgacagggcctgtgttgcactgttacagctgtgtgtctagcattgtgtctgacatatggaagaaacttaaaaaaaaatctgttgaatgaataaatgcttgactacaaggtgtgggtcatagatttggaaaggaagggtagtgactctgtataccatgttactattcatttagagactgatggccagcaaagaggaattaactccaaaaattagtgggagagtaggggtgcaggaattgagggaatagctgtaaccatggctaggtgtctgcatatccaggatatttcacaagaaagtattccatgatcacccagtaatagaaccaacctttataaggctcctatttattttatttgacttcatttctaagaatgacaaataaataatccccaaatatattcagaatcttaagaacaggatgaagataaacaacttggagcatttggtatagcttatttattatggcttgtattttaagtagaaaagactttattgaatgactaacatgaaattatgtcagagtcatgaaggaatcatagaaaagaggagctttaaaaaaggaggagccaattaatagccaaaaaaaaaaaaaaaaatgctaacctcatggcactatctaaattggcagatttctgaaaagccaagaggcagctccatcggttttctcaaaaagtcctccaggcaatgggactaaggcattggtcttgaatagagttccactgcttgcctactccaatgagaggctctttctccagatgatttcaacttggactgagggcaaaattaaaagaaatatctgatggtactaagggctcatgggtgctatagattgaatgtttattttccccacaattgctatgtttaaacctaactcccagtgtggtggtattagaagagtgggacctttgggggtgattaggtcatgagggtggagcctacagtttgagattagtgcccttataaaagggatcccagggaggtccccactccttcctccatgtgaggacacagtgagaagacagcatctgtgagccaggaagcagtgctcaccagattccaactgtgccggcactgtgatctcagatttcgagcctccagaactctgagaaatgaatttatgttgtttataagccacgtagtctatgatactttgttacagaagcccgaacagactaagacagttaaggatagcctccctggctaagggctgccttcagtggctcagaaatgtcatcttattagaggaaagtccaactttcatgctagacactgggccagccagatacttcctttctgtttttctccctttaccttctctgggaaagtctcagagttgtttgactcaacacagttcaaatattgggccatctttctggatttctagtaaatagggaggagtttgttacgataggaaaatctgaagaaagactgggccatagctttcatacagttaaggtactttagacattgaaggtctgtaaatcattaaactattctggtagtagtagtcaaaatacacatgtataacaggcagaccccaaatgttaacatatttgacaggcctgtaagttaattgctttttaatgtcagtcaaatggattccactttggtttcttggccaggcttctatgggcccattaaaaccccatgaagctgaaaacatgaaacttaatatttgtaaaacatgtaaacagaatagcctttttctgccttaccgtgtggttaagaaattaggactaggatatttcagtttggtatctttctcagaatccaattagagtaagaatttattttattatcttttcaatattgttaataatctagtaacacatttttcacttaagagttttattttcataccaaatcaaaagaaaaaaaaattctatattgctttatgtttagagatgtgcatttggtcagacagtctaacttagtgtattcgtttggtcaggctgccataacaaaatgcctcataccacagagcgggaggcttaaacaacagagactggaagtccgaggttaaggtgttggcagttttggtttcttctgaggcctctcttcttttcttgcagatggccgccttctcactgtgtcctcacgtggtcacccctcagtccatgtgtcgtctgtgtcttaatctctaattataagggcaccagtcatattggattagggcccatccatttgacttcatttcttcttaattacctcttaaaaggccgtaagtccaaatccggtcacattctgaggtcctgagagttaggacttcagtatacaaattttggagagacgcaattcagccctaatgctagggtttaagaaaaggtctttctttcagtttgtgaggactcaggtttctgattgcaggagggtgatgatgtatcttgtgaaggcagtgagcccaacacacttcccttcagagctcgacagggtgagtggccttccgacctcatgccacctcatctttgccagcttctttgtgaggttgctgaatgccgtcttcagcacttgtgaacagttttgaacagcacttgactgcaatttggcaatgtgttttaatttattccatccactgctatttgctgaatatctcttttttacctgtgagctctgcatacaataatagttggttacatacaaattattttcatgtctctatttaacattgagttagtaagaaagtaaatggaaaatatgttgaaccttagattcctttacaagtctttattttctaatttattcaaatgtcaaacactgtcatcacttgtgtattcgtcttaatgaaacataaatcactagacatttattactatatatcttgtttgtagttacaattgtgtttgtgtccagataatcaaaataatgtatttgggtttaagtaaaagtctattctataactttatattaatctatttttgacacgtgtaagcacgcattttagaatgtcagtgtgcaattagatattcttagcacatgtcatttgtgaaaagcactttaaatctaagtacattcaattgagcataattaaaatatcaagatacatattcttcatatacattttgcctcttaattttttaagtagctataagtatctaccatgtgaattcaaattaaaggagggtgattaaattacagttatatttattgcttttagtttaaaatatagttgaaattgcgctatattaaaaaatatactgccatgttttctgtggacagcagactgatgatgggtttaatttgttttaatgcaagactattaatagtctctgaatattctcaagactgttgactagaatgattgggggttgggaggcgtaagaaggcttgtatttttatctaatgagttcttttgacttgactcctgaagtctcaagaaaatgttcaggaatactacctcatttaataaagaagcattggagaaagccttgttttgttgatacaaatgaaaggaaatggatcatggggaaatatgaactggagctcctgaacccttatcctttagataatgtatttaggctactgatatttcctatcattgtgaaaatgagcagacagccttggtgagtcagttttaaggcacatgtaactgttaaacctacttgtccacaactgttggacctaaagtatattatgattttagtgaaggccattgttcttggagtacttagagaaaatggggctgtacgttagaactctggattgtgttgcctttctaaaatatttgatttcttaaaattctgtttgtttgtttgtttgtttgtttgttttccaagatagaggcttgttctgtcgcccaggctggagtgcagtggtgtaatcttggctcactgtaacctccgcctcctgggttcaagcaattctgcctcagcctcccaagtggccaagactacaggcacgcaccaccatgcccagataatttttgtatttttagtagagagaggattttgccgtgtcagccaggctggtctccatttcctgacctcaagtgatccacttgcctcagcctcccaaagtgctgggattacaggtgtgagccacggcacccagcccttaaaaatctgtttttaaaaaataaatagctatatcacttccctgtgccaaaccagaagtgtcaacaatgaagtcattatgtaacatggcaagagggattcgggtggcaaaaccgtaaggaggagaagaagaaatcaagcttatagaagcatgtagacactgagtgaaagacgcagtgataggaaccacagtttggtttttttgcagactagcccatttcagagaaggcggtattagaagaaaaaacctataattttactgtgagccgtgaggaccatttcacatgaaaaaaaaacagagcatttggaaataatgatgcttcgtatcagtagaatgctgtgcgtttgagaagcttggcgcttggacttcatgctgacatggttgtagtcacagtcctattgccctttctggttgctctcagcactcctggatgcaaaggtgaatttatgaagatcatggacttccgatacaaattacagcagccaaaactgtcatatggagatgtgaacttaagattgtattggtagataggtgaagcacccattgctcctatcttgaaatgactatgctatatttagacaaaacctacatcagtataattattttgcaagcccatttgaagaaaattaaaactgtcactagttatatatttttgagcctaaaatatttctcacggctgggcatggtgtatcatgcctgtaatcccagcactttggtaggccgaggcaggtggatcacttgaggtcaggaatttgaaaccagcctggccaacatggtgaaacactgtctctactaaaaatacaaaaatttgggaggctgaggcgggcaggtcatgaggttaggagattgagaccatcgtggctaacacagtgaaaccccgtctctactaaaaacacaaaaaattagccaggcgcggtgacgggtgcctgtattcccagctacttgggaggctgaggcaggagaatgctgtgaacctgggaggcagagcttgcagtgagctaagatcatgccactgcactccagcctgggcgacagacggagattctgtctcaaaaaattggctgggcatggtggcgagcgcctgtagtcccaagtacttgggaggctgaggcacgagaatctcttgaacctgggaggcgaaggttacagtgagctgagtttgcactactgcactccagcctgggcgacagaacaagactctgtctccaaaataaataaataaataaaatatttctcaaggattcagatttggggattttactgccaagtagcctggctttctcattattgattaacctacaaagaaaaatttgatatatctgatgaaaatcagttatattgtacctacaaaaacatctcttccatattacttgatgtattttaatgtcactgaatccattggtttatctttatctcttagaagctcttaaagtcacaggaattctagtccatatgatcagattaaccaaaaattcaggcagctactccgttcaaacaggaaagaaaaaactgaaaatgaattgttgtattgaatctgctttttcacaagagacaactaggcgtaatggttctgagcgtgggttagaaattgggcaagtcgcgttcacattcttttactaccttgaagagaagtctctgcctccatctcatctctagaaagatgggaataatatagcttgtgtcagcatgattgggggattgaaggagatgatgtctgtgaagagtttagcacagtgcctcctacatcagaagtgcttgacacgtgtctggctcttgcttctccaggaaggagaggaggggagaagagagagtttgcagggccgtagttattcaagtagttacagctatctcttctttctggtcacactgctgggtaatttgttcttgaaaagtgtctcaagatgactgctcccacttagtagctggaaaatcacatccttccagaaagggatctagagggcagacatgggtgaagtgtacattgttagagggctgactggaaataatcagtgcagagatcactgtgggcagagccacagccttcaggtcctataaagggcagaacgataggaataatctactgcataggaaaaccaaagaaaagaaggaggacgaaaaacactctggggaggaaaaaataattggggttcactactgggatatctttccctctgctagaagatccttcatacataatgaatcacagtttggaaatggagcctttgaaaaaaaatccttacacaactggtaagagagaagtctcataccagccactgaatttttgcagaaatttgggcctccctccgcaagtgtactttcagactcaaattcctccagcatccaggacctcttgattaactatgtactctcaataaagagaaaaagatgagacctctgggaagcaagaattggtagaagctgggcctggtacagtggctcacacctgtcaccccagcactttgggaggccaaggtgggtggatcacttgaggccaggagtttgagaccagcctgggcaacatggcgaagcctatctctactaaaattacaaaaaaactagccaggtatggtggcgtacacctgtaatcccagctacagcaggaggctgaggcacgagaatcacttgaacccaggaggcggaggttacattgagccaagattgtgccactgcactccagcctgggtgacagagagagactctgtcttaaaaaaaaaaaaaagaaaaagatgctgaaatgtatcaaaaccagcctactcgtcatcctcttttaaaagaaaaagatgagtaaaccatcgcattactcattaggatgttaccagatatgtgagttggtcagagggactcctagctacaagtagaaggagtccactctaccattgactgtgtgcaaagtagcacattttatctacctttttaagatactcggccggatgcagtggctcacgcctgtaatcccagcactctggggggctgaggcaggcagatcacctgaggtcaggagttcaagaccatcctggccaacttagtgaaaccctgtctctgctaaaaatacaaaaattagccagatgtcgtggcacgcacctgtagtcccagctacttgggagactgaggcctgagaatcgcttgaacctgggagatggagtttgcagtgagccaagatcatgtcactacactccagcctgggtaagagagtgagactctgtcttaaaaaaaaaaaaaaaaaaaagacactcagtgactctgtgactctacgtatttggatctttccatttatctagtcttgtgctaaactttaaaaatttctgacactttataaaatgtgtgtaaatgtgtactgatataagatcctctacacgattttttattcagaatattcctgtcttcagacatcttcaggaaaccctgttggggttttgtttaggaggattgctttgaatttagattaacttaggaaaaagttataatatttgactgttataatcatttttaggaaaatttgcattttaaatttatagcccaagtgacgtatttgcaacattgaatctaatgatacttatttctctttcattcaaatgtttatgtgcctttaaaacaatacattttttcttcattttgatcctatatatttcatgttaagttattctttattaatgccacttgtaaaagaataaaaatatgtaagatttcttttggtgtaccagttctattgttctcctctaataaagatatataatgtttttgaatgtcgggtccccttttgaaaaatgctacaaaaagtttgtttacactggtgctagtattcaatactaatagagtgggcaataaaatgttcctcagttcctgataatagcctgggtgagagtacacatggcactgaacttagtaatttatcttctacagtcgtgggtgcacacagtgactcttaatagagaacccgctgtggtgctgcctgcagctctgggtcccctgcagccaggtgcaggtatgcagcccagtgcagatgtgcagccctaagccctgtttaaacacatggccacctgctgtaccttctaacctgttttgagttgaggaacagaatgtgtgagcctatgaactcacctctgtggtcatcagctgcttcatcttctcttctgtgttacagatcacagtaacttaatcataacttcctatggagagccagaatattattttactattgattctgaaggggtcttttgttgctgatgtggtttatgcatcagaactttagttgttcttgtgccaaattcgattctgtttgatttttttaaatctccaaagcataaatagtaaggacaactatgatttgtcagtttctgctctgtaacaaatttatcccccaactctgtatgtcactaaagcaaatgcaaactcttcatgttctacctttcactcctccattcagaacttgtactgttatgcgtaagcacagcataattatccctagtagttttatcttttcactctcttccccctagatattttctccttaattaccctaaatgaattgtcattgtctcttgattgctctcataaactactgtcattttctcactttcccttcccctgcaagtagactacacagctctctcattccccagcattctcgttccaatcctaggtcaccccatgtgctggactttgcctccctgtgtcagtagacattgttggtcctttcgccttctcacttctggaagccctgttcttaactcttgtgcctggattgctgtaccaccggtgtatagcagaggtttttcatcacttcatggtctctcgccactttccatttttcttcttcatcctcccaccttatctaaacccctgccttcagttatatatgtggagtgatgccctcatctgtgtctctcatccctcttaactcacccttccactgccttctgaatgtgtcattattcgtctttccaacactttgttcctattacacagcaaaaacttggatcctttctttgagcttacccactctttttgccctatattcagcagccaaatcctgttggtctctgttgcatccattacccagccacctctattcagtatagatatgactgttctaattctggccttttatcactcacctagtcggctaacaacctaattgtgatccctgcctcaggctctgcctcccggatgagccctctcccctctgctccctaggcatcttcccaaggcatagataatgctcagacctctacagctcctaagctgtgtttaccagctctcctgctgctacatagtcgcacagaccatctccagaatgcagcctgttctaggcagcatcctggaccttccatgagttggctccagcaatcttattttcagccaccttctttcataccccttctccatgccatctagagcaaaaggctgccatgataagaactgtaagtgtgccgctggcatccagccacttgagcttggaatccaaggttcaccttcctagctgcatgactccaagcatgttaaatagcctcctttactttttgtagcctcagtttcttcactgaaaccaggattttatttatttatttatttttattgagacggagtcttgctttgtcactcaggctggagtgcagtggcacaatcttggctcactgcaacctccgctgcccgggatcaagtgattctcctgcctcagcctcctgagtagctgggattacaggcacctgccaccatgtccggctaatttttttgtatttttagtagagatggggtttagccatgttggccagcctggtctcaaactcctgacctcaggtgatccacctgccttgacctcccaaagtgctgggattacaggcatgagtcactgcacccgacctattatttatcttattacttaccttataatattatgaagaccaaaaaacaatttttttttttttgagacagaatctccctctgtcgctcaggctggagtgcagtggcacgatcctggctcactgaaatctccgcctcccgagttcaagtgattcttctgcctcagcctcctgagtagctgggattacaggtgtgcgtcaccatgcccagctaattttgtgtatttagtagagatggagtttcaccatattagccaggcttatcctgaactcctgacctcaggtgatccacctgccttggtctcccaaagtgctgggattacaggtgtgagccaccacacctggcccaagaattcttatagaactcttaccacaatccctggtacttagtaagctagaggagcctcaataaatgctagaggatgatgatgttgatctcatcataattatcatccttattaaaatttcgcttggcagaagtgatgctgggtatattacccatataagtgtgatatgcccttgtcactgttcctttgtgcctttctctgcctggactaccaaaatcctaatcacactgtagtccccagctaacatgttaccttctcactggcttaatcacctcccagccaggagagctcttgccctcctttgaactgtcatatcagtttgtctggaccttggatcttatcatataattatctgttctcatgtcccattttctgtatttatgaggcatatagttactgaactccattgaaaatcctttcctctgcttgctggctatatagccctgggtacgttgctatattagtttgctagtgctaccaaaacaaaataccacaaactaggtggcttaaacaacagaaaatttatattctcacatttctagaatctgaaagttcaagatcaaggtgttggcagggttggtttcttctgaggtctctctctttggcttgtagatagccgctttttccctgtgtcttctcttttgtgtcctacatgtctgtgtctcagttttctcttcttgtaacaaaccagttggatgggattacgtcccaccctaaagacctctttttaacttaatttctcttttaaaggccctgtttccaactatagtcacattctgaaatatttgagagttaggacttcaactatgacttttggtagaacacagttcagcccataacagttgctttaatctttctgtgcttcaatttcctcttatgtaaaatctgcaaaaagtacctcttgagtggactgaaaatatgtaatatatgcaaagcaacaccttaataccccataatagatgtttaatgaatattcatgacttctacccttactacttcaagcttcttgagaatgagaataaagcatcttgtgtccttgcagttctaggacaaactttgaattgcttataaatatttggtgaatgaaaaatcaaatagcagaagtgagtctataataattgtatgcatttctctttctctcttagatggatccagatactagatgataactaagatttcaataacaaagagtataccaggaaacatgtagaaaagtcagtgttaccgctgtaaatataatatgccacactgagccagttcagtatggaatattttcccatgtcctacttgccacagactccagtaagtcatagggaaatgatttgtgacaaaattgcacacacacaaaaaaaacagtatcttcacacagccagagctttcaagtgatgagggacgcaaagacattgtgcacaataggtgttcctgtccattgtctgccgattcagctatctttgatctctgcaaaagaggaaccatgggtatggtactgtgaatgcataatagaccaggaattggaagagcggcacgcagtgtgctgctcagtgatcaagtcgtggagagacccagacaccatgcatctgatgataagcatcttctcttggtgccttggagtctctcatttccttccagttcgactccaaagggcctgtttcatcttcagcacctttacaatgtgccactttgagtctgtaggttctttctttcagaggccaccacagataatgggtacatcattatgttttcttgatatcactacattctttcttccccgtgcatctgcctcctgcagctctctgaagtggatttgactcctcatcatccctagtgataactaactctgctttaaaagaattgttatctgttggttggcttggagtcagggagttgagtgtaagttcttgttttattgtatataatgctagcaacttttaccagtgttagtaaagataagagataataagacaattccgtacctaagaattgtaccctttcataacagcaccacttggatatgtagaaagagtttgttgtgagatcagatgtaaaacaaataaaagttattcgtgaaatgatatggaagactgggattagaaactgtggcattcaagaagccagttaagctgattctcagaattgacagagattctagagatggtgtagtgcagatggtgtagtgcagggattctcagcctcactgcacatggtaatctcataggaaaattttagcaaggacagatgcagaaattcttattaaactgtcaggactgaagtccagaggtcactatattttaaaaaggtctgcaagtgattgtaacatgcatctatggaggaaaacatcagcgtaggagaaaaagggaaagaaaccaactggagtaaaggctctgtcttgagcactgtgctggctcctgtacattctccatctctttttatcttcatagtaagtgagatggtttgacaaatagggagaccgaagctctgccttcatgtgggacactcaactgcctccttccctgctgttggcagtgcttggatgaatatgcattgtatgcctcttctctcttccaagaagactggtttctctgattactttgcattttaccctggatagagatggtcttaccctcttttgagcttcaaaaaatcaggcttcaggctaattccaacctggtgaatctttctcagcaattctacccccataaaacaatctttacattttaaatttctattcatttttctaactattcataagattttcgtatgaagagttctggttcagaaacacagagaaaatccttaccgtgcctctcacatggttacttggttaggtgtgtttcaactcatcattctgccaaccgtaaatagctgagtccatatcacatgggaaatgtaggtgcaaattcacaaaacactcacgggctgtaaacaaccagggagttgttcttctcatggacctgcaggttgcagcagcagcatctgagcaaaacagagctgttctgagcagtagggcggggagcagcacgtctttgtgtggaccagaatgcaccagcctgtgggtgtatcatctcacactctacttcctagactaaggccctttcttgggcctttcagtgaatccaacccaggttggtattttgtgttgtcccccaacccaaacaaaaaattcatttgcacttaaggaagaacaagagtgacttgattaaggtatcaagttggtaaaaatggaaaaacaatttgatttagagagttaatgaacgaacatctttctttgattcttttcattaacattacacatattaggtaaactgtgtataggtgtttatttttctttatggaagtcacacatgatctatatagaaaaaatttcaaatacatcaaaaaaaaaaaaggaaaagaaagatacttgtaatcccaccacttcagaagcaccactttggtgtatttcttccacatggtggtaggggatggcagggggaaatgtgtaccagtattttaaacatatgagcatttttacttaaaagtatatattgaacatttttcactgttgactgcatagtatctccatgcatgaacatactcaagttcatttaacccatcccttaccattagatatttatgttgtttctaatttttctttccagcttttataaataatacttcaaaggccatccttgtagctagttctaattagtacagtatagtttggatgatataaaaatttcatatatgtgtgacaaggaataacaagttgaagtacagtaagaaagaatgtaattgcttgtgataaatataggcttagcttcaaaatagctagcttaaaatttcccttatagtgtactttaaagatttcactgatgatcttggaggtgaggcatctagccattgctggaatgaaataacacacgatgttcaaagtttggttggtaattgacttagtgcatatttttgctactttcatataccacttatctcatatgaaaagagcaattctgtacacaagtaatacataaacaaaaattttaagaatatgtaactccataaaatgagatttgatgattgacttgagtttctaagagaaaaaaataataactttcatctaagtttacgtgttcgctggcagtttttgaatcgttgccagaatcatgaaattcatcattcaagagcctttgtcctcctagtccccgttctgttctgtgtctcctcatttggatacgttctgtgtctcctcatttggatacgttctgtgtctcctcatttggatacgaatgcttttcattttattactgcctttgtgcccttggctttgagtcctgtggtggcagttgtttgtgcttcaaggagcatttgtaatttcagtgtgaggacttggggaggtcaacagaaatctctggtctttgccctccttcagcctccacattaaggacatagggcttcttcctaggcagtaactgtattttgattcatacttgtaatccctaaccgttttgattgatgggacaagggctgaaactacattctcttgaggatagaatatttttatccttgagaataatcattcatctcttcctgacccaccttaccatttctttgctttgatcctaaatcttttttgttctttttag

SEQ ID NO: 126 - DNA, 22742 bp, Homo sapiens
  source 1..22742: mol_type = genomic DNA
gtaggaaagggcggccggcgtcggggcgcggggcgcagagcctgggataacggcgcaggaacggccagagccccgagccgctgccgcgagccgggccgggtggggggcggacacctcgagattcaagcccccgcgccgcaccttccctgagccacatgaaggagcagaggcgccgctcggaccccgacgtgcgcccaggccatccgtcccctgggacactcgggaggcaggagggctggaacagaggcgagagttgcatgccccttccctcccgcggtgccccactggccccgcaagttggcactggattctgctggagccgtcgaagctccctattcattccccagggcatggaggggacgcggagtgaatgacacgagcagcgttggggggccgtgcgccactttcccaatcctggggtcagctgagccgagttagagctatgcccctcatttgttctctgcgggctacggcggggtcgggtgcgacttgaggatgggacgtctctgggacagcccgagctctcagaaacgttggcttaaaagcacaccggggcttgggctgagtgcaccggagctaagcctagtgcaccagagctcgcgccgcgctctcccagccccgactttctccaagagatgtggggtgcgggcggtcccttagagggctggaggacggtgcctccttgctgcttcgggaactgcgctccccttcttgcttttggtctctgcgtgtactccccggcgcgacaccgctcaccacggtagcctcgggcagtgcccattgggttctgagcacacgtccccacgggtggcacccacagatgtcctgttctaggcttggctcggtcttcagacaagaaactcagaccgggcagtcccctattgaggctctgagctaatatcctcccaaaatagacatgaaccacaaggagaattttttaaaagccaaatgataacaccacgttctttccggatgtggggctggagcgctcattccctttcccaggaagctcagccttatccccatgaagagctgggggggcggggagggcgggaataaaatggctcctgagatttgtgacaccccaaaaatcagagacggtatcagactgagtggcattgggggtctacctttgtttttctatgacacacaaggtgggtgtttggcaagagagtagggatgttgggtgctggatagtgcctagattctgtgtctttgggaactttgggggaagtgtcctcctaagggagccaaaaaggctgctaccccagtcccccaaattccaaaacaaaagaggtcagtgaaagctactcgcattttgcatgttatctctttatctttggagcacattgggaaggactgacccagctccagatcagggtctgattggggcaggacagaccctctccaaggcagagaaggggaaaaagaacttgcccttagaagtgggagtccctgggggagtgggacagaccttttcccagagcagccctggcaaaatggctgagcctcccttgagcctcagaaataaatcgtcaggcaggcagcaaacaaagaaagagctctgtctccagccaagcactggctcagtggccagtccttggaggacaaacagtgagtcccaagcagagagacgcagcccggcctgtctggcagagcatctggaaagtggggttcccctaggaacacacaggagagaggcagccactctggaggtaaaatcagggaccctctgtcctgatgtgggacactttatttcaggtctggaggcttgatgagaagtgggtctccaggaacttagatggggctgggaaggatgtctggagaccaaggagtaggtagcttagagggtaaagatgaggcaaaatcaagtccatcgaagccaaaagatgcacagtggccacgtctctcctgcctgccacggattttacatgcctggtgaccccggagcagcagaggctataaatttttttacacgtggcccagcacacagcaggacctcaataaacctcttagaataaagcctgcatggatggaaggtgatgctatcactggcatggacctacctgcaatctgtacctgtctcactgagccaggaaggctataaaatgtggccccttagtccatagccgggaatgaacgagccccagatgagggtttgctttgagctggggcattgccatttctggccaggtgaccttgggtacgttcttgttcctgttggaaggaaggaatggagtacccaaagcttccaatgtgccagggattattcctacaagaaccgtgtggagcaggcactattctaatccccacttcagaggcgatgaaactggatgcagagaggggaagtgacttgtcaaaggtcacatagccaggaggaggaagggcagggatcttaaccctactgttctaatttccaggccaactctgtcctattgtgggtctctgggcctcggtttttccatctgtaaagtgaagtgatggggtggtagttcccgtgggcctgccatgggagcagtggctggtcctctaccttggtggcatatgacatgtggagagcaccatgaaataaataaagcaccaatatcaggccacttcttgccatcacacaaagactccattccttggcttggctgtgagctcagcagctgagatagagttccatgctacttggaatttggagatgtcttttccaccctcttgcttgtctatgggtctcaggcagagtgttaatgaccgttgattcagccttgccaccacctttagccacctgcatcctgaagtccatctcctttgtccttagaagcccatccctgttgcctagcccaaaatgtgcccaccttccccttgactaccacccccgccccagcagcccctctcctcagccacagccccaatgccaaacccagttagagccacttcatcccctctctgcccaaatgaaaactaaaatgcaagcgtcagcaggcctgtctatgcctgtgtcgggactaccccttcaattcacccatgcaacgtcgcctgagcttctctgtgcctggagaatggtgggcagggtatagccccgctgaatgacagcaacctcgaattgacttcagttgccaagagcattgggcacttcccccacaaggtgaaaagatcatcctgtgtccactgctctgtggcttggcatgcctcgatgctggcttctcagacaggccctgcacgggtggctcttcttgccaactttaccccattctctgaagggcactgggagatggaggggaagaggttggtgcttgaaaaagaaaagattgggaggccagatgtgcaccccaaaataggacttcccaggaaatgggtctcagtgagcatattaacatccagcatcttcatctactccatgctcacctaagacctctggggtcaggggaaggggctatggagtcagtgggaagtgggccagtagcagacaggagagttgcctggcataggcagtaggtgtgaatgcaagctgtgatatttcagcagagacctggaattcagtcataaacagaaaagaaagaaaacactaaatattgttccaatgcaattgtatcaaaaacagtaataactgtcagttactgcatgttggcaatatgccagggactgtgctgtgtgctttatatcgttgcagttaattttcacaaaaccctgtgagatacgtagcataatgatccctgtcagggtgaggaaactgaggaggagaggggctaaagcacttgctgcaggatcactgggctggtaaatagccttaaagcccaaactcagtcacagcatgcttaaatctctgccactaaaagcccctgacactgcttacttggcaatgaccatgagcgccccccgctgcctccaccccagttaaggagctgcacagtttacaaagcacttcttcatccattccatctgtggagctttgccacagctctgggaggctgggtggcatgatagcttctgcgtgataactggggaagctgacttgcagagagatgaatttgtgcccaaggtccctcagctgctaggttgcagaactggggttcaaattgagatgtccagcctgttacaacatatttgggacctagattttaaattcatttgcagctagtgctgatgtcatgcactcagccacctttccctaactctcgggtatcccccaattttgtccccaccatcttactgctcaggaagctattgagagtgccctgacaaagccatcagctgcatttaccgtgatctgacatgacacagaagtggcatccgattctatgcaagctgcctgcagcgaatggtcttctatttttacatttctcacaaattggaaattacaaggaggccaggtcttgcagcgagattggctgtggtgctctgaaagcaggggatgtacaactaggtggaacaggccactttaggatgccaggggcactgttggctgtgaaaggggccccctggctgctggggctggatgggatcctggcacacaggccaggcttggggatgcaggagttagtgactgccttggacggtgacctgcagctctgcccacctgtcagctgcctggtgtctgcaagttctgtgtctcacgccagctcctgagataactgagccctggccagagggacattcaaggtcaaagatgccctgaaacatcgacagcaggttgctttcatggctgtgtagtttgataaggagattctgtgcagggagagggcagcagccacagggaggtgagcaaagacatttggtatcagtgttgcggtttgctgcaacttagcgctgatcacgatactcccggtcatcagaaccgcactttatactttgctaaaaatgctcttgcagctgctttttcttttgatcatgtatgaagtattccaggggaagaaaatatggtccttgagatcctggagaagaatcctctctccaataaagagtgatttttttaaagctagttttcttataaagcccaaatcagaatgaccttgacccaaatgaggctcctttgcacacatgtgcgtacatgcacacgttaacacttatgtagaatttcagttttcaaagtgttttctcagtcgaagcttgtgacagccctgggaacttcaagtgaaggtaattttattgttattattggtaccattattatccccatccaaaagatgaacctgaggctcagtgagccctgactcctcatctctgtcccctagtttcccagctgatgaaaatcacctttgctaggctgaaatccaagttcaccaggtagccccttgagaaggagcccagatgaggccagatctggtaggaggcagagcacagagcactcaaagatcgagacttacaagagagcgtgggaaggcacggctgtgaggctggggagaaaagggccgtagcatcttgtaaccttacctgagctctggccagagattaacatctccttggttatgcgcagagtttggggtccaaagtgtgatcatttggccggggggtcccagcagtaaccaggcctggagggagaggaagggatggttgctctcacacacctatgtgcacacaagaatgcttttctcggtgaattgggggagaaatgaacaccagggaccccatgagatttcatagaaggatctaaaggtcttggtagccaggaaggttgtggggagtgtttgtatgtgagcctcagctcagacccactggaggagcaggctgtgtgcttctgagccatgcccaggcaagagggcagggatcactcacctctgcctttggactgttgccatgctggagattgtgaaatatcatgagttctaggagcttccctctggggtgcagggggaggcaagagacctgagggtttgacagttccctggctggatggtggggagagaacttgtccagctgggccctgacagtgagttcagagggcctgctgggcactggtccctgagccaaggctgatactggatgataggtgctactctctccttctgccagagaggaccctgagcccaagggtggtggagtcacttgccacagggtgcacagaccaagtttggtcccaggtcttggtgatgccaacctcatgctgcttctgaaaagcacctgagacaagataactgttggggagccaggggctttttctctgtattcgccatttctggctgtgccatgcaagggctgagaaaaagtgaaagcaatacaaaataaaagtggccaaaagcaaaagctaccagcttcctgggcaccgtctgagctgccagcctgcaatccaggcttcactgccgcctgagctgaccaagcccctttccgcccaagtcagatgtttccagagcttaagatccaggacccacctatgattaaaaaaataataataaaaagtaggcctggggagagagaagaagtcatcttactgaagagtatttttgaaagatggaatttaaatgcacgcatgtattacatatgcatttttagcaggttggttcagcataatgacacagaatgatctgatatgtacatctctcagtcttgggctctgcctgtgacctaggcactgagccagtacttcacaagcattgtcccaggatcctcaataaggaaactgaggctcagggagctcaagaagttgcccaaggtcataccactgacacagggcagagctgggaatcagatccaaagctgcagggctccgaggcttgggcttgcagacctgagaaagaagtgggagagccgccttctgctgggcctcaagcctgtgggggaccgtgggcaggttctttcccctcttggctttgcatgctcagttcatacagccaagaggtttggaccattggataggatgatcggctgctccccgcaccaggcgccagttctccaggcaaggggagggaagttgcacgccccacttcctcctctcctcctccatttcccccataatagcctccccgagactaatgactgaggaagataagagccctttctccaaatggcagtgaatgccactaatgacagagcagatgcagcactgttaattattccacgggtattaaatgaaaacgccagccctggaggagttaaatagcaccactgatctggcaacgtctgtgcttaaaagtgatgccatcaaaccgggccggggcagagcagccccctccccaaacttggagctagacaggagtcacaaagtaagggtcccctcattggtcacagacccctcttcagctcagggtccgaagcagctccttggagacatggatcggtggctgctttgggagattttcttaaaggcccctggggggcctagactagttatccttaggggcagatgtggacaaacaattggaccgaataaaactctgagcacctactgtgtgccaggtcctattttggattgtagaaagaaactggatgctgttcctgccctttgaagatccacttgcattgaaaaccgtagattccttaagagcaggaatgctgtgttgtttggagtctctggtcccatagtcaagaacacagagtgggtacctctgtattactttgattatctgctggttccttgaatgagagccagaggccacacagattgtggccagagtgagatcggtgggcagagggactgggccagggtcaggctgtcttcttcaggtacaagcaacatgaccttcctggacagcttagccccaggttctgaaacaagccatgacctggatgaagagccgggttttccacttgctgaggcaccacaggcgactcctttgccctctctgagcctcagtttgcacatctgcaaaatggggaggataagggccatgatggctgcaggcaaaacaactgtctcctaaccaatcctggccctgaatctggaggatcacagagacctcatgaatgtttgaagagtgacattctggaggaaattcagcagagagagagagtgtagtcaccaaaggcagcatctggttcttcctgtgggtctcactcaaatctcactccaacccccaattcatctccagcagctcaggtcacttgttcccagcttcctggacctggaaagctgtttctcaggtctttgtaggctagagaacatcacaaaacccacccatttcagacacacctgtgttatagatgggtaaactgaggcctagagaggaagagtcctaggtcttgcagaggctaggacccagagcttctaacccctaacccagtgctctttcccttccaccaagccagcccagctcctccgttaagaaattattaaatagagttggtggaaggactctggttgccgtgacaacggagcctgtgtcctcgggagataatggcgttgcacaaggcagagcgatgtgtgttgaatgctgattcaggacctgctagagtgagagtgagtacaagaggagagtggaggggaccgtgtctagaactcgagcttccccaagaaggaggtgcgggactggtaggggtggggcaaattgccttctctacttccatccttcctacagccttgtcagaatgggatacttccctgcacttcgtggaggtgcagagtcaggtgaggagaggtgaagtgactcatcccaggtcacacaaccaggaaagagccagagctgggattatacctccaaccaacacgggggcctaggctatagggagggcctggaaggaggctcacctgcaggggcaggggatggttgatggagacctctctaaagtcttaagtgcttgtggaggtcctgatggtccaggaatgacaattccagcccaagaggaagagaaaacagaatgtcagcatagctaaaagcatcagctttggagccaaagtcacatctctccctgccacttactaaactgtgtaatcctggatgagtcactttctctctgagcctcagtgtcctcatctgcaaaatggggataatgccggcacctacctcataggattgtggtgagactgcatatcatgaggaagataaagcatcgagccccaatcctggccatagctcaatcaccagcagctgttgttatgaaccaaaggggagaggctgggaaaaggatccactcccaaccatgtatcagcttgtaatttgtggtgttggaagagcgaaactggctaacacagtacaagcatgatacataacagggctcttcattccaggctagtaaatatcactagaacaaatgaacagctccatcaccaaaaatatacataaatattttgcatttgaagagtgtgaatgttgtacctcactgcaaatgtactgtccttaaaaacctccatgcacacctcactgagggaatgtgtgttttctctgtgccagctatctaaatgaccccatgctgcaaacgcttttggaaaataaacactctcacccacccacctagtttctcttctagaagcacagctggttcagtgtacttacctccctaatcagggattggagaacatggggttaataccctgtgaaaccccaaagtgcatcatttgcatgctggcaaagatgcaggctggcagacaaccccattccattttggaagcggaaagagggtgctggactcaggcatttggctgtttgaaaagcgctggtaagagctgggatcctgatgattgagatgcaagcaaccattttgtttgtttccgcaaacctgtttgagcaaatccacccccagagatagcaacctgtttctgggtcccctgagagagagggtcatttgtttgctgctgtttctggggctggatgccaagctatgaggcaatgagctgacgaccttggatcctgacacccctattctatgcaggcaggagaagggtcagggagactgattcagtgaacaaataaagacggttgacatttaaccaggattttaatgggtgtgccaaattgcaagatacatacacatgtccactttgggaatcatgtttaataaacaatttgccctaagaatttgattcaatcagcatctcccagtgactcccaccattcctttatattgattgcctataggttaagataacactgggcctggcgcagtggctcacgcttgtaatcctagcattttgggaggctgaggcaggcggatcatgaggtcaggagatcgagaccatcctggctaacacggtgaaaccccgtctctactaaaaatacaaaaaaattagccaggtatggtggcaggcacctgtagtcccagctactcgggaggctgagggaggagaatggcatgaacccgggaggcagagcttgcagtgagctgagattgcgccactgcactccagcctgggcgacagagcaagactccgcctcaacaacaacaacaaaaaaagataacactggcctgccttccacccaggactttttcccatcactaactaaaaatataaatgaaagccctgatcaggtggtttattataatatctgccaggtatcaagcatttactatgtcctagatgctgtactaactacatatttccccatttaatcctcatagcagccctagaagtaggtgttatcacttctgttttagacagagagagtagatgactaacctacagtcacacagcattgaaccagagctgaaactcaaaactgggtgtccttgcccctagggaaggacaaattttctttaagtcccacgaacaatgggcatacttatgaagagctgctgcttgggatatcatagagtgatcagaagtttgtttgtcaggagccatgataggggcaggcagaagagggcattgctcattgttcatgggacttaaagaaaatttgttcaataaaaatctgatttttagccagacatggtggcacatgcctgtagtcccagctacgtagggggctgaggtgggaggattgcttgagcctgagagacagaggttacaatgagccgagatcatgccactgcactgcagcctaggtgacagagtgagaccctgtctcagaaaaaaaaaaagaatctgatgttaccaaatgggtagactgttcttgctacataggagtttccactttacaaaaacaaggggctctataccataaaattcctttccacagctaagtgagtgagtcaagaacagatgcactggtgaacgtgagcattcaagtcttttaaaaataaaattagcctttatattgtgggaaaatattttagaccctggaatctgacccttaattgactctgaaaatacacgcctccctcattcttgcagactattctaaagcagagtctctctgcggttttttaaatccaactgagcttttattaagagaccaataggatttgttgtttcccaaatataaaactataacaccaaacatgctttttcaaacttcaccacccccaagagtttgacatatcccccaggaaaggggcaatattaaccctcatccatcttccactgcttagagaaagagttctactgagtgactaagattgtaccgtgtatacaaggattgcaaattcaggggccattgagggccagacaggtcacagaaatgagtaaagaggtcagcgataggatgacagtaatggtgggacttgtagtaaactagaaaacacatcaccacttcccttctccaaagcatgcaagttcaatttctaaaattcaaatctgataccactcaatcaagcatagctgtgggacccattcggctcaaaaccaccacgttgagatccctggtggttcttattgtgaccttgtgtgatcttgatccagacagtttctctttggggctcagtctgattgtctctagaaggggctgatagagcctgcagagctgctgagagagaaatgcagtcccaggtgtggacacttaataaggagccatggcgctgtctgcagccactgtcacggatatgccttctgcgaccctaagccagctctctgtttgggctgtgctcctgcacgtcacttatttagttcatcgtttagttcagccagcccttgcagtgttattttttcttttccccaaatctgaatgcttaaagggcctttatcttaatgcccgtcggagccttccaagcacatcttgaacaggaatgaacagctattttaaccccacgggcttcttacaagtgtgttttaaaaggcaaagagcgatgtaaaagaatggcaaaaggtcatcgtgccgctcttatttcctggtctaagtcagtcctttctggccggttgagcacagggcttttacagaggcgtcccctggaactgaagtcctccagaaagccccacacccctcagaggcaggaggaagaaaggagcctggaacaggtggtgagggtgcagagggtgggcacccggacctgttccacaggggctcgccctcgtgcccagcacagggttgggtgctcaagctggcaatgggagacagctgccctgagtggaaggttgagactaatgggctggcccccagcaaatacagtcagaaccaactgaaggaagtcagtggaacaggccctgcagcctgggttcaaaaatcccggctcctcagccgcttttgaccttggcctccgccaacctcaggcttctcttggctgaaaggtaggctccttccctccctccttgggttcagtgagcgacacagtggagccttgcccagctcacaagcagtgaatggcgcatctgttttctcttctgtccttccttccttctgcccttatttttcctctttcccctttctgatcccttcctgcgctcctcctttcttcctcctgttttcctcctcatcactctgctcctttaccccagcctcctccttgtctgtttctctcctcctctccttccatacccttttctctcctttcccctccttcccaccctcctctctctccatccctctccactctttcaaatccacccagggagatgcctctgagttcctgtgtctgatcccagggttcgatgttcctcatcctgcagcagacgtctctgcgggcacccaccagccccagcatgcgctccagggccagcccaggggttgacatccagggctttccttacaggaagcaatcaagagagtttccagcattaaaccactcaggaagcaaggccagtttctgcccgagagcatgcctcactggccccacaagaagaaacaggcctaaggctcagtggtgtgctggagcctgctcacagatggcacatacccaatcctatgacctcatattagtaccttgcacaggccacagtgggagtgtttacaccacagaaatcagcagatgctgcaaattgagtcttctgttttgtttcctgagagcccattgttaaagcttaccagcacaccattgctctgtagacctgccaccttctcccaagcaaacgtttctgtgctgaggccttgtaagaacaatgtcctctgccatagagggcagaacccagaagagcgcatgcatatctagcactgttcaagctgcctgctgtcggggaagcagagcgggtggaagacctgggccccgttcttgcataggtgacagtgcagctgggaagctaagagagaagaatccgtaattagtcacgagagaagccatgttgtatagggcgaccaggccttcctcctcgcccccaccatggtcctggttcaggcgctgtcccttatccttgcaccatccctgttacagcaacctccacccatgctccctctcctctcctcctccccacacagctgctgggcggtcttgccaagtcaccatcacatcaaatctccccatcttccacggttcaggtggcagccctggtgaccaccccatgcccacagtggagagggatagttaagaacatgggctttggaatcaaactgcagtgtctgggagctgggaagttgttttactgtctgaacttcgccttcctcatctgtacagtgtgcagtacagaaatgcagtaaatatattaagcacttcctcagccttcggtgtgatcatcattcttattacagggtaagatgcgccctcttttcctgcatcagagctctttactactactggcggcttcctggccacgttcccctaaatcaccccagattctagcccccaacaagcctcctcactgtctccaaatgtgttctgtattttggctttgttctatctgcctggaatggaccaggagtggttagggttgcagttaaaagcaaggagtccggtcctgctcctctagctgtgattatttgaaaaatatccccacttctgctcccttttccaccaaccgcaatgctacccctcccagttgcctgcctgaacccagaccccggggcagggtgccacctctccttctctgcgtgctgtggaagaacttaccccgtggatgtggattgtccatggcccatctcccagctgtcccgagagctcagtggcagcaggactcagactccaacttgcatctttgtccctcagcacccagcatgaggcccggctccccggaggtgcacagtcgatgcggatcagattgaaaattgccttgacaaaatgaagttctcagttgggcactacagataattaggggccagaacagacgttagtaaaccactgatcgtgtgagcgagacaagcaggactggatcagagtgaagtggagctggaaattggagtctgactgtcctgcttgcacacagaagaaagctgaggcacagagaggggaagggactggcataaggtcacacagctagtaagtttagagagagatttcaaacctgtgtctactggacttcagggcgtcaagctaactgcccttcctcctcaggtcagctcctcgcagcagctgcaaggcacgagccatgtctgcagttggaggagagctggggtctccaagaggggagtgctgcccctagaggctggctgcctcctggggactctgattagagcctgcagccccacagctcagccagaatcccacgtgacctcccggggtctccctggatacctgtaggctttgtccagcgcaaccgtagaagccattttggagccagaactcagaggctctcatgctagcagcctctcttgggtttcttaaaaagaacagcaggccttgtccttgtggaggtttgtcctggagggaggtggctgctggggacgggccatacttgtacaccccaaatggagggtttggggggttccacaggtaccccattagagacagcagagtggttaagagtttggacacaggagcccagctgcctgggtcaaggcttggcatccttagctcctaactgggagacctttggcacgtcactttaacctctctgtgcctcagtttacccatcaataaaatgggggctaaaagcaattgaatagacagaaagcatttagagtggccccggcacattagtaagtgtgtccagctcacttcctccctgtactgagctcttctttttctttcaccccttgttaatgaaaagttggggaatttttcttttctgtaggcggctgcagaaggagaaccatcctcctggaatctgtttcaccattggatgggtctgtcatattccagtagtcgcaaagttgaatttgttctcgcctgggttgtcggggtggggatgccctctggccttcttccacattgtggtttcagaggtgtcctagaaaacctgacttctaggctctcagaggctgagagcagaggggaagggctagagcttccatttattcatctgtcctaggacagtgaggctaggcaaactcatctccatgcagtcacatttctctccctctggcatccagcagccatgcttgggcagatcagatcatgaggcctgataggtctaatggtttcagggaatttcacacaggccagcgcctgggaggcactttctggacaagcaaatagcaccagactataactcagagggcctgggtcaagtcctgtgtgaccttgggtaggccatttgacgtctctgggccttagtgccatcatctgcaaaatgggaccaatgatcagtttagcgtcaatgtatttagctcttgctgaactgggcacggtgctagaaaattcaaatccagtcatcacagagtgggaagtgcttactattgacctcctttattgatgaagaaacaaaaacttttttttttttgagacgaagtctcgctctgtcatccaggctggagtgcagtggcgcgatctcagctcactgcaagctctgcctcccgggttcatgccattctcctgcctcagcctcccgagtggctgggactacagacacccaccaccatgcccagctaatttttcgtattttttagtagagacgggttttcaccgtgttagccaggatggtctcgatctcctgacctagtgatccgcccgcctcggcctcccaaagtgctgggattacaggcgtgagccaccgcgcccggccaaaacaaaaactttgagaaaataagtagcttacttgaaaatcacagtgggatgttgtgaacagtaggcacgcgataaatactactgacaaagacacctgcttctgcaaattccctctcaggtacgttgaggcagctgaggggtttataccaaggcatgaaactgctttcctccatctcttgagtaagagtatgcggctggctgggagttgggagtccataaggttcaggccactctcaggctgtgtgaccttgggccagccaccagtccttgctgggtttttttcttcatctatagaatgccatggtagaccaggtgcaccagtttggcatgcagcaagtctggaccaggaaggagaccagctgggtcgtggccctaagcaccactgtgcatggggctgaggtccaagaagggaggcctcccatttagaccccaagctgtcccaaccagctcatttctcctgtagcctgcatcccaccacaggcctggctggcctctgaggtcttgttaaaatgctgggccttggagaccctctctggcggctccctttccattagagcaccttctccagggagctttccctgacctccaggacagcgcgtggcaagcactgcccacagcaccggctgtcccacacaattccaacctccctctaaccttctgtacctgatcatccactattaattggtcttcacatttgtataacatttttcaattacaaagcacttttgcggccattcatctctttgagtggcagcctaagctgctatttattgacacttcctgtgtgccaggcccttggctggcctctttccatgcattatcatgcaattctcagagcaattctgtgaaatccacatttacagatgagaaaattgggactcaagcaagccagatatgtagccctattacacagagatttgaacgaagtcccatgaaataatctgggtcattcctaacaacagcttctgaagctttcctatgtgcctaaatcacgggacctgtttaaaaatcagcttctcgttccacaggtcttgagtggggcccaagattctgcatttctgacaggctcccaggtgatgctgatgctgtctcttgaagaaccgcactttgagaagcaaggccctgaatcactgggcaatttgagaccccaggctggcaaggctgtttccttatctgtcagatgggtgaggtagccctggcttacatagatggaatgactcccggatgatatagtgcctgtgaaatgcctggcacacaataggcgctcaataaatgctagctcttctccttcgataggagctggcatgagtctgggtacacaacggatgctcaataaagccttgtccaatggattgagcctagcatttttcccgaaggcagagaataaactgtattatgtttccccttggaatgaagccaaactcaatattaatttctttcttaaaccacagagtttcaaaaagaaataaaggcaaactagagtgattgcagtctgaagcgagcctctgtaatttctgtaattacagaacgagagcaaagcaaagcaggcatgagcacagtctcatggagggagtggggtggggatagggggaggggaagagcaggccctactcccagacccactactccccgtcctcgattccctggcttttcagggctccccactcactccatggcggggccatggcctgggacaatggcagccctgagactccagccctggcctctcggtctctgcctaggtccccaccccacgcagccgcctgtccctctgatgcagtgggacagagggagattgtccaaggcggtttccacacacttccctcccccttgcctgccatctggtccagggctgggctgctcacagccaatcatccagcaaggcccatggcccacgggccccacccccagaatagatcctgggtgtcggtgacacttcccccaacttctgcccatccagccacccccatgcaagccaccatcatctctctggactggcagcctctgatcatgtatccctgcttcccccttgcccctatgcagccttttctgggcagccagagggagactcttaaactaaccgtaagtcagatctcccaccacttcaacccccacttcctcccatcccacttagaatgaaacctgaatccttgctgtgacctctgagacctgtgtgacctggcccctgcccaccacctctgcctgaatccatttcctctcacactggactccaaccaccttgggcaccttggtgtctttcaaaagtgccaggctccttcctgcctcagggcctttgcacttgctgctccctctgtttgaaatactgtatcccagagagtcccatttctggctcctaattcagactgaattttttttttttttttttttttttttttgctcaggccaaataaaacaagcccaagggccagttttgacccattttgccacttctgatgtagagcttccaaactgtacatgttttctttccctacaaagcatcttgtcattcagagattggcagaggaattctttgtgcttggtttggccccatttttatcaatggctttaacacttggtcatagagcatccactgaggaaggatgggatatcctgggaatgttttaccatcttcctgcctggagtgtctttcactaactccgtccttcccagaggccccatgagcgagtcatcttctggtttacgaatctgatcccattatcagccctgccccatccctgcagctagtccccaggttccttagtccggtgtccaagacccttcatatactgaccttcctagcttcacactgtatactttagtacatgtgtttccctccacttggaacgccttttctctctttttaaacctgatgaacacctattcaaccttcaaagccttgctcaaaggacgcctcgcctaggatactttctctggctgtattaatgcgtttcttctaggcctcccgtgtcttgttcttacacctcttgcagcacttatcacagggtattatgatcagctataggcagaaatatttctccttctaggccatgaccttgacaagggcaagggtcttgtcttatgaaattctcacaccctgagtgtccaccccagctccacccacataggaggcctcagtaaggatttacagaaatgaatctttctgctggaacctgttagttcactgattcggattctggtgaccagggtgtagttcagaatacaaaatgcttgaagagacggctccattgtcgtttcagcacatagcatgtgctcagtaaatacttgcagaatgaatgtgttagtgagtgagtacagaggacctgacatgtcatcactggtggtctcacgttaatagtgccctttgaacgtggctttggtggaattaagttaatcgtggtatagtatgcacctgaaggaatgtggagccgcatgctgggtctgcagaatgttgtcacctgatgaagaagaactggaagacgctggaagaaggctttggaaaaatgcccagatcatgagaaggtgagaggtgtttcttccgcctgctccaccagcaggtaaaggaggctgatcacaggctggcactcagggcgaggtggaagaaatgcgtggtcttgccactacagacccgcagagctgtcctccaacatgatccaagagagccacaaaacacaggggtgtgtcttgggaaaggaaaagtaacaacttgcaaaaaggttggttctgcttcagagaaatgttctagaaagacagccaagttaccctgccgtgaactcacacacacctgtgctttctgcatgttatgtttcataggagagggaagtgccgggaattaaaattgcggatgcactgttccccaggtgtgtgggtgaggcacgcttcctgggaccactccatttaagcattgggtcccaggcatgttcactactagcaggaggctctttatcaatttcctcccgtggaccagatgattgggatttttttttctaccagactttattacagaataactatttttgtattaactaagcaaacaaatgtaccgctcccagcttctgactggcccaaggtgctgagctagacctctttgctttggtacaaagagagcccaaagccaagagacttggcatttctgttagctggtattccccagggtgactaaaaggatgatttccattggattttttaaaatgctgaagacactgaaagacctgaatagtaagcccgtaataaacgttattcggtattattattgttgttgttgtagccttctgggaagttgcgaatgccaaattaagaacaatggacccatacccagatggtggcgattgcagtgataacaatggctgagatttcctaagccctaactatatgccaggcatagttgtacatgctttacacacatgatctcatttaatcatcaccataaccctcggaaggagttattattatcttcccattttatagatgagggtcagagaggtgaagtaactcacccagcattagtaggtgttggagggagccgaggtctgtctgactcagcaccagggtggctttgctgctgtgtaagtcaaagagccttctccgttctaaatcctcaaagaagtatgagttatatcaattcatggctttactttgtttatcttcatatgtgccacatcttctaaaaggaaaactccaaatatagtcatgtggctcctcctagggaattataggcatttggctgaatctgaatacatatccccgtattccagaaattggaaatcacatgtatgtctgctttatggtgaggtcttcagagcagccaccgtctctgatcgttcagggcttggcatgaggaggtgctcaatatagtcatggagaagaactcatggactgaacttcctggtgaaccagagggatggtgcagagatttaagattgcaacaggaacccccaagccaatgtaagcaaaacatctatttcatgactatgggaatgttttgtaaaatccaagcaccagcctgaagaaagcctggaactgcaaactaggagctttgagacactctatcttttgatgtctagttttctccttcctcagcagaccaaatctcactctgagtacaagatgggcagaggatggctgccccagagtccccaagtcactagcaaaactgcccttcttcctgggtcccatgccaaattccagagaaggaatttgattggctagcctgggtcaggtggtcagtcctgattcaaggtgattggatcattttgaacaaatatggcagctggagcccacaagggtagatcatgggaccgttaagggcatcattgttaccagagttaatggctgaggctgctctctcctgcgtatcccaagagtccctggtagaccacagaatcggccgcctcctactatcctgccattctccagaaggggaggcaggcaccctactgagtccagagctctctctaacattgccatgcccaggccaggatctagatgggcatccaagaccagcctgtgtgccgtgaaggagttcaaagtgagcaggccatccctgagaacgaggagcaggggtgttaggaaagtttggattatctgaagatggcctggttctccgtgaactctgggaggagatgatggtgtttggtaatggggactgcatgcgaggggctggagggcgagtgcacagcagactgggcccccgccgggcaaagctgcggggaggaggccgcgtggggagggccagggccacgccgcaccttgctttggcgcagctcccagctctgagggaatgcagaccgcttcacatgttctggtttgttctgagggttccataagtttattttttgttatattattaatttaaatcagttttgtagagcattatagaaattaaaaaagcacaaagaagaaaacgaaagtcactcaaaaactaagcattgtaaccatctttgggtatatccttttttaaaatagatgtggggggtgggggcaaaatgggataattcgaaataaactgtctagaaacctgcctttctcaccccaaaacaaggtgctctttctcgtgttcttacgtggtctttttgttacatttccacaagtttggatggaggacagagaaaagtctcagcagcccctctgttggtttctcttttcttctgataaaattatggaatgtcttctccacgctgccctcatcccacgcccacagctgtcccgagggcagcgggccccactcctgcatgttcccagcaccccaagggccagtgccatgctgcatggtctcgctgcggccaccctggctggggacgctctgcgggacacgcgcacagcccagacgccctggcaggcttcctgcacccctgctgccctctgtaggagctgcctgcctgccccatcgctgcttcaccatccctcctctcctccccttctctgctttgcag

SEQ ID NO: 127 - DNA, 586 bp, Homo sapiens
  source 1..586: mol_type = genomic DNA
gtaagaccccttcttgtcagtgctttcaaatgacccttatagtaagccagagtctttttccctggaaggattccaaacagatttgatgaaagattcatatgcagagtactcctgtgggtgcttaaactttcacaaggatgacatgctatctcgttgaagacataatacaactttatggaaaaatgatttacttaatggaaacctccaaacttctttaagtttgtacccttcattaaaagtaggtcagggttaatattaagaggtactcttcccattgaaaatacatcttagaaataagaatttggaaagctgttaacctgtgtttgacccctgccaggagatcgtgccacaactaatgtctccagtcttgaatggaggtagtgcagtcttatgatatctgactggtgacatcaagcaaaatctcaaaagttatgagaaaaaatgtcatcaccaacctttgggtgaaaaccttgacctatgttaaagtttggtgtgttttatgatctgttcagcagttacttttctccagaggccaagcttgggactagtgtgcttaccaatgaagaactcttatcttccttcctag

SEQ ID NO: 128 - DNA, 1798 bp, Homo sapiens
  source 1..1798: mol_type = genomic DNA
gtaagctttggacaggatagatgccagctggggatgtggcaccaggagaattatttttctccaaatctagaaattcccttctccctgcctcaatcctctacctcaaggtggtggctgttgcagaggattctgtttcagagtattcaagagagagtgcagggggcccctgagctctggggctaactttctgaagtcactgtgcgctctagaacacagaaccagctcacaccatgagttactatctatatcaatatttctttttggatctccagtcctgtttttagttattctatcttggctggtcatggggaaaggcacttgtttatgccatgaatatggtagcaggaaagtccagagcctgctggaagggcagagaggcttaatctgcctaaatcctgggggtgattgttgctgctgtattgagttgtttattccttttctcatttcatgtcttgccctgtcctgcagactcttaacacagagagatttttgaaggaatttgaacctgcaaagtttgggctgtggcagactggaatgggctcgggggaggacaaggacaggcaaagggagctacagacccctcccctaacttcctgaaagaaaaaaataattgaacaaaatgtgacaaaatgccaaaagttcatgaaaacagttgaatttattttgaaacacaaattacaattatatttgttgtatgataatgtaaaatcacaattttaaaaagcaaagagcattatcagtgaccatgctgcttcaattggactattctgtaaaaagacctgccactaacatgcttgtaggcagcatgtcctcctccgcccatacctttgtcttactatgcctatgatttccttaaaatgaccctctattcactatatggagataattaagaaaactatggaaaaaaaaaaagagaagaggaggagggttttgggctgaataacactagctgacctgggtagaccgaataaaatggtattattactgagtccttcacatactattgtagattctatcaaaattcagaattccagggatgtcaggctgatttgctgaattgctgtttccaacatcaatggctaggtcttttgctgtcatatggtggtaataatccatcacctttgtctacaagtggacatccacaaagtggtcttctaagaactgttaaacacatcccagttttttttcttaccaagtaggaatttatcatatgataaggcagaaatttatctttgcagtatccatggagaaacagaggctgactaaagcaaataggtaaggagaaaagagacagataccatttgtttatgggtgctattttcaaggacttcagaatgcttcattgtaatagtatgaccattgcaaatcagttttctggtcattttgagcaaacctcctaagcatctttttctctcgatagcttgattgcaatcagtgtacatacttgaaaacagtagcaattaaattattctaattgagtattcccccaatctggtattccatatagatttgtgaggttttattctacaaatgaaaagacaaaagcaccagagcagaaatgtgtaagtggcacagaaatacacactttaatgtgtacattgtaacctggaaacatttcaaaagcctaattttcctcatattgggaaggatgaggccttgaagatggaattgcctctctgtttcactaagacgtagttttgaaaacctaaaattagttcacatcgcaataacaacaaccccggcttaaggaatgtaagagaatgccaacttaagtttcctggacgttttctcttctcag

SEQ ID NO: 129 - DNA, 2328 bp, Homo sapiens
  source 1..2328: mol_type = genomic DNA
gtcagtggttgaccagatagagtcagcattgcgtgagggtgtggagaaaacttgatttcctgctcattctttcctctatggtcttacaaaaaattggcatggtatcagacatagctgttatttgcaactgaaggttatgcttcctttgaagttgagcctgtgatagtcaggatatcaatacaaaggcaggagccatttaaacatcactgtcttgattcattgggatgagatactatagattcttggtcatatatggctaacttttgcggagcatcattgtttctcttaaagcagtgcttctccaaattgagtgtgcatcagaatcacctggaaggcttgtttaaaaacaggctgttgggccctaccccacaatttctgactcagtctagggcagggccagagaatctgcatttttcattagttttccagtgatgctatcttgtgggtttggggaccacattttgcaaaccacagtcttcataggttaactgtatataagttcctggggacactgttagaaatgcattcacttgggtttcttctactccttgactacatctgagtttcttgggtagcatatgaaaatctgtgttcttaagtggctttctcaatggttcctctgtacactcaggtttgcagagaaaaccactgacttaaggtcataagaactaaatcttttccagctttgttcatctcaagactgtttggtacctacccatctaataatatttgataatatcttcagagaaagcagcatgactagttcactggcaaattagctagctgtcttctcttctgcatgaaagagcagtttgtataagacttgactgtgaggctgcactattgattttacaaaatacaggcttggaatgtggtgcattaaagcagagaatatgatgaactattatcattgtgcagctccatcttaagagctctctaaggatgctggcagatttttctttttttttggaccacactattgaatctatgaattacctctaaatcttattaaatcatctctgctttctgcattgttaggaagactaacaaaacaaaatattatctatgattagaaacagcaatatgtttctttaaaaacaatacaaactacttgcaaaacagccacaaatcccttttctgttttgctactttagtcacagggagttttggggagcagtgaggatagtgagaggagaggggtgtagaatcttatgaaggcagtttttattgggatctattgtgagcctgattttctaccttgtgcccatgtgaagagggaaaatagcttaataaggcaccagggcagataaatcctgcaggcaaagcagtgcatccaaagaagggcagttactgaagtggacaacctcactataaagaactttaaaaaaatattcccaagatattgaccctccatgaggcttctgtagtatgaacagagcacttgacttatgagtaccattattccctcatgagatgattgtcacagtttctaagcatgagcagccatgtttatggccaccagcacctcactcctttccttgccacccaatgtgtgtttttttttttaaagcagccatagctcattgtccctgactcaagactgatcagtttatgcaccaaccaatagccttctcttcattctggtgcctgctgtgttctccctctggttaaagtgctagtggagagacaaggcaaaaagaatagaagcagatgcaactcagtttcctgattcccatgcaacttccataagataccatttggatttgatttgtttagctcaatcaaccagattgagactggtttgtaaaaaataagttacagttagtgaacaaagaggcatgcattattggtgatgtttcatggaaactttggttctattcctcagttgtctctggatggtagatttagctggaagagctaaaatctaaaagatgatacagctccacctctaccaagtcatttacctgaggatctgggagcttcaacaagaaaactttagagtagtggttctcatccaggggtgattttgcccatgggggcatttggcaatatctggatacatttttgattggctattggcatctagttagtagaggccaggatggctgcaaaacatcttaccatgcacaggacaggcccctgcaaaggaattatcagcccagtgtcaatagtgccaaggccgagaaactctactttagagtaatctctttggttgtatacagttgatggtgactgagggtagctgaaggttcttagggggcaggacgggacagctgattctgaaaaggtgtaacaaagaagaatcacaacccttgactttcttcccag

SEQ ID NO: 130 - DNA, 1465 bp, Homo sapiens
  source 1..1465: mol_type = genomic DNA
gtaaggaggcggcagcagtccgcgggagctggcgggagctgcgggccttacagtaacctcccaggcggtggctgccaggcgccagcagccatcttttagccgggcacgagcgcccgcccactcgcttcgtgcagcgctgtcgctggcctcttccgcccggagttggggggcggtatcacgtgatcgggggccttgcccgccttttagagaggggaataaacgagaaaatgttaaaaattgcttttttttttttttttttgccaactaaggagataggcgtacctccactggttttctttctagttgcaatgcaatattaatgcaggataaggtgctgtcgtgtccatttaaaagttaatttgaaaaacaatccacgttttaaatattacgtctggctctaaagctggaagaattaacgctttctcccccgctccctcccccacgcctccccgcatctgataccacacgatttagatggacgttcgcctgttcatctttgacgtaaaaataccacccactcttttatatgtgacaaatcgttgtgggaacccctgtaaatcgagccattcttcagaaacgtatagcgtaatgtatatctctaagaagaaatacgtgggacgcgttacccgccataatgtatcagtcaagcaacaagtgtttgttgagcgtgtctgatgttcttgaactgccgcgcgtgagatactaagccccgagcacggcagtttggtgggcgagcgtaccaggttcagctctagaatgtttggggcgctcacatttgaggcctgaggagtagaatctggcaacgggccgcttaggctctagacgttctttatacctcgcagttatcttaaaagagttttagtctagatttcagggagtgggaaggggaagagcggagaaaaacgtggtctgtttagggaggagtccaggccctgttttgttaggttgtcctgtttctccccagcctggaggggatccctctctgaagactttataggatactggttgggctctggtttgggatcccgttggactcctggtgttgcttccgggaggcgtacaacaggaggtgagagacttcaagtccatctaacaattcccctatctagacactaaagataatttcctaagtttccgcagagtttggtaaggttgaaacgacatcgaactagttctcgtgttttccgggtaagttaggggcgaacattcagtcagtgtccccagtggctgagtaccagtaacaagatggggagggtcgcgctgccctcctccggggtctggagcggcgggggaggggccgcatttgggccggtgcgctgagccccgcccccgaggccggcgtccatctgctgcgcatgcgtgaggaaggcgggtgttgtgttttgatgcgcgggagctggggggtgggtctcgctctctgccctgcttccgagctgccattggtgatgagccctttgcgtcacag

SEQ ID NO: 131 - DNA, 1057 bp, Homo sapiens
  source 1..1057: mol_type = genomic DNA
gtggggtgggggcaggagctccggggagcaccgggaacccagacaggcaggctcggcccactcagaagatggtaccttgggccccatctctgggggtcccgcagagactgccagaaccgtgttctctggtgattcgcagtggcgctcatccaccttccaccggagacaggtctgatttttccagacgtggtgcatcgtttaggccccagacaggaatatgcagtaggtgagccggggctgggccagtgctgtccacagtccgcagagtgacctgcaggccgccttcgtggcctgagtgggccccggcacagttcccagagggatgccagtgtggcttccgcatgactttggaggaccgcattagtcgagtctgttaaccacagctttaaggaggactccacggccacacgggctcatcagcataggggccctggggaggcgaggctagtatccagcagcctcagggctgtgccttttcctggagcctggggcgggtgatgtacaggaggccaggcagcagaagggaggccgggacttcgccgggacttagcagggactgaagtcctctcagagcctgtcgctgggccagagcattgcccccgaccgctggtggcagtggcagaggtcatagcctggggcttctaaaagaggctggacctgggagaggcaagaaaggcttgtagttgtggctactcttggccctcctgcccgagcttccttcttggcccagctgcatgggcacagccaagattccttggggggtggggtacgggcaggaacagcagctgccatcacagccactgtggccccttgagaggatctggggggtgtcctgggccacgtgggtcagggtggcccctggagaggatctgggggtgtctcaacccatgaggcccggagcggcctcagagggctgggggcgtctgtccccatgcggcccagagcggcctgagagggctgagggtgtctccatgcggtgggtgtgtagcgaggcctctggtgccaagtccatgtggggagtggaagtcagcctgtgtcatcgtgcctggtactgcag

SEQ ID NO: 132 - DNA, 1217 bp, Homo sapiens
  source 1..1217: mol_type = genomic DNA
gtactgggcggggctggcctgagcgccatctttctgccagtcacccacagagctgtggacactcaggggcgattgcagacttggccctcttgggatatttgggggtaacttttgttttttttttgagacagagtcttgctctgtggcccacgctggaacgcagtggcgcaatctcggctcactgcaagctccacctcccgggttcacgccattctcctgcctcagcctcccgagtagctgggaccacaggcgcccgccaccacgcctggccaatttttttgtatttctagtagagatggggtttcactgtgttagccaggatggtctcaatctcctgacctcgtgatccgcccgccttggcctcccaaagtgctgggattacaggcgtgagccaccgcgcccagccatttgggggtaacttgtaagtctccagaggtgagctgtgaggggcgatccaggtggctgaggtggggcaggggcctgtggcgaaccaagtgacttccatggcagagagttgccctccccgcctggaggctgcaagtccgagaccaaggtgctcctcggcaggaggtgctcctcagaggcctcaatccttggcatgcagttggttttttccctgtgtcctcacaggctctttcctggatgtctgcgtgttaatctcctcttgggaggaaaccggtcatggcttagggtccgctctggtcccttgctagccgtaattagctttctgaaacccagtctccagagacagtcccgttctgagttcctggggttgggactaaagcataccaacatgggggcacagctcagcctgttcccaggggcagagggagcccccgcagaggcccagagcccagggacagagggaggcctttgcagaggcccagagcccaggggcgcctgggtgtgccgtggctgaggggtgcaaagagtaggggttccagccctcgtggaggccttgggtccggactgtgaggctgtgggctggaggccgctgctctgaggtgcctggcggagcctggcctcgaggcaggggctgagcggggcagcagggtgggtggccgtcagagcagcgctggctccgacatcgtggtcctgaggattgtgggagggagcatgagggcaaaaccagggcccaggccaggaggcccctggggggccagagatgggtaaggggaggtactggcctcaggccaaaggtgctgccgcctccgcag

SEQ ID NO: 133 - DNA, 32986 bp, Homo sapiens
  source 1..32986: mol_type = genomic DNA
gtcagtgttgccgcggcctgcgccaggcggcgctggctcccctccgtcactcggccggccttcggggcccgctgtggcgaggtcgacaccccccttccccgccccccgccgccgaggcgagtgtttgggggcgcgtggtccgaaggggctggtgccagaagtaggcccctggtggccgcggctgctgcagccgtaactgtcagtcctggctgagcgacggcgggagggttttgtcgcccgaggggacgcgagcgggcccggggcggggcgggacgtgcgaggcgtcgagatttgggcctcctaggagccaggctcttcgagccagccggggccccagacagggaagggcaggccctttccttcaaaggggagccctttctcggcgttttcaaggtttttggctctcttggggaagacatatttagccgtgtgcttggtgggttggggttttgggggtggattgatgggaagggagggcggatgaagtggtatgtcaagcccaagggttgtgcgcacaggttactctgtgttaccggccaccaggatttctgaagttgaacgtgagttattggctttgccagagactgctgtgttatatgcagacctgtatgcaagcagttggccttttttccccccccttttcagtgtagaaaatgaaaaggatgctttcctcatcttggtggtaaaggcttttgttggtaaaggtagaattgaatgtaccaaatgccttagtccgtaaaattttagaaataattttaatacagacactggtgaagcttggcaaccttgaaagagaatttagcgtctacattttttaaatgactttttatggatatgctaaattagtaacagtccaaaatctgtttgagattattaagtggcgagggtgctgttgaaaatgtaaactaatagcatatggggtttacagtgcacagttaacctcaatcatgaagaaatgtggatatgacccgtaattttggatcattttactgcctgcaatattgagagaagcagcaaattattacagttttttttgggagacgacctaaagtttaagaaatacaactgttgaaagttacctgtcagagacacaaaggtacccaatcaatcttgttgaataaattggacaagtgggataaggtgtttgtctcacacttctgatcaataagtactcttacttaagaagtgatttggtaaatcatgtaaaatttagaatttaggagagataagaaagttgtaacttggtgtgtatagtggaaatagctttgaaattagatcctgtttttaaatccaagctacttaccacatttttagtgaaatgaatacattattaatgatgctactgataagccctaaggatgaccagaagcccttttaagaaacactaatacagttgaccaaaaaataaaaaaggaaatagcttcaagaaataattttcaatctttgtgtatttataatatacacaggagaaataaaagaacagaatatgaagaggtaacttataatctttacaaaattagaatgtaaactatgctagtcttactgtgtcaatatttattaacctgcattagtttgctaagtagtatgctcactatcctctggacattgcccctgtccctgaggagcttaactttatacagagatacaaaatactgtgttttgatttcctttcagaggatttataagctacttatgttttatctgtcctaaattctgcccttttttttcccatggctgaaaaaataacttcctaagaaaggtacatactagtcagaggtgtggggaaaacgtgttctcatcccacttgtgcagtccatttaacaggatttattgggtacctacagtgtctttgacatgtaacatttaatcagttgtatttcttaaactttagataatttctatttcgatcatttctatttcaatctcctccctctcccctccaaaaaaatttactgtgtaaactgtgataatacactgtttctctcagtgtcagtcagtggaatgatccagatttataggtcatagcaaaatttttcatcccaagctcttgaaatgatgtttccaaatgtccattttcttaaatgactgctagttatgttctccaatcatgttacacatattttgtttagacttataattgtgtaggtctaaatgtagaaacattacattatgtacatatgcagctgctgaaagaaaattagttttctaatttttagatcggggtgaagacaaacttttagaagtgatctttcggtaaaatactggatgaagtcttaggtgctctttttatgttggttcaggacaaaagttttttgactgctttttgagttttcccctcactgccaaatgtaaggataaaatgtagtaacaagacatcttggtatgtatagtggtaatatctttggaattagaccctaattttaattctggccttattaatcttggtaagccacagttttgtcatctgtaaaatgggttggtgaaacttccccagagttgtgaggcttaaagtatgtaaaacgcctaacacgtaggcactcaataagtattaccttagaaatcttcctatccagtttttctgaatggtctggaagcaccttgtatgtagtggactacagcatgttatcctttatgttgtttatttcttttctcattagctatgaactttttaaggccaggaattcctagtgtttaccagagaatgtgttactagatgtcttagtctgttctggctgctattacaaaacaccacagacagcatggcttataaacaacagaagtttatttctcacggttctgggggctgagaagtccaagatcaaggtaccaacaaatttgacatcttagtgagggccctcttcccttgttcatagatagctagctgtcttttcaccattacctcatgtagtagaagagtagacggggctctatagggcctcttttatagaggcattaattccattaatgatggcaaagcttcccaaaggccccacctcttaatactatcaccttggaggttaggctttcaacatgaattttgggggacacattcagaccacagcactagagcaggcatgaattggttattggtaaatcagtaaatgatcaactaacatttattaggttcctcctgtggcttctatgagctgagctaagtacaggacccacaaagacaagaaagatgtctgtcttttttgaatgcttatagttgagtgactttctcacatttgtgtgtgtgtgtgtgtgtgtgtgtgtgtaaaaccctatcacataatggaacttcattttcccatgcccttccaatctaagagcagttctatggactcaatacctcctacccaccagctgctactgtaaagatttacttttttactccttttaaaaagttcaaccctctggcacatgcattacttcattccttggtcccagcccaccaccccagtatctggcacgtagtgtattagtatttgtgtgtgtgtgtgtgtgtgtgtgtgtgtgtgtgtgtgtgtgtgtgtgtgtatgtatatagaatttaaaatttttactccggcagttgtcttcaaatactctaattttggggggcatgattatcattctgtcttctggcagtacatggatagatgctacctgagtaggattgtctatgaggtcagctgctccagtcattttatacaagaggaaattggagtgcaaagctttaaaatgattttcttaaagtcacccaggtgtcagaaccagaaccagagtccatgtctctagttcaggactctgcacacattggcacatgttctgtcctaccttttgggatgaatagttatacttgctttgtgattactcacccacctttttggagacatatgagtgttttgtacactattaatagaaggcagccttcacaaaatgccatctgcagatctgttatttcttctaataaaggaaatgatgtaaaattaccttaaatagaaatagtgttaattcttctggagacatattccataatccaaacacgaaatgtttgaaatacttgaagatgccatataaataagtcctttgtaaaaagataatattaaaaatttttgttttatagagatgggggtctcactgtgttgcccaggctggtcttgaactcctcagcttttactttagcttcccagtgtgttgggattacaggcatgagccacaatacctggccaagtccttttttttaatcaaatgacttattaatacacagtttctttgccagcttttgttttcatttgctatcaaaaatgttgcttagtagtgctttgatctgagttatcaataacaggtaaatgccattatggataataattcaaaaagaagcttattaattattaggcctatctgagagtgaagtaaagttagcattttctttttgtttattttacttattgtttatttgtttagagacagggtctcgctgtgttgcccaagttggagtgcagtggtgctgtcataactcattgcagtctcaggctggagtgatcctcccatctcaccctcctgagtaggtgggattagcatatgccaccatgcctggctaatttttttattttttaatttttttgtggagatggggtcttgccgtgttcaggttggtttcaaactcctggtctcaagcggcttggcctcccaaggtgctaggattacaggtgtgagctaccatgcccagctgagcatttttaaaaaatactggtctttgtacatgagtcgttactatttgattctaagccttatgactgatatccctaaaaattatttataaaattttaagtgcatcagagtcattgaaatggaatgagcactgtcttttggtcttgaggttgttttaactagcttcgtaatggtcatgagcaggttatttagcttttgaagccttcgttccttcttttgtcaaatgaaagtgatagttgctttgttttaaaagagtatgcttttcaaacgtgatcattcttgaaaatgtagattaagagctttttagaggccaagtgccatggctcacgcctgtcatcccagcactttgggaagccgaggcgggcggatcacgagatcaggagatcgagaccatcctggccaacacggtgaaacctcatctctactaaaatacaaaaaaaaaattagccggacgtggtggcgcatgcctgtagtcccaactactcaggaggctgaggcaggggaaacgcttgaacacgggaggcggaggttgcagtgagccaagatcatgctactgcctggcgacagagtgagactgcctctcaaagaaaaaaaaaaaaactttttagaaacgttgttttggggaatttttagtgtgtgaattcattttaaatatgtgaactccatttgacatggacaatggatcttaatagtttgtgatacattattcagtgtattaatcaaaagtcaaatctcttttgtaatttgctgtaccagacctgttgtgttaatctgatcaatggcaagtgaatcataagattgacctgaaaggaaaagatatttttaggggacatagaatcatattggataagattattcctatagttcattttcaggaaatctgaacaggaatctcgtgtaaggaatcacatgtgaattatagaagagagtctgatgtaagactttatttattaaggtctgcatctgtgtttcaagtaagagcatagaggtagtatatgagccctgaacactcatacaagtaggataaaatttttcttaaaactgttggctggacagtgtagagtctaatgctgtgactcttaacagttttgtgtgttccagaagttcatctcctcaggatcaattgaggttagtctagcacagactttagttatagaaaccaaacatgagaaaaattttttgacccatgtcttcgtagcatgcaggcttggtagctctttcctagttctggatgtgtgcccgttgtatatactttcagcaattcaggatgttccttttcatatttaagacaagcactcttgcatacaaattacatagctgtgggctgaatgaagatgctaccattgctgtacttctacacaggttcttttcatgtaatgaaatcagaagggatggcttttccatttcaagcttctgttaataagtagtcttagaattgcctttgtgtactgtagccaacaccccaactcatatatttttataatctttgtgatgcagaataaattctgaaactttccacctcctaattaaatatagaaatactgaaaacaataaagcaccatgtattcactatggacatatgtcacattttgtcactttcttgcactcttgtaatccctctctaaagctcatgttaaactcatgttctttattttcttctcagatgattcctttggcactgcatgtaacagtacaggaatttcttcctttcgtacttccaacaaatacttttttgtctcttaacagatgtgaaccataatgctgttctttagaaagcaaaggatgaagtgcacagcagtgttttctatataaagctaatgggtcataaggggaaatatgggttatttccagcttgttaattgtcttaatacatttttcctaagaattctattgtgcctctgtggttatatgcaccaatattgataatcttacagcgtgccataaataaggatttttatattatctttgctaaatattttaagtttttgttttgggaattgaaaaaatcttttgtgcatctatggtatgtgatacgtatactaatggataaatcctgtttcacacaaagattaattgggtaacatttttctttcctagttttctgaagtcagtggtcatgttgtgtgttggtgattgaaaatatgctgtttaggctgggcgccttggctcactcctgtaatcccagcactttgggaggccgaggcacacggatcacctgaggtcaggagttcgagaccagcctggccaacatggtgaaaccctgtctctactaaaaatacaaaaattagctaggcgtggtggcacacgtctgtaatcccagttacttgggaggctgaggcacgagaatcgcttgaacctgggaggcagaggttgcagtgagctgagatcacaccattgcactccagcctgggcaagcaagatttcatctcaaaaaagaaaagaaaagaaaagaaaatatgctgtttaagatcattcaaattcagtttctaagaagtgtaaagttttcctaattacttaagctgcttcattctcattcccttttgtaacacattttgccatctctgtaacatgttgaacatgtttaaagaacagagtgggagaataggaagttacgtggataaagtttggtaatcaaggtaggaatacatcctgcttcacagaatgggaatatttctgaaaagttgactgtagtattgaagaacacttaagtgtagtgtattagacgaactgagctaattttggtcttttatacacataaatcaagatttctgcatttcaaatcatgcatatttctttaaatttattgctcagtgtactgtatttcaaatattgtaaaaatgaaaagatcttgtggtcttatttaactcagtatgggataagtccttcccaccttcccattcttattccctcttttaggctgaatgaaaggctgggggagtgaatttaaaaatagatggatctcagctggagaatgggttggtcacgtatctcaactgatattaaataatttcttaaatcctggattgaagattataagaaaacagtaaatgtttgctctcagttcatttctttgttttgttttttcatgtacagttttaggcacttgtaactgctggatgcatgaactactttctagttctttcaggcctacttttagatatctgctgtggggacagtcctcaacacttaaagtaattttaaatagtgataggcagaactaggggtcagttttactgcctatgcctgtgctgaatttgacatggcattcctaggaggggaggtggaacgagggcggtgcacacattgtccatattgctagtcagtgccagattttgagaaactggggctaatctctctcttaaatggtcaagatctaattccccaaagtgctgtttcagataacctagtatttgtccaaaattgccctgctacaatagtatttatcttatatatatgtattatatatataatatatatataatcttatatatatgtattatatatattatatatataatcttatatatgtattatatatataatatatatataatcttatatatatgtattatatatataatatatatataatcttatatatatgtattatatatataatatatatataatcttatatatatgtattatatatataatatatatataatcttatatatatgtattatatatataatatatatataatcttatatatatgtattatatatatataatacatataaatatatatatatatatatatataggtttttttttgtttttcctcctgagatgtagtctcgccctgttgcccaggctggtgtgcaatggtgcagtcttagctcactgcagcctccgcctcctgggttcaagtgattctcctgcctcagcctcctgagtagcagagactacaggtgtgcactaccacgcccggctaatttttgtatttttagtagatacagggtttcaccatgttggccatgctggtttcaaactcctaacctcaggtgatctgcctgcctcaacctctgaaagcactgggattacaggcatgagccaccacaccaatcctattacattcttaaaaaaatgtttgtttgtttgtttttgtagagatgaagtttcactatattacccagcctggtcttgactcctgggctcaagtgatcctcctgccttggcgtcccaaagtgctgggattatagacatgagccactgcgtccagcctgtatcatatttttattctgatatcttttgtaattttgtttttagtgaagtagggaggtttatattagataatcttccaaggtaattatcagcttggacattatatgctaatatgtcttttgtttgtttttaaaataagtgtatatgttttaattgtaaaatttttaaaacatccagaaaatgacatagcaagtgcctatttatccaccacctggaaatataaattatgtccatttttatcccttgggggaaaggatgcagttatataatcacttttaacaaccccaactgttcaagtcctgttacccgtctctacacaaagtaacaactgtcttgagattcttaagtaaatttcacatccttgttttatacttttactatacatgtgtacatgtatctgtaagtgatatgtggtgttggtttttgtattaaatttttacagacatgtataacgctgtctttcaatagcttgatttttttaaactcagtatcaagtttttgaggtgtatatgttgatgcgtgtacatgtagtttattcagtttcactgctgtatggcacttcattttatgcatagataaaatgtatgtgtcccactattgatggatattttgagttgttttctttttgctattataaataatgctgcagtgtttatttttacatgagtgtatgtgcaggtgttttgggaaaaaccgtagaagtgaaattgctggttactagatattggtaaattcttttcctaaatggatatgcccatgtatactttatcagcattatgtgggcatttctagcatcctcacccatacttgggattgtcagattttaaaatagttactaatttgaggcatgtgaaatgctatctcattttaatttacagttgcttgattattctgaatcgtaggtaaaaggataggaaatttattattttctgtatgttttaaatatctcaaaaataaatgtttttaaaggaaaggcacactatcgtacaacatttatgttgaaaaggaccatgaagatcatttcatccaaccttcttactttacagtgcagccaaagaaagttaccagaataagagtaaaatataaaatcctgcccattgtagtattctctggtagtatgagccttaatttttgatgtaaaaatcatgtctttttctttatgattgtgctttttgtttaagaaatcctctttttatattgtctgctaatagttgaggattttttgttactctttgttatttgcatttaggttcatctgaaaggagttaggattttttattttaaatatgaaaagctagttgttccagcattaagtattgaatttttaaaattttgtattgaggttaaatatacatacataatttaccatcttttttaagtgtacagttcatttttaatgattttttaagtgtacagttttttaagtgtacagttcagcaataataaatacagttatgttcttctgcctttgtcctctcactccccacttcggctgctagtaaccaccagtctatgcttatcttcttgagatatacttttttagcccatgtatgagtgagaacatgtggtatttgtctttctgtgtttggcttatttcacttaacataatggcttcttgttccatccgtgttcctgcaaattacagggttttattcttatttttatagctgagtagtattccactgtgtgtataaactacattttaaagtctattcgtcctaattattgaattctccccaccccacccacctttttttttttttttttttttccaggagacagggtctccctctcttccccaggctggagtgcagtgccatgatcatagctccctgcatccttgaaccccctggcctcaagcgatagtcttgcctcagcctcccaagtagctgggactgcaggcaggcacctccaggccctgctaagttttgtgggtttttttttttttttttttttttttttttgtagagatggggtcttcctatgttgcccactttggtttgttagttttagtagtttataattcctttgtattattgtgaacaaataacagttattttgaaatagaagagtgctttctatttaaaattttgctttgatagggttctgtctactttctgagccttaccttcctgtgcattcccctttggtcagtaccatcttaccacacaggctgcttttagtttcttgagttatccatcttccttctatcttatagggctcaacctaaatattactcagggaagccttccttgagagtctttctttttgcactcattggtttggggcttctttatattatactgttaattgaattctgagtcgtgtttatctcaactgagattaggtaatttattttgagaacagtaaatgtttatcatctgtcattctttttttcatgcccacattcagttatttgtaagtgctgaatgtataagtgttcatctacagataaggatcagttcttttttccccaactagaaatgttactccagttgataataacagctcaaacggaaatataaggcagaggtgagagagtcacttgaggccacgaattggagaccagcctgggcaacaaagtgagaccttatccctatgaaaaataaaattagcccagcttgggaggctgaggtggggggattgcttgaaccctggagttccaggctgcagtgagttgttatcacaccactgcactccagccgcggtgacagaccctgtcccttaaaaaaaaaaaaattataaccagccacattgaaatattttgtaagacattaatagaagactaaatgttctcatatgtttactgtttgtgttaagtacgtatggtttttagaacaacagttttctatcaagtgtggtctggttcacttagaattagatggggtagattttttgaaaagcgttttgaagttaaattagaagctaatggttttttgtcactaaatcaaattttgttttatgcgtttaagtgctacatttatttgataggcaggtgaatgtaacagattaaacttgaaaataatgtagctatgattccttcaaggaaaaacccacctacctttagttcttttagtatattgcattataagtcttttgtgtgtgcatatatagcaggcataaattggcataattctgggtttaattttaggctaggcgctatggaagtttgaactctaattacagtgtaaaaataacccagaggaaaatttcagaataataaatcattgggactatatggtacagatgtccctgttttcagattgtagaattgttgaccagtaggaatgctttatgattaaaagccaggaaattaaagtaattctgatgatttggtatttctaaagattttcatagatgacagttgagaactactctcagatgagattcttccattgctggtaagtcatgtaataaaacacttaagtaaatattttaatgaggaatgataacattttaatattggcacattgtgagtctaccttctgtagttagtaggtaaataagaaataaacataccttatttaaaaaaaaaatttcaaagaacccaagggaggggagagccaaggtgcacattagaaggagattacagtactcttccagtgcacagtggatgtgttgtgattccagagttctatgtatgtatgactgtgtagcccagatttaccagcatgggctcagttttaaatgttaggttaggctcataaatcatgaaaagttcctaggaattctaacatttttacatttccagaagagagcctcttgtattttgtggtagttgccccaccatccctcaaatattggtgtgtagaatctatttttgaggatgaggaaatacagaaaagaaaaataaaaagctatttttttttaagtataagaagaaatgaaaggtttctcttcgcttcatagccaattctaaaacttaacagttgttaagtgtgtttaactgtagagggaaaaaaatgcctggaaggaaattaccaatcaaatataaaatgtaagatagctgtaaaagtactgatatacatacagcttttttccttttggggaggcagtatttaaaaaaaatcctaccaaacatattctctaactttcaaaactgttaatagctttattgagataattcacatactataaaattcacccttttaaagtttttagtatattcacagttctgcagccatcaccactattgaattttagaacattttcatcatccccaaaataaatcctaacctgttagcagccattccccattctttcctggcctctggaaaccactaatctgctttgtctctatgaatttatttattctggatatttcatataaatgggaatcatacagtatgtgtccttttgtgtgtgggttcttttacttaccatggtattttcaaggtatgttcattgacatgtatgtctgttttttttgggtaacacacactcttgattactgtagctttgtagtaagtcttgaaaccaggaaatgtgagtattctaacttattctttttcaaaattgttttgggtctctgggtttctcaaatttccatagaattttagggttagcttgcaaaaaaatgcaactgggattttaataggacttggatttgtgttgaatctgtaggtctatttgggaagtattgctaccttaatactgtcttctcattcatgagcatgggatatctttccatttattaaggtgttctttaatttctttcatgttttgtagttttcagtatacaggtcttgtacttattactttaaaaatttatttctaagaattttatgttttgatggtattgcaaattgaattttttaaaatttcatttcaggtttttaattccttgtgcatagatttttgtgtactaaaacttgtgtttcatataatttttttttcctcttaactgtgttataggaatctttcaaatggttggctacatacacatccatctgattcacttagtaaacatttcttgaacacctactgtgtagtgggcctttttttctaggtcctggtagagacagcagtgtataaaacccactcagtcctttgctttcatggcacttaaatcctaaaaagagatcataaagataggtaaaatatatgttacatagtgctaaggagaagaaacaaataagggaagtgtttgcaggtgaaaaggatgatgggaaattttagatagggtaggtagagaaaacttcactgaaatggtaacttgggtgaagaactgagggagatgagagagctagccatgtggatatttgggggaagagcatttcaggcagagtgtagtgaatagggaaaccccaaagtgagagtgcctgatgtgtttgaagaactcgaggtgtggccagtgtagctttagaaaagtaattgatgggaaatagagagaatggagggtacagatattttgatcataataaggtgtttgatttttacctataagtgagatgggaagctattggaagtctttgagcagagtagtgaaaaagtatgacttatgtttagcaaggtcactctggttgctgtgttaatcatagactgaaaaaggggacaagggcagaaacagaccaattggtagaccattagtacagattaagacgtgactgaaatggacagagtggtcacagtgagggtggtgagaagtggttgaattcttgatatatgttgaaatagagtccataggatttggtagtagaccagatgaaagtgggaaataaagggaggagtaaaacatgatgccaaagttttttgaccagagcagctgagagaatggagttggataattcttataaattattgcattaaatctgtgcatcatatcacatgcccacttaactacaggtaattttaccatataagcttgtggggggaaaagaggaaaaacagaaaaaaggatggaaaagcatgttttaaaatataataaattaggccttaatgaaaaattgtccttgagaaacctgagatggaatactctaaatctgatgtgttctctcaatctttagaactgaactaggaattaactctgagagttcatgatgttatgagaccctttgcctgttttggaaattcggttgttttcaatatttgcttttgcaatgatggtacctgttattttttctgtaaggtagattcctacaaataagatgtcaggccattagatcatgtcaatctaaatatttgataggttttgccaattaccttttaaaaaataattttagcaagtttcattccttaaaatatattagggactgctcatttaccttgttttgattcatgtatatataaaatctgtttaagtctttataaataacctgggaaattgcctggttttttggtccatttctattgtggtgtttgttttttaaatttgtaagcattctttatatatcatttaattctttattataatttgcaaatattatctctacctacctttaattttatagtatctagtcatgtgaaattttaaagtttttatgtaggcaaatctgtccatcttttatggtttctgggtttcagcatgctaacaaagttgatataaatatgatctcatatatatattacaaaaactttttagagataggatctcactctgtcacccgggctggagcaaccatagctccctgcaacctcaaactcctgggctcaagtgatcctcctgcctcagcttcccaagtagctaagattatagacatgtgccactatagctagttggtttttttttggttggttggtttttttttttttttttggtagagaacgtatctcagtgtgttgcccagactggtctcaaacttctggcctcaagctatcctcccacctcagcctcccaaagtgctgggattacaggcatgagctactatacctggccaatctcttgtattttcttctgatacttttgtgattttactttatagactttaatttagaaagttagatatgagcattcagcatatttttggatatggtatgatatggtttagatctggattgcatttgtcatggtttgggaattatatctaccttttattttcttccacttgggtagctgattgtcttgtaaggcatcctttccccactgataatgccacctttttctatattaagttctcacaaactttgaaaaaaatcaagtttattgatgtataattgatacacaatgaaatgcacccattttaactatatagttttattgattttgataaatatatacactatcactgctactacaatcaagctttagaacaattgaattacctccaaaaagttccttcctgtctgtagtcatttctccctcttggccccaggcaaccactgatctgtttattagttttcctactctagaattgcatatccatggaatcaagtaacatgtactcttccatgcctggtttctttcacttggcatgtttttgagattcatccaatttgtgtttgtcacagatttttgtttgtttcgtttttttaaatacaatatgactataccacagttcattcattttctggtgaacatttaaattgttttcagttttaggctgttgcgaataaaggtactgttttgtgtgcatgtttttgtgtgaacatatgttttcatttttctagggtaaataccttaaattggaattactgggtcacatggtaagtttatgtttaaatgtataaggaactgccaaactattttccagatgattatactactttacattcccatcatcagtgtatgagagttccagttctccaaatgtcagcatttgatgttctcagtctttaattgcacacgttctgagaggtgtgtagtggtatcccattgcagtgtttttttttaagtggtactaaaatacacaacatcaaatataccattttaactatttttaagtgtacagttcagtgacataaagtacattcacattattctgcagccatcaccactatccatctctgaaactttttcatcttctcagtctgaaaccctatccattaaacagtaactcttcattgcctactctccctatctgctggtaatcactgttctacttcatatgtgaatttgactcttccaggtacttcatataagtggaatcatacgatttttgtccttttgtgtctggcacatttcatttaataataataatgtccttgcgttaggccattcttgcgttgccttaaatgaatatctgagactgggtaatttaaaaagaaaagaagtttatttggcccctggtgctgcaggctgtacaagcatggcgccaccatctgctcagcttctggggagccctcatggtgagtttactcatggtggaaggcaaagggggagcaggcgtgtcatatggcgagagcaggagcaagagagagggtggggaagtggcacaccctttttaaacgaccacatctgcgaactcactctgtatcccaaggagagcaccaagctatgagggattgctcccatgacccagttacctcccaccaggccccacccccaacattggggattatattttaacatgagatttgggcaggacaaatattcaaaccgtatcagtcatcaaagttcattcatgttgtagcatgtatccaaatttgattctttaaggttgagtaatatttcattgtgtgcatatatcactttttgttttatttatttatttgtcagtggacatttggactctttgtaacttttaactatgtgaatgatgctgctatgaacattggtatataagtatctgtttgagtcccttcttttaattcttttggttatgtacttaggagtggaattgctgggtcatgtggtaattgtatgtttaatttttttagagactgccatactgttttccacagtgactgcaccattttacattcccaccagcagtgaataagggttccaatttctctgcatcttttctaacacttggtaatttctgttttttatttaaaataattgccattctaatgggtgtaaaaagtcattatggtcttaatttacattttcttcatgactgctgttgagaagttttcttttgtgtgtctgttcaaatattttcacattcttttcagaacatatgttctttgtcagatagataaatgtatttcttctgtatccttactgattttctgtccacttactaattaccgagagaggaatgttgaaatcttcaactataattttgagtttatcttccttctgctctgttcattttttcttcatatgctttgaagcaaagtctttaaagttgtgtccttaggtgtgttcacatttaggactgttagatctccttgattaattgatgtctttatcattatgaaatgtctctgtttatcgctggtaatgttccttatctaaagtctactttgatattagtgtatccattcctttcttatgattaatttttgcacattatatcattttgctgtgtttttattttcagcttattggtcatttaatgtctttcttttagatagcatatagttgcatcttgctttcagattgactttttacgatcgttgctttttgattaagtccatttacatttattgcagttggcaatataattgtgtttaagacactatttgttttctatttgtctaatcttttcttccttttctgccttcttttcggttaatggagcatttttggaattttgtattgtctccattattagcttgtccctctgttttttttccccccagtgatacttctaggatttacaatatgcacctttaacttacctcaatctaccttcaaaaatattattcctcttaatgtataatgtaagaattttggaatagtatacatccatttactctccctcattctttttggtattatgatcttaacattttacttctatatgtgttatagattccacagcagcgtttgaaactatttctttcaaaggccagttgtcttacgaagaaacttaaaaactaagaataacattcctttatatttaccttcatatttaccatttttatttatttttctttgtggagattcctttttgtagatccaagtttgttgctggtgttattttccttttacttgaaaaaatttcttaaacatttctaaagtataggtctactggctacaaaatctttcagcttttgtttgtatggaaatgtctttatttcactcttcattttatcgtacaatttttcaaaccacacagactttaaaataattgtagaatataatttcacaacattttgttctatttgttattgtcttctatcttgtccatctatccatcctgtcttcttctagtgtctttttttatgcttttcaaagtaagttgcagttgttagtataccacacccttaacttgagcatgtatgttaactaaaacttagtagtttagtatttttaactagaatttactatgctgttccagttatttattgctgtgtaatacattgccccaaacttagtgccttaaatatcagcaactatttattttgctcatgaatctctcatttggtcagggattggcaaggagagcttgtctttgacaatacattgtaacaactgtttacatagcattacattgtatttggtattataagtaatctagagatggtttaacatatttgaagatgcatgtaggttatatgcaaataccatgccattttatataagggattcgaagcatccttggattttgggatccatgggagtcctggaaccagtcctctgtagatagttgaggtatgactgtagtctttggattgaaagactcactaatttcactcagattcaaggagaagggccatagactccaccacctgatgaaaaaatgacagtgttacattgttaagagcatgtggaatggcttctattgtgaccatctttggaaaatacagttgaccacatataccatttcatgagctgtgacaaatgtatacacctttgccagaaagttctatcagggtatagaacctacacctcttcctagttattccttccccccacaccacccctagaacctaacattgttcagattgttttcatcttagtttagcttgcgcagaactttatgtaagtagagtcatacaatacttatatgttgtaaaaagtttctttttgctcaacataatgtttttgagattcatccatattgttgaatgtttcggtggtttgtgacttcatctgttaagggacacctgggctgttttcagttccaggctgttttcagttcccagctattataaaaaggtacaatgaacatttgtgtaaaaaaagaagtctctgtgtggacatatatgtttcttttttcttggttagttgatgtgtttttctttcagcatttgtttttgatgagaagtctggttatacagtcatgtgccgcatgctgacatttcagtcaacgagatcatagttgacaatagtcatttaagattataccaccatattttcactgtaccttttctaggtttagatgtataaatacttacactttgttacagttgcttacagtattcattcagtatagtaacatgctgtacagctttataacctaggagcacccgggctataccatgtatcctagttctgtagtaagctataccatctaatctagatttgtgtaagtacgttctatgatatttgcacaatgattaccatgctgagagttgttggggttttgttttttttttctttttgaatctgtacatttatggttttccttaaatttggaagattgttgccattgtttcttctatatatatattttttaccacctttactcctctttcatcatttcctctttttctgggactccagttacacatatgttagactgtttggtattatccacaggtcattaacatcatattcattatttttcagtctttttatttccctgtgcttcagtttgctttgtcttctattttactgttttttctcctcccttgttaaataatttcagatatttcgctttatatttcaagaaattccatttgattcattttattcatgtatttttttgaattcttgagcatatttgtaatagctgtttgaaaatcaggttacttattgatttcttgaattttttcactctgaatttgttggttggttttttctcttggtcatgggttgtattttcctagtatttattttattttattttttgttttttacatatttaatgattttttaagattggatgctggacattgtaatattttgttgttgggtgtctagattttgttttcttttagagtgttttgttttgtagccacctaaataacttgctggtcagttttatcccttcagggctacattggagtttgtctagagaaggctttgctttaatggtagtagctcctacctaaggcatgatccttctgagtctttactaaatgctcccagtgtcaccgtgttctcttcactcaggttagagagaattttaggagtctcccagtcctttataagtactgggaatatttcagcttactgcccctctttcactagcttcatggagtcacttaccttaatcgtgtacagttagtactcagcagtggactctcaaatggcagatttctgaagccatttctctgccttctcagacaagcacttgtctggcacttgtcatcaattttacccacttcagctttctcagctctgatctcttgattctgaactcagtaaaactgctgtcttctcactggatttcccctccattgactgcaggttggaaattacctccaggcagacatccaagcagtggatggctcacctcctttgtttttgtcctttcatgcattatagtcctctgctgcctgttatccaaggtctgaaaattctcgtttgagaaggagcaactgtcagatactttcggatctttctctgaaattagctttctgttgtgcttgttgtgcttacctctttgtctaatgctaataccatatgaggtttttttttttttttttagaatgttttaagctatacacttctaagtgtatagcttgttgcactttcacacactgagcacccgtttagctagcattcagatcaaaaaacagcagcagctcctgcgtagccccttgtgctctgtgtcactaccccttttcttccatgtgtaaccactgtcctgacttctcatagcatagattagatttgcctgttttcatcctttaactagaatcaagcacatttagttgtgtctgacttcttttaatgtatttgtgagatttattcacattgttggttgtagtaattgtttatgatagtcgctgtatattccattttaagaatggaagtgatattccattttaagaatatgccatagtttaatctgctgttacggacatttaatcatttttggtttggaactgttaagaatattgctgctgctctaaacatttcagtgattgtcttcttgtgaatatgtttacttctgtttggtatacttaagagtgaaatttttaagtcataaggtatgcatatatttagtgtatactcagttttttaaaggcatgccgattttaattattccatttaagttaatatgttttaatatctggtagagaaaggaacattattagaaacaattgttttggttattcttacatatttagtctttgaaaaaacgtttcttaaattggcatttacttatatttgtgttaatttgggaagaaatggtatctttgttcatctatgagtcacatttggaactagctcaaaggccatgggtcctgattccttttttttttttttttttttcttgtagaggggaggtatggtgtcaagaaaacatagtcaccattattacgaaaagtaaaatatggaagagatgatccctaccatcaatcagcttacaactagaggcactgacaaatgtatacagatagctgtaatgtaaggtataacataataaatataaggagaaattaataaattattttatggtattaagaatgtataataagacatgaaggagatggtgattatgtataagagtttagataaccctgtgagatacagtgtttagaatgaggccagtttttaacatggcatgataggtgggtgggggatagaggttagtaatggatagaggaccatttccgagtgaagtctcctcagaagcaaaagcattgaagtcagaaacacaaatatccagtacattatagccaatagtcaaatgatgggactagatctggtaactggtgatgatgtcatatagtgggcagtagtgctgggatggctggggtcagggccacatggcaggggcctcaaataaaatgtgaaggagttagaaatttattctgttggcatgagaaagtgttaaagcttttgaatatagaatgatatgtgtaactttgagtttttaggaagataattctagtggcaaagttgaggataaaggcaaaagggaaaccagatgaaataatggggcactgtagtaggacagtgttggtaagtttgaggaaaaaaggagtaagagatatttttaaggaaattcatagggtttgagtataaattagaaggcaagtacaagggaataagcgtggtctttagaatcagacaaattagggtttgaatcttaaccttgcatttactaaaggactgaaagctagttccctaagagaaaaattttctcttttgtaagatgcttattctataaacatttgcaagcactggaagtataaaagcaaatgatacacatgttctcttgaagtctggtctagtctgtaagaagaggctgcactggcaggttttgaccaaattgtgtagaatctcatctgacgtgattgggagctttggctttattctggaagcaactaaaagcaatcaaaaaagactggggaataatgtgagaatgtagaaatgtaggggaatttctaaggatgaattggtagcaattggtaaacaatttgatatactgggaaagagagagactctttagaatatgactgagaatcttccaatttgagcagctggactgatagtgctaccatcattacctcacagggtttttcttagtgtgtcttgtaaatcttgcttgtccctcataaagaatggttttccttttcttcagactaaggactttttattacagtacacaacttaacaccccctgtatctctccatcacaacacttaactgtgcattgttattgcataattaattgtggtttttatttgtgcccatttccttcaccacatgagggcaagaaattatgtctagtttttctacctctgcatcttcatccacctagtaggcactcaaaatctagtagacagtttttgaattaatgattatgaagaatttgaaggctgaacaagtatcaacctacacagtggttagggcaaataaaaatgagggggagaaagtaatgaatggcaccaatttttttagtccttaaccaggacagtgagattaggcagagtgagttctttgggaaaataattgagtttgatattagatacgttgaatgtagatgttaatgagacatccaaatggatgtgtaccgttggtaatatgtagttgcaggcataccatgccagacataaggacttaaagatacagagttaggggtttgtaagcatagaggtgctatgggaatggatgacattgcgcagaaaattggtttaggttaagaaaagtggctattgacagaaacttggagagaggccatgtatgaggtaggaagatgaactagcagaagaccttattgcctttagagagatggaagaaaatgagtggatacaacattagggaagccagaggaggtgaggagtcattagcagtcttaaaagctacaaaaattaagtaggattaaggggccaaagcactgggaatatacagaaatgatggaaactttacaagaaaaatttcagtagatagaaaaatagcagctgagctagtggttttcacgtctttttggcagtaaaaggaaagaagataaagaaatggtactctgaggagctaatggagttgagggaattatgttgcaagtattatttgaaagcagtatttaaaactttttaagtcttaactgcagaatggactggaataaggagaaactaaagcaggaggacttaggaaaattgttgtagtagtcctttaattgtgaaatgtgtaaacggacaaaacttagacagttttaataagtagcattatccataaatataagacaccataaacatgatgcaaaggagaacagaagtgttgggtgttataataaaaagtgatagaaaaaaacagtttgtgaaattaagttttgaaacagctttagaaggaggtgaaggaaaaatagaaatgaataaaatgaaaattttagggaggtagatatagatcaacataggcatttattattagactatacttatttataagattattagactgagccctctgttgaagagataaagtaagagaactatgtctggtattaggattcttatggttaaattggcaagtgagtgtgcctaatatttgtagtgcttacagtttttgttattctgtatttttatagatttggtatatttcctccatgattatgtgttcctaactcataatttggaaggcagggcttcttaaaatgagatctgtgtgtcatgtgaagtatatgttaaaatgcaaattcatttctgcgttcttgggttggtctgaaaaaaattaaaaaaaaaattcatttacccctacttcatgcactgaatgaaaatctttgcgagtagagcccaagtagttgcatttttagatttccccaggtaattctattatagactgaagtttgaaagtcagtctctaaaaccttaaaagttggttaattttatttcaaaatgttttatatgcagtgtattcactttctaccatcaacctctaggacactggataggtttcttaacctttgagatttgctttctttatatgtaatgcagtacatgaaaggactttatttttgttccattgaggaatgttctgattgtatacaaacaagttaagaatttacagtgataatttaggggcttgctttaagcttcaggatttttttttaagagttaagttttgatatatattaagtggttgatttaataaattataattatcgtcgtatattgaagtcctgttttgtgccaggtaggcattatactataactttttaacgcattttctctgctacaataacctgacattggagactcaagggtcagagggtcggcccaaggctgctactctagaaagtggtagatgcccagatttgtacctaacatagccgatgcttagcatatagaatttaattaaaaacaaaattgctataggtatttgaaaggattagagggatatagtcaaatagttttcatatgtgtttagcccttttggagggaggatagagtaaataaatagaaggcactaagctttatggatgaatatgggaaatatggctttgcctgctgaaagcactcaggccacagggcctgcctacctatgctttcctcatcccggcaacagcagtaatttgtttcttgatacgtttttggatgttcataattatagaaaataaatttgcctttatgatgaaatttagtacctttttttttgaaagttcatccagttgtttatgtaaaaagaattgagtgaggtgttttatattttaggttaaaaatctgtaagagcctgattttagaattcaccagctcctcagaagtttggcgaaatatggtatgtttttgttttattttttggaattcgtattgcatgtgtatcttaatgtcataataatgacagatgtgttcagcaaatttgggcccctgccatttttaaagcattgtgtcaggtgctcactaactacacttccaagactgtatgagggacccaggtagggtgctgaaaaaatttacaagagattagtgtgctatgagaggtaaaataatatgcataaaaagattgagagggcaggtttggattttgggctatgagtattaataatagctttcatttgttgttgttgttgctgctgctgctgctgctgttgtttttgagacagagtcttgctctgttgcccaggctggagtgcagtggcaccttcttgactcactgcaacgtccatctcccaggttcaagtgattctcatgccttggcctcccaggtagctgggattacaggcgtgtgccaccacacctggctaagttttgtatttttagtagagacggggtttcaccgtgttggccaggctagtctcgaactcctggcctcaagtgatccacccgccttggcctcccaaagtgctgggattacaggcgttagccaccacgcccagccatttgtgagcacattatgtcaggcactgttctgagatacttagatgttagcttgtttatccatgacagctctatggaataggtactattatcctagttctacctataaggaaactgagactcggagaggttaagtaacttgcccaagatttctcagctagtgaatgaccaaacagagacataagtccagcctggccttggagccttttgagcaccggatctcataaaagaggggactggaagagaggacttgactctagttttcaaaatacatatagctctttaattacattgaggtcaattagtcaattaaaagatattttaactttattatttttgtgtttacaagatggaaagttagacttgtttgaatcttctaattccacataccattagtctcttgagaacccaaggggaagctgtatcatgaccacattgtttattttagggaaggtggtgtttcccatatgacctcagcaatgtctaagttcttattaggcaatgtatagttaggataggagtatctgggagattgcgttatttcttacagatactataaatcccatttattggaatcccctgcaattatttttatatattcaggccaatcctcacctaatctggattttgaagccctgcgttcatagctgcataggtatgggctcaaacattcatgttttaaccgttggtattcgcagataccttgctgttttatattgggttctgaatccacactggtaaccaccttttacgcttgactattgttgctttgaggatgttaattatgaaaggtttcttcctcctaatttcctcatctttccgtagttgatgcctcagatttggcctggataggggaatcgtgaggggaaagaactagttgcacaaaatgatcttttgatactgggatatttcagatgtatggtatctttgccagaactacagtgtcagtaaagaggcctgctaaatttgaactgtgacaatcagaaaagttcagctaaggccatgtaaggggttaaaaagatatttggttgagggaggaggatatgctttcatcttttgccatactttttcatgaaattaaatcttagtagatttatggccaagaaagagtagaatatatttttatgcagtacttaaggggttttgactgatgttttttattattattatactttaagttttagggtacatgtgcacaatgtgcaggttagttacatatgtatacatgtgccatgctggtgtgctgcacccattaactcgtcatttagcattaggtatatttcctaatgctatccctccccttccccccaccccacaacagtccccagagtgtgatgttccccttcctgtgtccatgtgttctcattgttcagttcccacctgtgagtgagaacatgcggtgactgatgttaaatgactttacgtacatacagaattagtgggactagactttgtgtttatgtgtgtgtgtttatgtgtatgtatataactattccattaagcagttgccctccttggtgactgattgctctatcagcttaggaatcttttgactgaatttgtccgtatttgaaagatctcaatctgtgttctgaatctttactcatttacatatacttaaatcttgaaacccagtatagcaaaactaagccaaaacaaacaaaaaaatccatcccttgataggaagtcagtatatctgggttttagtcagtccttcaacactagttccaaaatcttgggcaagtcagttaatcactcggaggctgcttaattttttttttttttaattcttagtatattatctgtcttgattaggtaaagccaaagttgttataagactcaaggtactattgaccaaaatgcttcagaaactataacattacataaaagtacaaggaattattacattttctcaaatgaagagatcatttaagaaaaacaaaatgctggaaaatagtccttaaaaacttttctataataattactcttctgatgaattttacattgacacctaatttgaagctttgaatattattttttgaacaatgaattgggtttatatattaaagtgttctaaccaaaggtttgtttaatttattagagttattaagcctacgctcagatcaaggtagcagctagactggtgtgacaacctgtttttaatcagtgactcaaagctgtgatcaccctgatgtcaccgaatggccacagcttgtaaaaggtaattttgaattattttacagcctttaaaaggctgtcattgtaaagtgaaatacatactgtaaaaatgaagacaatgtatagttggcaggaatactgctaagaatagtgggcctgagagttgacctacttcatttaatctccttaaaatattttagtgtctttttttctcattaaaaatatcagtagccactatcaaagacctatctgtatgtataaacaggaaagtatttctcaaaaaaacttcaaggttttaaacattttactataaacattatagaaaacattaaaaatttcttaatatgcattttaaagtatgccttttatgtggtgaacgttttaactaaacatttctctagaagtttttataacattaataaaactagtatacttttctctcctagagagttacagtggaggtaaaaggagtggcttgcaggatggagaagctgcaccagtgttattggaagtgagccaccatttgaatttgctagctcatgctgcagtattcagattagtgggtgttttgtgatcatattttctgcgattcaaatcaagacctaaaattgattctcattctgagatttacattttattatccaatgttatttggttattgtttcagttttaaaatttctgacttgttattctgacacactttaggataacctaagtcaatagtttaatacaaaaatttccctttggttatatgttttgaattaggttatatgttctgcatttacaagcacatacaggattcttacttccagcaacttggcagtaaaagaataagtagactctttaggagccaaagtcaagcttgggaactgttgctaggtggtatatatttcatagtttatgtttgtttccaagacaaggtctcactccatcgcccaggctggagtgcagtggcacgatcacagttcactgcaactttgaccttctgggctcaagtgaccctcccacctcagcctcccaagttgctgggactaaaggcacccaccaccacacccggctaagagacgaggtttcatcatgttgcccaggttgaccttgaactcctgagctcaagtggtccttatgtcttgacctcccaaagtgctgagattacagacatgaactaccacacctggcatatgtcatagttttgagagtttgaattctaacctcgggactttggtaacttatttataatattctagaaatatactgttattaggatgagtagaaattcattcagacagaaactattataaattactgcaagaaaaatgtctgctagttctgcatatattcatttttctcttgattaaaaaacaatttccaatttgagtagaacaactttgctatgtttaatagacccaggacagatttattttaaggtaataatctttcaatccttcttcttctatactggattggtttaaattacttagcttgtcttatcaatggtttttaatagcctactttaatatatgtaaaaagtagtaattaatatgttacagtttggtggcaaacattttgatgccaaagttcacatattctcttgcttagggaacagaaattgggaagatagatgtagttatcatttgataatgtatttaaactctatcccatttcaggatctcaaaactttgtaacagttacatattgtacttctaagacttagatttgtttttcttcttgtgtcttacctttttgcagtaatatttttattttcctatcatcatgtcctcattttttccctctcttctctttccctgttaattttgaaagttttgctgcctacgtgtttgaaaacttctaatctgcctctcttccctcagtgccagcaggtttattttttgttttgcaagccagctctgcctccttacagtatgacatctgatgctggagggtcgcactttcaaaaatgagtcagctggtacatggggttatcatcaatttttagctcttctgtctgggagatacaagtttggaagcaatcttggggtacttacccacaaggctggtggagaccaggtgtgtcacataggtgatttgcttgctccctgggggagagggtggagtgaaatttttgcatttgtgtcacagccaagtcactgccacctccagcatgccccagtttttagttgttatgtaattttgtgcaaaattgaaaatttaaatacattgcaaagaagatctaaaataaatatttgagctgctggagtcttttttttttttttttttccttttccattcttgtccttggaatctgaatgaattgcagtgagggtaattttgagagtctgataaagaagtgaggggttgttttttgtttttgtttttgtttttagctaagaaatttagaaaacaggtttgtgtgtgtgcgtgtgtgtgtgtgtgtgtgtgtgtgtgactgattttaagattcttgttagagttgcttaaagttggaagcctaaagtcagtgagaagttcacaaatcaggactttgtaatgccaatttgaaaatttagcttttgacctcaaaaaacattttttatctagtttgggaatttctaagtgttagaaatcaatattatattgactcattcattgttgctgatgctgtttataaaagtgaatagatagggaaatactgattcatatctcgtgaaatgaaaatgaaaggctttttagtgacttagaattttaaatatttctacatgagagagcagtagtatatttagaaataacaaagtaactggcaactgtttaaaactgaagttaattcacagctatccagtgcaaaacttcacctcaggtgatacacttttgacaggtaatacatacagtaagtgtatttttagggaaacagtttcattgttgaaccaagataatcatcattagaatgttgtatctgatttaagtgtctttaaacttaccaaggtattagattttagtttgaattgtctggagtagcggtagcggttggcacatttgttcttaaagggccagaaaataaatattttaggctttatgggccatgtggtttctgccacaagtcctcagctctgttcttttagtgtgaaagcagccatagatgatacctaaatgaatgagtatggctgcatcccaataaaacttcatttacaaaactacatggctggcctaagctttagtctgtctgcctagggagtagtttactgagccactaatctaaagtttaatactgtgagtgaataccagtgagtacctttgttaatgtggataaccaatacttggctataggaagttttttagttgtgtgttttattacacgtatttgactttgtgaataattatggcttataatggcttgtctgttggtatctatgtatagcgtttacagtttcctttaaaaaacatgcattgagttttttaatagtccaacccttaaaataaatgtgttgtatggccacctgatctgaccactttctttcatgttgacatctttaattttaaaactgttttatttagtgcttaaatcttgtttacaaaattgtcttcctaagtaatatgtctacctttttttttggaatatggaatattttgctaactgtttctcaattgcattttacag

SEQ ID NO: 134 - DNA, 14697 bp, Homo sapiens
  source 1..14697: mol_type = genomic DNA
gtaagtctttgctttctagactagcattgaaggcaatcctcattttatcttgaaagttacttttggggaaaaaaagtcaacataccaaatgctgctattagaagataactggagtgtgaaaaataaatgttttagcttcatatatttgtacaagaattggaagaatatgttaaacaatgtggaagaatgttagatacaattttatgttaaaagtcataagaagccctgctttgtcatctaatataaccaaatcatcactgttacatcacttcaaaacatgcagaacaaagtgttttaatttcagtgtcttttcatacattactactcaagtgtagcactagactgtgttaacattccattggtctttaactattaaccttcagtacttacaatgtggacggctaaaatcgttttgcatatccctaaggttgacagaaagatatttaaaggtttgctttggtttttctcttccaggattttacaggtttattatatgacttgtgtggtgggtaataggtctctaatgtaagtgttattttaatgtaaatgcaacatattcttatgctattgttttggggtattttactgtggttttatctatttagagcaagtacaacctagcttagttgtagggagtattacagtttattgtattaaatataatttcagaaggtggctatatattcattatccttgcttcctaaaaaccaggctgtagtgttgttcattttatgatttaattgttttaccgctaggaatatttgtgatgccttctattccactcaaatattttagctctctgacagaactcttaaaagctgtttgtttacattgattaatacttggagttgtcatgatcaaatacgatttattgctgtctaaaggtgagcccacaccatcttttacatttgataagctgagttgagaatatatagcaaatgcagttcaataaatcaattcaggtttgtctctttctagtttagaaattacgatcatggattttagttaatttgctatattttcattttcatataagaattaaatgaatgagtattcgttgttttcttgacctggctctgagaagacaggatagaagatttttttttttttttttaagcagggttctctcttactgttggaatattccctttcgagtatcatttttctgaagactgatgctatcctcattagagtgctcaggagtgcacctattggaaacaaacaagtagcgttattgtcaagtatgtttgcatgtagtgctgttggtggacacttcatggcttctataggtttctactctccagaattttctgtgtgaaagcttttgcttgtcagtgaatagtagagaagagaacacacccacagagtattaaaattaacctccacttcccaatgcagtttaaaaaggacaggatttgatcatgattttcttgctaatgatattgtttcttggaaatcataacatatttcctcttttctacatccttttccatctctcggaactggtgtaggaaaaagaaaatgaattgccagtaagtcggaatgaggattgcgttaggctggaaaagagacaggaatataacggtgaaagaaaaacaaaaaagaggtaaaaggaagcaaaaagtaaatgactaccaacacttagtttcataatttaaaaaaatgcttgaatggatatgcagattgtttttcaattgatactactctgttagtgtagctaataagttgagttgaataatataaaacccagtaaaaatgttctgcatttaaaaactcttccaagtgggaaactgccagttaggaagtcaaattacaaaatggaaaaagtgaaacttgatctctctgaaagaattggcagtcatcaaaaaaaaagaactaagttataaatggttgctggaagtggagggtctgagtaagctaaacctgaaacaatttatacaaaggtgtacatttataagtgagttgtggacttgattcagctagacctgggagacgtatataggtgtttcttctccttctgcttctaaaatgtgagactataatccaccttgaaattaattttgttttgcataataatattaggtcagaaaaccgtgcaatacttggttacttccatcaggcagaattctaatgtgagagtgtgtatatgtgtgtacaacaaggggatgtatctgtggaataattatgtatctacctacctacctaccttcctacctacctacctgcgtacctacctacctacctacctacctacctacctacctacctacctacctgtcatcatctgtatttttgtgtgttctgtatatgctgttctccttaactaaaagcattgtttattgtcttcataagacaatgaagtttactcacctctaactgctcacctatactaatattatttattttctatgagaaattttatcctccaacattttgagctttggcaagggaaaatcctaaagcagatgttcaattaatgaatttcaaggcaggtgtataccttaataaggaaaagtgcatatgtgcctggagaaccaacctttttatgtatcaaggcacaattttccagactggaaagtccttggtgcatgtgtgaacttgtataaatctattcacaggaatagaatacacctttatatatactgtatatccaagtaagcaaaaataccacccatgctattctaaaccaaggcattcaataattttttgctgcactcagcgagtcatataaatcttgtttttttttttttttttactactatgaaacaaaacatgctactcaggacacacttatgttatacttgctcaaatggatcttaatagcaacttacggtgctctagctagagggcaactgtagttagcagttaaaaaaatctgaaagaacttttcagctcataaaagttttatgagctgaaaaatgctatggggtgtgtttaacagtggttcaggggatactgaaaactttactcctgtctatttcaggagtaatttgcacacctgcattttgaaaaattattgaaaggctttctttgtgaacatgcatgaaggccagaatttgaagctgtaggaagagtttcttcaactccagattttttttaaaagagcactcctctaaatcacctgaaatgttacaaggtagtggaacagaactgtgaatgtttttaaaaactgacaaacaggtatttttaaatcaaagaataatttagaaatgtatggatattaaataccaacattattatgcaaatgctcttagttataaccttaaaataggcagcttattaccttttttaacaaacaaattcatatatactacttattatgtgtcaggcctgcttgatgctgtcttgttaggtgttctttttcctactggttttgtaatttgtatctacccaaatgtatgtgtgcaggtgaaaagcaatattaaattaaatgatagaaagattaagatgttggtaaaattattaatgtaatgctattaaagattaattacattttgagaaatatacaaaaagctaaaggcttattgtctaaatatggtgttatggagaggataaagaacaaggaacattggctctgagggcaggagccatctgggcagatacccatatttacatcattgattgcagagtcatcacttttttttttttgcgacggagtcttgctctgttgcccaggctggagtacagtggagtgatctcggctcactgcaatctctgcctcctgggttcaagcgattctcctgcctcagcctcccgagtagctgggattacaggcgcctgccaccatgcctggcgaatttttgtatttttagtagagacagggtttcaccatcttggccaggctgggcttgaactcctgacctcatgatccacctgccacggcctcccaaagtgttgggattacaggcatgagccactgcgcccagccaagtcatcactttttaaaaggtaatgtttatttaagataatctcatataattttttaaaatcacacattttctgttcttacagaattttaaagaacattttaattatagaaaaattactttctgatttgttattataagatccaggtcctttcttcaaacaaaatgttattgagagcccctgtatcttgaacagacaaaagagtagctgtgttggttaatgtttgagggggacatcgagaacctcactcccttgggacctcctcatctcctgtggtggtttttaaaataacatgtacctcacaacacagctagaaaaagaatgatatctagaccattcaaaataaagcaaaaacagttactcattcctgagagaattaagttcttaaaagtaaaaatgtttcaaaaattggtctgattatctatatctttatctcattacaatgatacacatttaacatttacctttgaatagcactatgcatggtgctgaataaaacacattaaacaaatattgtttcaatcttattgatgcctatgtgtcatcaagataatatataatggtatgtcagagtctcacatgtatgtgcaaaactaagtcatcatcaaactcacacttcgggcttcatactttcagaccactttttctatatattatcatgtttaaacttcaaagataatttgtgagacaactagggaaagcagatagtcaaacgaaggtacactgagtctgacattcttggcattgggtctagcagccctggccctctttggagcatttttgccatgaagtgattctctctcctgatgagctctgagaaaacaacaaccccctgcccaatggcttaggtactgccctgtctgtcaattcctgaaagagcaaactctgggaagactggtttctcattggcattctagtggtttgttaagagtatataatttagatttggttgctgctaatatggggcagtatgcatgctcttcagatacctgacatagcaaggaaagagtgtgctgaaattggtagtacgttattctgcagttctgggcagcttctttcctgtagagttttggagcacatctctgaaagtggatgggtctggtgcctgcacacctccgtggttccttttcctgagctccagctgtggctgtctgtcagagaagcacatttttctgcagataattagaatggcttcccccatctctcacggactgtcccaagtctagaaaagaattgagttcctcttctattagtcaaataaaagggaagagaatgtttgtcttcctttcctttctgtagtgttaagaaaataaacgaacttaatgattctaaattatcagtgagcttaacactgtactatagaccaaagattaccttttcaaaaagtcctttgaggtgaaatattttgtatacgtaatacatagatgcacatataaacacacacatatagaatctcaatattttaacacttctttgggtagttgtactaactcactaaccctgaggaaaaagttaagaaattgaaagtgttttcttcaaaagttgagatttaacaataaaaggtgttactttgataactaaaaggaactttattatcctcttcctaaaataaaccaatgcctattctgaaaatggcacttgcaattacaatttgccattatcaaagctaccactgaggtagaggcattatctaaaacaaataccacttatcatttattggcagttacctcgagagagacccatacaccatcttctagcagagcacagtcaatcaaattaccttcgggtaaagctatagcatgtctagtcgtttgacagatattaaaggtggtcataaaagaaacataaaccataggctgtgctccaaaggcatattggccagctaacattaacacaatcaaatacagttgtcatactaaacatatagttacacagtaggtgtatggtgtgacagattgtgaatggtaggtgaggtcagaaaaagaaggaatcaagaaaggcaggaagttacagaatatttcatgagaaagaggagacttacgtcagtctctgttggagggatagattacaatccaattatgagaggccagttattagccaattgcttcccaacttaggctcaccagtggggttaaggagccccaagtataaacagctgtttttctaaatagagtttctaaacagcttctgaaggaggccatgtcatcccagtgctgtttgacatggcctgcttcagaagctgaataccttcttaggcctcacgcagaaactagtacagttcatgaaaacccgagatactctgccagcttcttgaggaagcagtgttgtcacacttttctgagcttcagtgattcacacattttgataagacagcatgttctgtgggttaagtacatttaccttttcaaaatatactcccatgaagtatcatggttcagaattacacacttacaaagttaaatggcataaaactactttgtaaaaagtgcctacactctaaaaggtgatttaaaggtttatgacatcttaattcaagtgaatactgaatcagtaggattatagagcaggtgctctaagttagggaatctggagtcagtctctcctttgcttatgtgcaatgtggacccagggatttctcaatttctctgtcagaatttttaacatggtaaaatggctattattatatggaatgatatttcctaagctctgacacatactctttctccaaatcacagggtttatgaaacaaagatacacacacacacacacacacacacacacacacacacatatatgtatacacacatatatacaggtaatatacagatatattttttctaatttattcaacagtcaaataattacaatatactaactacattagaactggatttttttgaagtacattctggttaatattctgaaccaacatggagatgtagttagtttgctttgtaggatacatggaagaggcagttattgtgatagaaagagcctttggaaagagacctgggttcactgtcaacattgttacaggaggcactctgtatccacaattctgcatcctctgatttgaccaaacatggataaagaatatttgaaaaaaaaaaaaaaagcaccacaataaaaaagaacaatacagcaataaaaaataacacaaataaaaacccaacacactataataactatatagcatttacattgtattagttattataagtaatttaaatgattacttataatacctgatttaaagtatatgtatatgaatgtatgcgtaggattcctgcaaatactatgccattctataaaaaaggacttgagtaccatggatttttgtatcctcctagaaccaatcccccatggctactgagggataactatatttacagtctgtttggtcttgtataaattacttaacctccacaggcctcagttgttatataattaaaaatttataataatactacaacctcaccacattggttaaagaaggggatctttgagtgattgccacatgcaagtcactgtgacaggcatttcacatatttaatactccttcagtgactagaaagcaccaagcacaatgcctgatacatagtaatgacttagtacaaattaatctcctgtgggctttaaaaattatttcatttccaacttctaagtacaggaaaatatagactgttttgttctaaataggtaaaagccaaatgatcttaaaattcaagatcatttatgccacaagaagccaagtataattgtactttagtgtctgcttaactgaaataacttcttaaaaatccgaacccgacataggttgtgtttttttgggtggtgccattttgggtgcaaatcagaagcagctgcagcccttacttaaaatttaaatatagtattggctctataggacctaagagtagaatttattagctttttgcttttcctcagttgtgaaagttgggcttatgattttgataactaccaatttaatttttttctcataaacatcattttacaaattcttgatacatttccccaggtattgagcctagcttcttgcatatttatagaatgaatggacattccctgctgtctttttgttgttgtcaaggaaacccccagttctctacacagggattacattcttctttcttaatagctcttagatcgttcatttgtgcaatgaataaaaaatgtactcacaggtccagacagtgttcagaacttttttggtgggtgaggggcgtagctaaggggagagacatgcctagtgagaggagcaataggaataaaagaaaaggagaaagaaatgctggctgaggttccattttaatgaggtaaagctgaaaaatttatgctttaaaaaagacattgcctatttttgtcactttagaaaatgtataacattacttttcattgaggtcagtgtttcatgtacaaaaatgttagtttttaagtggctttgttaagcgaatagctccaagaatggggcccaggttggtgagggtgggatggatgagggagtggtgatgcgttttagtagaaactattttttcatttctatagaagtatttgaactttttttacaacctaattgaggtgatacaaaatataagaatattccttcatcctggggcatcatgtggtcatctgagagctcatttgattacattaaaaatcgtgttccttagagagagagtgccagtatttagactttttgagtgtgaatcaggagggaaacacacatccattgacaagaagatggatataattatttttaaaaagagtgatttgatcctttggaggaaaataaattctggtggaccttctaagtaactgctagaatgattgggtaatgtatacagcttttgcttctccataaataatgtaagtattaaaaaggagattttaaactagaaggaaggaatctctggagtgagaggaaaagtttaattgtatttcagtatctatgtctatgaaaagttgatatacggtgtcactgtggtatacccaaacttgtttatacacatgtataaccagtacacagtaagtaccatgagtggcttttagtgattttatctttttaccttgtagtacagtctccctggtgtctcacaaggctagtttacttactttggccatatgcttcacatagtaggtttctggaggttttgttttttctaagatgagagagtgaaaaggtaatgtatatttctggagagtatattggaatatagtataatcatcattttcactatgctgcacttcgggacggctgtctattgtattttttaaataggaaaacaaaatctttttgttacacattaaaataaaatccattttaaaaaagaaatgtgatcctaatatatctctgctgagtagattggtgtacatttacgtttaattaaaagctcttaaacttaaattgtaaaattccccaaagagaacgtgaactttaaccagctgcctatgcatcttagcaactatgttttgtgtctggtaacagtatgactggaagacttgtgctctgtctacaaaactttgttatgaagtacttaaaaatacttgtgaataatttgaggtcagctagcaataaagctttgtgtgaaatgtcattaaaaaaagcctattaaccatggtactgttatattcaagtcaagctgttaaaatacattcatataaacatagaaaagattatgcatacaccctgtagagttctgtggtttgattcttgaaatccaaacaaaagttatattgccttttgagtaaaattctagaatagagcagtcttttataagactaagagcttcatctaagagcttgaaatgtcaattacaccattgggttgctctgttcctatgaaatagagcacatctccatttcggaatgagatacctcctctcacagtagcacaggtgtaccccccaacccccttactatacaccgcaaagaaacttttctggtttgcaataatctctgttgagattctctaataacgtgtgtggtgggtggaggtggtgacaggaaatggggatgaagaggtaatttcagaggaagaataaactaagagggggcaagtaggatttggtgagatgcaaggagttagtgacaaatatttgggtgatagggcagggaaaaatttatctgcatatattaatagtagataggttttataccccacctctccctgctatgagatgttaaaagtatgggaagaaattatactgacagaataaaatttagattgtatgtataggaaatgtcagcagaaaattttaacttgaaagccctgggtaattaacatttctctctccttcaaactgatattaagaaatccagccaggtgcagcggtacacactgtaatcccagcactttgggaggctgaggcaggaggattgctcaaactcaagagtttgaggctgcctgtaatggtacccctgcactctagcctgggtaacagatcaacaacctgtctaaaaaaaaattcaataaaaccatttgcaagttgtcgcgaacttatttaaagaataataatagttgcttaattgtgagactattactttcagaaaaaggaaacaaaataatttcaactcccattttgcatattttttgaaattaaagaattcccatttagtagacaattttttttctggggatctaatatacaaaattaagactgtagttaataaaattgcattgtattagagattttgttaaaaaagtaaatttcagttgctcttctcacaaaaagatggtatatatgttaatctgcttccttttaccatctatatgcatcccataacatcatattgtaaacctcaaatacacaatagagtttattttagaaaaagaaaatttctatcatacttattaaatgagcatattattttatttatatgtagattttcttctcaattacttaatttattttgatgtgctgccagcttcatgatgagaaacataagatgaaactgcataatacatttctgttttctatcattttgaaggcaagtcagatcaaatagttgcgaggtgggtggagaaaggaatcctaatctaaatttaatgattagtacatttgcaataagtacattccaaaagtttcccattaaaataggagaaaagagtttagtaaggccagttctctaacttactggcaggaacatttgtttcagagagagagagaggaagggggcaaggagagacttggaaagtatagttaggtctctctgaagttgacaagagagtgtttgccctagggtctgatacataacaggtactcagtaaattttgagaaatcaatgagcatctgaagagatattacattctgggcagcatgcatggttgtggtggtagtgaatttaattttgtgtgcaaaaaccgatatgaagcaatgctgtgtttgtgaaatgtatgcaaagattctgtctctgaaatgcttatactgctgtgattgaaacattatcatatttatttaggttagaaaatggaatttactacatctgagttggtttttggtgagaaattctgatatgatagtctaaaatggcaaggaagtccttatagatctatgagcaattggaagtgttagagttcttgatctgagagaaatatgacctaaaagaatattatactttgttaattggagctaaaatcagaaactataaagtgaatgccatggtctttagtagaattaagtattcttaatatgagttgatagttagctaaattattatacagtactgatttacaattagagttcttctttattttctttcccagaggaaaacaaaaaatttcagtgagcattatgaccatccatcagtttcttaccatattgacatgtgacatgttggcatacctttgtgtcttctttctctgcttttctccaccccactttttttagagccaccaacatacttgacagaacttccatctgtaattactcaataagaagatcatgagatatgtttgtatcagtcttatttttttgaagtaaagaatttacttagaaattcaagtaaatctataatagcaatgagtgttcttaccctattcttggcctaggagtttgtaaatatacaatattaatcagatatttccttatttatccttgtgttttgctggagaaacccagctgaatggctcgttttaacttcattatttacaaaagggtacaaaatatggtagaggttctttatatgcttgacactgacccatgtttcttatttaaaatcttttctctgtacttaaatgaaagttttggtgtcaccaaacagggtaagtaagaatttagtgtacctttgtctaatatttcttaatcatgaattctagttttatttaagttaatgaagcaaaataaaagagttgcttgcatgtaaaatggtagtgtgagcagtttaagatatgcacatttttaaactccagttaaatcccatgaagttgtactgaatagtttaactgagtctggcttaattcaactatattcaaatagttttagcaatgagagactcctggcttggataaaattattgatgtgaatatttcaagagattcttttgtacagaaggcattttaaatgcttctgctcatatagtttaaacattttcttcacattctgttttcatagcacaaagtttaccttcaatgcaaactgaattaagaggatgttatcatctgaatattttatggtgtcctattttaaaacatatacaccatgggtactatatataagatccgagtaacaactttagtgacctaatattgaagaaacctagtctttttagttacctatatttttaaatgacaaggcatttaatcattttcctgcactgagcaattagtaacaattgcaacatctgtgtcagaaataatctgtattcattttatgtttttataacacactagagttatgtatttatctcgcttctctttgtggtagaaatattttctcatttatttgaatacccatatgctgtagtttaagtagttgaaaagctgaatatacagaatggaatggaatggagagagaagaaatgaactgtagtgtgtaaaatttcaataggaagggtgtttagttaggataagaataacccagtcctacacagaagtattttagtgaaataatttagtgaagatgtggtgggatacaaaagagagttttctttcttgtttctattagaataaaagggataaatgtatatgtctttgcattacataaaagtcttattgtctgggttttttaatttaaaaaaaattcaaggagcttctgtggaatttgtcttggtagttcctacacttctatatttgtcttgattcataaaatagattagaatataagcaacactgattcctcttcaatagggttttttcttctctgatgaaacagcaaaagctagatattgtttcttctatacatagaaggaaatagcttcttgcaacaggaacaattcaggagaaaacagttgttttctcccctttagatgataggttgggaagcagggttggctccgtcataatgatttctcctaaacacttctcaggtttggcctatgcatgtgtgttatagattggggatagtttgaaaactcattctgtagtattattcctatgggcagggtggtgagtagtgtgtaaattctttgtcttctttatgggtcagtatatccacaggcacattttcatactgctttgtcactgaaagtaaggcagctgcagtggcaggaccctgttctaggacagttgaatgcctctatgatgagacctcagaatttcctctttcctagtgcccaagacaaggagctttgctgatgtatttctgatagcagaaaaggccattgagcttagtggttggtaccatatggcaatttacaatctgggaaatattctgatgatacatacttttcgaggaatgctagttagaatatttagataggactcctgaactttctttgagaagatgttgatgacaagaactaaaatcagcctaatctgggtcacatcccaggaaggataaaggtctataggtgtggaaggctctttctggtcctttcagtgagctatttccaatagagcccgcctatccagagcttcccactcttgtgcataggatgtggttaagctcatgtctcagtgccacagtaggtagaggatgccattgcaatgtaaaagggctataaataaagctctcttgtttttccataaaacagtctgctctagaacagattataaaggggccagaaggaatctcttctcattttcttattgaatagagagtgtataaattattcccttacataaaggacaattactttttctatatagatcatatatagaaatagagctatagaaaaagtaattaattctatatgatatggcctcaatttttaatttttaaattgtttttatatgaaatagtcttaattttactctttttgcagttcacacaaagatgaattcctgcacttcaagattacattgtatatgtgattccttgcttcattttaaggactatgttgttttcttaaatgtgttgatgagtctttataacctgttttaataatgttaaattgaattcatttttcttattgttaatacaaaaacagtaaatttgaagactgagaaccatataagagggtgattgcacttattatgaaaagatttgaatccttctttgtgtgtgtgggtgtgaccagccttgctatcaatttcttctgtcatacactgccaaattttctatttaagtattgtgaaaactctgtttttttcag

SEQ ID NO: 135 - DNA, 9077 bp, Homo sapiens
  source 1..9077: mol_type = genomic DNA
gtaaaaaaaaaaaaaaagtaatcaaaatttgtttttgcagagactatagggacaaacataaagtaattacaaagttatacagttttgagaaaagcagatttagttgggaaaaaagcactatgtttaaaaatttagttcactacatttgaaggaaattttattcactaacatgtatgtagttgatttatgtgtgagtttttgatttgcaaagcaatttctgcccgactgcttggatcaaataaaaatgttaaacgtgattaagtcaaataaattcacaagttacacttaaaacaagttttattatgtttacagaaatgttttatgaagaaacatagtaagactattggaaggaacatattcattttgattttagcattaactttgggtggttttaaatacctgaagcattttaatataataaccatttattaatgtgcctcgtgttttatttatgaaagcactctattttttctgttggtaatagtgttttgactgctgtaagttccattatgatgagacccttagggtagctcaggattggcaaactttctataaagggcagataaaataatttaggctttgctgttcgtgtatagtctcttttgtaaactactcaactccatcattgtagggtaaaagcagcctcagatagtatgtaaatgaatatgtttggctatgttccagtaaacaaaataggcgatgggctcaatttagtccacaggttgtcatttgttgatccctggagtaactcatacaaggtaatagtaattctcatgacagtgttatgaattaggttggcgacattaaaggaatttgtaccacgacacattttgaataaattctagatgttagtctttcttttgtaagaagcaaattgtgtataaaatttgacacagaattgccttattgatcaaatactatttcatgtaacgtaatgattggtagaaacagaagttacatgaggcttttatgaaattctgttttgtttgaaatgaggtatatagaagctataagatgttgtatgtaggaagaactgaactatgtacctataaaacatctagatcagagatgaccaactgtctaagtgccaaaatgggctaaagattaatacaaattaatagtttgattgtatttagcctgaatctttttataactaggaatgtggcagaattcagcattcatgtatctgcatggccagataatcctatactgtctaaatgtcttaaatatcaatttctttaaaggaattagttatgtggcatgacaaaatgtgttaactttccaaatatacttagaagtagttagctctgctcttcctgagtccacttctcgtattcccactacatgttttatgaatcctatttgtaggggtgaaaaggggaaggatagaagcatggaggcttagatttaaggaaattataacaattttgaagtaataggtaacatccagaaagcttaaattcaaaagattgaattattagcctaaagactgctaaagaaaagaatgttcatttgattgcagtattgattatggtcttggtcagtatttcttctttaatcatttctcatcaaatgaatcaacatattgagggtatgtgtgtgtgtgttttcagatggagtctcgctctgtcgccaggctggagtgcagtggtgccatcttggctcactgcaacctccaactccctggttctggcgattctcctgcctcagcctcctgagtagctgggattacaggcatgtgccaccacgcccagctaatttttgtatttttagtagagacagggtttcacggagttggccaggatagtctcgatctcctgacctcgtgaccgcctgcctcgaccttccaaaatgctgggattacaggcatgagccaccatgcccagccaacatattggtatattgaagctcattaaatgagttccactgccccattctttctgatgatggaattagactaaatttgtcaaactgcaatataaagtacctactttatatatgaatatcagtcaattagttaccacgtgcacagttcaccaagtttactagacaattaagtggtctctgctccctgagtttatttcttaaaaaatatagccttaacttaaagacctaagtatatagttagcataggacagaaactgtaaaggtacacctagaaaaatccatgtaacataagaaatcaaacatccaaaacttacacacatgttatttgtatccacagtaacaggattatttataatacaatgacatattttaggtaagatcacagaaattttgagctggtctttaatttataggtgatctccttcaaacctagaagcctagtaaatgacttactaaaagtaatgacctaagttgatagcagtcagggtttttggaactcatgaatcctagctccttattgaatgttcttgtcactatatcattctgacttctagagttgaaatgaaattatagaggggggatgcattggattaactttgggaaatctttgtaagcctaaacttcaaattaaactgcagaaggtaagagaatgagtgtttcaaatatatttataccagatgtattaaagaacattatcatgaactgatttaggtacccactttgatcagtctcagatttgtctctgttctcattactaataaccttgactttgttcaaatgcaaatccaattgctatgcctacagtagcagcacttctcaagtaaatccatacccgtttgccgctgtctcattcacattggaggcagagccttcttttatgtgcaggttaacttaagatatttttatcagttcctgtttcctaataaattagtgtttatagcaacagaaaaattgttgaagcctttgttgtactttagaaagtaagttcatttaatttgtcaatacacatcatgtaatgaagttttatttttattaaggacccaaattccttgtgattacttaaggaaaactgctgttgcttcatgattgcccaaaatttcgaagaaatctcttcaaagacttcttcagtagtccaaattatatgttaaaatcttcttttctgcttagctcttattttacaaatacaaccaatgaccatggccatctaagcacagcgtaggctgaacagggacatttgcaaaggtgaatataactatattggaaatcattaagaattaatttcttgctagtttatgggagaaaataatacataagttgttgctatttcctatttgtagaacacctaatcttgttttccacctaatgtgagaatagttaaccatttacagtattaatatgagaaagcaccaaataaatttaggtactttctaacactcagtaatggcacgaaggggtggcttcagagagttttatcatagccctcctcgtcctcatcagctccctaatgttcacttcaaataaatgcagtttgggtggggaaagcatgcttgctttgcttgctgagcttcaagacactttccccagctcccacttctaactagatggtcactggatttccccctatatagaaatcttaagccactgctcttcattccttccacttctaaaataaaattgtactggtattggactatgtaccttattcgtaataaatttgtaaatagcctggcaacctatttggggtctgtttacatgatgagtccttttctggattcagaggttgaagtgaagaaacgtttttcttttggaatttcagcattccatggtcattcagtttctgcaggttagcttgtgacattttggcactggatgcccgtaaacttaaacttgcaatgtgcagagtaggaattccttactaccttcttgggcctgagtgagtcttggtgcctaaaactgagtttgatgtatgtgggctaaaatgtggtgtaagagtgagtaacaggaattgtttatttctattgctgcagtagtcatcggagcccttaggaactgctattttcattcctttgtttaatcacaatgtcagtcgtttaattaaaatgataccatatatatggtgtttttaaactttcaaatatttagtctggcctacattcaagcctagcttctcagactgggtgctacaaacaggttacaaccatgcctcggcctgcaaagtgttcagagaagcttccaggccagtgagttctggcttcaagcatcttgtccagttaacctggtatgccccacaactttaaattgttattttactgtgaaatgtaaaaggttgggaagcattgtattaaagacagctaggatttttaaagtttaattttatgctagccatcagcaagaacaggaggaaacatagtaatttttgttacaattttgtgcccactaagcacaggaaaaaagatttaaaaatctaccatttcttcatatacacactgaatcaagaccctctgtcaagtaatgcctgtccacttcaactgggcaaaaaatgttacccttttttttggtggaaattctatgatgtattatgtctagtgtttttttttttctctctcctcaaaagcatgaccttttagataacaaccctctgatagaaatagtaagcattacttagatttttaatatacaatcttgtttcttatgacttcatatttgacttcatcactacttttgttagtggatgcatccattaagcataagcatgctgccctactctccatcttggaaactgagattggctgtgaatattaaacagatgcatgtaaagtttcataaatttagagtacctaagcagtcagtgacaatatgcattacatattgtctggctaacaaagggaagaaggaaagtgatctagaagagaagactaaagaaagatcatttgtaaatatttttcttcctcctttacgcagtagaaagattcctaaaaatgtatgactactgtaaataatgtaaatactacttacattatgttagtgttaaatgaaccaagacagtgatttccagatgttactgatatatctaggccattgatatgctttggaaagacttacaggtgtttctgtgcattctgcaggtttacgaatcaccctactaatggtccttgtattttacagaaactctgttaatgcatcctgagtaaaattatcatgtattgtataacagaactgtacattttattatctcctgatttatctttatacaagattagatttggggatattattttttaagctaatattttggtggacaagttttagtcattcatgctcagcaaaacaacgttttaggatggtgagagaagacaaagtaattgatagaagaatgtggacactacttcaaaataactgggaaattatgaggctgggcacagtagctcaaacttgtaatcccagcactttgggaggcagaggtgggaggactgtttgaactcaggagttcgggaccagcctgggcaacatggcaaaataccatctcttaaaaaaaaaaaaaaaaaaaaaaaggaagaaacaaacaaaaactagcagggcgtggtagtggtgtgcgcctgtgtacttaggaggctgaggtgggaggatcagttgagcctgggaggttgaggctgcagtgagctgtgattgtgccactgtactccagcctaggcaacagagcgagaccctgtctcaaaaataagaaaattataaaatatttgtgttttgtttttttgagacaggatttcactctgtcacccaggctggagtgcagtggcaccatctctgcatattacaacctccccacacacctcgggctcaagtaactctcccgcttcagcctccagagtagctggcaccacaagcgcataccaccacgcacagctaatcttttgtattattggtagagacagggtttcaccatgttgcccaggctggtcttgaactcctgagctcaagcgatctgcctgcctcagcctctcaaattgttgggattacaggcatgagccactgtgcctagcctgtgttttgttacttaaaataaattattgcatattgaaaagtatttttaatgcagtcattgagccaacagaaatgttttatggggttccactcttgaactttgttcttttctttaaaatacagtgttttttagaagagcccacatcatgacaatttacaaataagccattaaactcttcatgttttaagaaaagatgagttcatttattcaattcttatggtatgttaagtttgcatttagcatctcatttctcaaaactgtcacattggattgttactgttatttacttttgttttatagatgaaattgaagcacgtagaaattaataatatgcccaaggtcacacagtgaataagggataaagctcaaattttaatatgaaccctctgacttgaacccatagtcttatccattttgctctctactgcctcccaggcagtatgctaccagtccccatggccatgacccttaccccatctctctcagtcatcccttaggcttatcttatttcttactatatcattgtaatttttttaaaagctaatttataaaacaagtagggtaaccagctgtcttggtttgcccaggactgcccagttgtagcactacacgtcctgcattctttgaaacccctcagttctgggcaaactgggagttggtcaccctcagcctattccttacccaaacctatccttgcatctcatttcattcttcttctcacaaccatgatctgaggctcagagatgagatacgaggttacagaattagatgcaagtcagaattttacacacacgtacacacacacggagctaggtattaaaaagcagtgtttatacattttggtttttctgtatccagccacttcaaaaatagctttgtcaaaacgtggagaaatagtgcatcctgtctgtcatgtttccatgaagactttcccatgcatacaaagcatgtgaggagtattggcacattacacaccaaactagatgggaatggaatggtgtaaaaagtacattcacattttgttcaatattttgtattatttggaacttttataagaattgttaatgtattatattagtaaaagagtattcactaaagatcttcagcattttatatatttataaagcatatttttaaaaattaataaaagggcatatacatttttattcagtaaaacaacagaagctttagtatatacttaacgtttctcattatggcaaagtgggagggaggaagaagagaggttgtttgaaagaggtggaaaaaagagagaaaccagaggctgagaagagacagaccaaggcagaaagagaaaataggacagttgaagactcttgatgtttctgattggtttcaatatacaagacttattgtcatttgtgcagattgggtttggtttctaggttctggctggtagagaaacaggaatatacaagataactgagtttggataaaataaaaaattttaatttggtggggcatggtggctcatgcctgtaatcccagaactttgagaggctgaggtgggtggattgcttgaacccagcaggtcaagaccaacttgggcagcaaagtgagaccttgtcactataaaaaaattaagaaattagccaggcatggtggcacgtgcccgtgttcccagccattcaggaggctgaggtggcttgagctgctgaggcagaggttgtggtgagctgtgattgcaccactgcactccagtttgggtggcagagtgagactctgtctcaaaacagaaatttttttttaaaggttcagcagtatattttatgtgttcattcagctttctgtagaaaaaaattgaagccagacttacctctgtgagacatgctatacatgaaatgtatatcaagcatttggtttagttagatggcacattgaagtactataaaaaaggacttttgtctgttctgaactttgcttcagtgaacacaacttgcctaactgtatttagtgtctggtttataagacatttgacaatatggcagagagtataataacatattttatatgactgatatgtttatgttctaaagtggagatctgttttaaatttgatattaacttcagagtccaggtacattctttcaaatgtcatcacattaaggagtagaataagaatctactcctcaaataaaagttaactatcatttatcctgttaatatacttttcacattttgtatattttttcagtatgacagaagaaatacctttaggttgtgtctacatgactaggcaaagttttatgggccctgaatacataaggctgtatgatcataactcagaactcatctgtatctttgtttgatgataatcataatcttaggttcaaattagctcgaggggaactggctggttacattgttatttctaattgtgttggctttgcacaaattcctcctctcttacatttcataattttccgcttgaggcacatgatcctgttacttggttaaatctttaagattttctttggtgttttgaattaatgggttcaaagagggtccaactttataacatttatgctatatatttttattaactgttgaatgtttgactttgatattctttttctttttatatttaaaagggttggtatttctttattacaaagaactgcaaaagaggatatcgccttaccttacaaaataagatttaggtttgatttacaagcaccaccaaaaaacatttctgtaagtgaatattttataatagcaatagattcccaggagaaattgttgaaaccatctgtatatatctagaagaagatgctcatctctttgggattgtttagatcacattttcttttttaaaaaaagaggattgatgtttgctttgaaaagttgattaggctttaatttcagaacttacaaaataatggctcttaaagctatatcacttattcccatcggtttaaaaatagataattttatcatcgtgaagtatttgataaaacatgtttctttttacacgtgaagcaacagagtttgtaagtactgagcgttctattagctacaactatgtcctgtttccaaaataccttactcagcattcagtagttttttaaaatggtattttcatgttgttgaagactatagaacaaattatgtcatttttcttaatacacag

SEQ ID NO: 136 - DNA, 5790 bp, Homo sapiens
  source 1..5790: mol_type = genomic DNA
gttggtcttacttctttctgaagtctaaatgccttacattaactgtgaacgcatctcctcgcgtcggcattgcatgccacaccctgcctctccaacgtgggatgcctgacgctctcctcaaccctccgctctcctctgtctgtctgtcctcccgcccccagcccctgtgcctcccacttcctgtagactctgtctctctgtttttatcgggttctgaatgggggttttctgtttggggtggtttgcgtcttttgcagagaaagggatgggttttcccagcgcagcacctctctcttgccccatcccgcacacacatcccctacactcagagacaatagaggcaaatccactcccagccacctctcaccactcctgtcccccattcagctccatggaccccaggccccaggaaagctgccaactgtctcctcgcccctccagctctctccatcctgctgtccccaatcctccatctcaagcccacaagatctttggccttgaccagcagagacttgactctccaagtctgataaaggagacctgaaggccaggcagtgtgccggcaaagactctcaggcagaggaactcagaagtgccagacttggatctggtagcttcatgtggggctggcccactgaggccctctcctggagccttgaactgtacgtgcacacgcagtcacacagtcactgcacacagacactgcacacacagtcactgtgcacacactcagtcactgcgcacacactgtgcacacagtcactgcacacagacgctgcacgcagtcactgcagtcactgcacacagtcactatgcacacacagtcactgcacacagacactgcacacacagtcactatccacacacacagtcactgcgcagacactgcacacacactgcacacacacaatcactgcgcacacacagtcactgcacgcagaaactggacacacagtcactatgcacacactgcacacaccactatgcacacacactgtgcacagtcactatgtacacacactggcactgcatgtagtcactatggacacacactgcacagtcactgtgcacacatacactgcacacactgtcactatgcaaacacagtcactgcacacagtcactatgcacacacactgcacacacagtcactgcacacagagccactatgcatgcacacacagtctgcattcacacattgaacacacagtcgctatacacacacagtcactgcacacacagtctatgcacccacacactgaacacacagtcactgcatgtacagacactgcacatagtcatgacctcttctctttttctcactcattctccaattctctctctctctcgctcttttttttttttttttttagacagagtctcgctctgtcacccaggctggcgtgcagtggcacaatgtcagctaactgcaacctctgcctccccgtttcaagcaattatgatgcctcagcctcctgagtacctgggattacaagcatgtaccaccacgccaggccacttcttgtatttttagtagagacagggtttcaccatgttggccaggctggtctcgaactcctgacctcaagtgatgcacccgcctcagcctcccaaagtgttgggattacaggtgtgagccactacacctggcctctaatcctcattcactgttcctgtctctgtgtctctcacatacagtcatgcatgcatgcacgcatgcacacacacacacactggccctctctgctacatctacccaccctgtacccccactccagtacatactgcacacatctctctccctcccccacttctcagccccttgcacaccccttgttctgttaaatctcaactgcctctgcccctctcctacccaccaatgaggcccttagagggacgccccaatggcatctttgccctggaatcatcccttccctgctggcaatacacatgcattcacccaccaaacatttaatgagcccctatttggtgccacagatggaattatgggcagaagcagacaccattactgtcccctcttaccacatacagtcaggtgggggaggcaggcatcggtcaaataaccccttgactccacttaaaattatacctgcactgcgagctgaaggatgagcagcattaacaaggcagagagagatgcacagagcattccaggcccaggacagcacatgcaaaggccctgtggtgggacggaacctgtgaggggtcaggatctgcaagcgagggaatgtggctgatgcaaagacagccgagaaaggctggcctggagacagccgaagaaggcagaaggggacaggacccggggctggggagggcggggctatattgtggaatatgggctttctcctaagcaccaggaagggcctgggaggataggaagcaggggaggcgcgactggtcatgtgactagacaagctcgctctggttgcagggcagggaacagcttgacaggaggctgggctggaggtgggcaccaggaatcgcagcaagagatgacagtggaggagagagaacagtgggagggttgtcctctgcaggacccagggaaagatcaggtctgaactgagatgaggtgcctgggagcagtcgggtctggcttaaaactgggagataggctgagcacggtgactcaagcctctaatcccagcactttgggaggctgaggcaggaagatcacctgaggtcaggagttcgagaccagcctgaccaacatggtgaaaccccatctctcctaaaaaatacaaaaattagccaggcgtggtggcaggtgcctgtaatcccagatcctcaggaggccgagacaggagaatcacttaaacctgggaggtggaggttgcagtgagccgaggtcgtgccattgcactccagcctgggcaacagagtgagactctcttaaaaaaaaaatactgggtgatagaggtgagcgagtgcaaggaaaggaccaggttgggggaagagaataggtgtgggcatagcaagtttgaggtgcctttaggacatcccgaaataagtcagataggcaggtgttgtgggggctgcagcttggagctgaggtctacaagtagtaggacttttctggagcccttaggtgggtggtctccatatccttctgagcacttgaggaacatctgagcacagcactggaaaagaaaagaccacaaggacgctgtcctcatgtcttccaggggctgtgtcccacccccatcacattctagccaggaagttcaggggaggtgttgaagagaggaagctgcacctcccaagccatggattgaaatgtggaaggcaggaagagggaacttgtcagaagttctgggggcagtggaaagaattggtactgatgcaggaagagatggagggtggatgagggcagactagtacccttcccccactgccccaaacccttcccgtctccacccctacctgcctcatgtgtctcctcccccacttggctccaagaagggaagcatgttttctgcacgcatctccctgccagatccctggcttttttgcatggttgcaagcttcccctgctctcctccaaacccccctcctgaggctgcttccagggtccgcctgccttcgcatgcctggccgagtccacatgttatgatccgccccatgaaagggatggcttgtactctggggttgaacgggagggggctggggatacctgagccatcggccccatccccaggtggagctgggtggccaggcagggatgggggtcagggcagcagggcacagagagtgactctgttagccaagctgggtttggggcttgttcgaggcactggagacattctcacagcacttgagcccagtgtggtcagggtaggatcccccagcccccttccccatcctagaggcctaaggacgcactgatgtgtcccagagagcatcctagacattgccatcaaacccagaggcctcagaaattccttgaactccagtccttgcctctcagctcccaggccaaagccagcacaagacacagatctggcagccagaaagccctctggaagccaccaagtaggatgcccatgtcacccaaactaggacacttttgaaacaggagggaggctgtgactgtatggtcaccctgtgccatttggggggtgaaggttagaccaagttaaatcttgctacgtggcctgtagcaaatcctacaaatcccatagaacaagtctgattaagccccttcccttagtgtggagagaccctctactcctcctgccttcaccctgctgggtactggccagcgaaggagggtttccatgtctgcctgaggctggggtctcaaactcaaatgcctctgggggccaggcagacaccagtcaaccaggaaagcaagtgccatttctaaaacgtgaggaccctggaaaactggagatcatgtggcctgcttccagggagcaatcgcagcaggcctggggttgccagaaagccagattggtgggcaaaatctcttgatttttaaacaatggcaataatttttaattaaaaacaaggacaaatgaaaaaacactgctcgggcccaacaaaacagttttattagctagatttggcccactcgtgacttcgagagtcccaccccccccaccaaggtcccttgaagccccacaatggccacttaactctagctggtctcctccctgactctccaactctctggccccctggttcttctagcttgggtgggaggaggcagaggcagtgactagacagggggtttttgagcagaggcagtggccacccagggaggtcctgggggcagggatggccccacctcccggcccccagcacccgccccttggtgggcccgggctgatttctgagctcacccacccatgggagctgagtgcttcctgcttcctgcaggcctggtcccgtgctactccacccagccccagaagctgagaagccatccctgagaggggggaaaagggccccaaatgcatcttctccgactcagcgggcagcgaggactcaccctgcagccgaacagtcccagctccctcccgtcctccccattcccgctcgccaagggggtaagaaaagatgctcttccgcttctcccaattggctcgagccgctgctcctcttggccgtggggtgaggtcagggcgggcaggagcgggtgggcagctcggcagggcagggcagggcagggtgcccggtgagtcccgtgacagatgcatttctggcccggagcgtaacatgccctcggaacccgcacatgtccaccaggcctgactgtgctggcgacctccacccccacccccgccctggtgtttgtgcatcgtacacgtatgatagattccgcaacttgaccggcttgtgtcctttcgtctcagtgcatttggttgttgggagaaacaaaaaccatctcgatttttttcctgattggatgattcggatatattttctttttcttgttcttttgttatttcttccccatccccgttcctttttcctcctttctttttcttttcttttccccattgtgggtggggctggcagggagggcttatgcttttgagttgatgccttttcctccctcccaccctctctctcccaacattattcctttttcgagtttttcctctgcatcattgcattaatagtgctttctctctccctccttatttggggtctggcttgcttttttcctgttggttggcttcatgtaggggcctctgtgagtggtgacagctctgagccttttggggtgggtggatggtcacccctcttcctccatctccccag

SEQ ID NO: 137 - DNA, 1137 bp, Homo sapiens; identical to SEQ ID NO: 68
  source 1..1137: mol_type = genomic DNA

SEQ ID NO: 138 - DNA, 12929 bp, Homo sapiens
  source 1..12929: mol_type = genomic DNA
gttggttaactctttatcctactgatattgttaagaatttatttatttatttttattatactttaagctctagggtatgtgtgcacagcgtgcaggtttgttacataggtatacgtgtgccatgttggtttgctgcacccatcaactcatcatttatattaggtatttctcctaatgctatccctcccccagcccctaacccctgacaggccccagtgtgtgatgttccccaccctgtgtccatgtgttctcgttgttcaactcctacctatgagtgagaacatgcggtgtttggttttctgtccttgtgatagtttgattagaatgatggtttccagcttcatccatgtccctgcaaaggacatgaactcatccttttttatggctgcatagtattccatggtgtatatgtgccacattttcttaatccagtctatcattgatggacattcgggttggttccaagtctttgctattgtgaatagtgccacaataaacatacgtgtgcatgtgtctttatagtagcatgatttataatcctttgggtatatacccagtaagggattactgggtcaaatggtatttctagttgtagatccttcaggaatcaccacactgtcttccacaatggttgaactaatttacagtcccaccaacagtgtaaaagtgttcctgtttctccacatcctctccagcatctgttgttcctgactttttaataatcgccaatctaactggcgtgagtggtatctcattgtggttttgatttgcatttctctgatgaccagtgatgatgagcattttttcatatgtctgttggctgtataaatgtcttcttttgagaagtgtctgttcatatcctttgcccactttttgatggtggtgtttttttcttgtaaatttatttaagttctttgtagattctggatattagccctttgtcagatgggcagattgcaaagattttctcccattctgtacgttgcctgttcactctgatgatagtttcttttgctgtgcagaagctctttagtttcattagatcccatttgtctattttggcttttgttgccattgcttttggtgttttagttatgaagtatttgcccgtgcctatgtcctgaatggtattgcctaggttttcttgttgggtttttatggtgttaggtcttacatttaagtcttcaatccatcttgagttaatttttgtataaggtgtgaggaagggatccagtttcagctttctacatacggctagtcagttttcccagcaccgtttattaaatagggaatcccttccccatttcttgtttttgtcaggtttgtcaaagatcagatggttgtagatgtgagttgttatttctaaggcctctattctgttccattgatctatatatctgttttggtaccagtaccatgctgttttggtcactgtagccttgtagtatagtttgaagtcaggtagcttgatgtctccagctttgttctttttgcttagggttgtcttggctatatggactcttttttggttccatatgaactttaaagtagttttttccaattctgtgaagaaattcagtggtagcttgatgtggatagcattgaatctataaattaccttgggtagtatggccattttcccaatattgattcttcctatccatgagcatggaatgttcttccatttgtttgtgtactcttttatttcgttgagcagtggtttgtagttgtctttgaagatgtccttcacatccatcccttgtaagttggattcctaggtattttattctctttgtagcaattgtgaatgggaattcactcattatttggctctctgtttgtctattattggtgtataggaatgcttgtgatttttgcacattgattttgtatcctgagacttcgctgaagttgtttatcagcttgtggagattttgggctgagacgatggggttttctaaatatgcaatcatgtcatctgcaaacagagacaatttgacttcctcttttcctaattgaataccctttatttctttttcttgcctgatcaccctggccagaacttccaacactacgttgaataggagtggtgagagagggcatccttgtcttgtgccggtttccaaagggaatgtccagtttttgcccattcggtatgatattggctgtgggtttgtcttaaatagctcttattattttgagatatattccatcaatacctagtttattgagagtttttagcatgaagggctgttgaattttgtcaaaggccttttctgcatctattgaaatagtcatgtggtttttgttgttagttctgtttttgtgatggattatgtttattgatttgttaatgttgaaccagccttgtatcccagggatgaagccaacttgattgtggtggataagctttttgatgtgctgctggattcagtttgccagtattttgttgaggatttttgcatcgatgttcatcagggatattggcctaaaattatctctttttgttgcacctctaccaggctttggtatcaggatgatgctagcttcctaaaatgaattagggaggattccctctttttctgttgattgaaatagtttcaaaggaatggtaccagctcctctttgtagatctggttgaattcggctgtgaatccatctggtcctggactttttttggttggtaggctattaattattgcctcaatttcagaacctgttattggtctattcagaggttcaacctttcctggtttagtcttgggagggtgtatgtgtccaggaatttatccattgcttctagattttctagcttatttgtgtagaggtgtttatagtattctctgatggtagtttgtatttctgtggggtcagtggtgatatcccctttatcattttttattgcgtctatttgattattctctctttacttctttattagtcttgctagcggtcatttttgttgatcttttcaaaaaaccagctcctggaatcattgagtttttgaagggttttttatatctttacctccttcagttctgctctgatcttagttatttcttgccttctgctagcttttgaatttgtttgctcttgtttctctagttcttttaatggtgatgttagggtgttgattttagatctttcctgctttctcttgtgggcatttagtgctataaatttccctctacacactgctttaaatgtttcccagagattctggtacgttgtatctttgttctcgttggttttaaagaacaactttatttcagtcttcatttcattatttacccagtagtcattcaagagcaggttgttcagtttccatgtatttgtgtggttttgagtgaatttattaatcctgatttgcactgtggtctgagagacagtttgttgtgatttctgttcttttacatttgctgaggagtgttttctaccaattatgtggtcaattttagaataagtgcgatgtggtgctgagaagaatgtatattctattcatttggggtgtagagttctgtagatgattagtaggtctgcttggtccagagctagttcaagtcctggatatccttgttaactttctgtctcattgatctgtccaatattgacagtggggtgttaaaggctgccattattattgtgtgggagtctatgtctctttgtaggtctctaaggccttggctttatgaatctgggtgctcctgtattgggtgcatatatatttaggatagttagctcttcttggtgaattgatccctttaccattatgtagtggccttctttgtctcttttgatctttgttggtttaatgtctgttttatcagaaactagaattgcaaccccttttttttttgctttccatttgcttggtagatcttcctctgtccctttattttgagcctatgtgcatctttgcatgtgagataggtctcctgaatatagcacaccgatgggtcttgactctttatccaatttgccagtctgtgttttttaattggggcatttagcccattttcatttaaggctaatagtgttatgtttgaatttgatcctgtcattatgatgttagctggttattttgcccgttaactgatgcagtttcttcatagcatcgatggtctttaccatttggtatgtttttgcagtggctggtaccggttgttcctttccatgtttagtgcttccttcaggagctcttgtaaggcaggcctggtggcgacaaaatctgtcagcatttgcttgtctataaactattttatttcttcttcacttacaaagcttagtttggctggatatgagattctgggttgaaaattattttctttaagaatgttgaatattggcccccattcttttaaggctcgtagggtttctgctgagacatccgctgatagttggataggcttccctttgtgggtaacctgacctttctctctggctgcccttaacatttttttccttcgtttcaaccttggtgaatctgacgattatgtgtcttggggttgcacttttcaaggagtatttttgtggtgttctctgtatttcctgaatttgaatgttggcctgtcttgctagtttagggaagtcctcgtggacaatatcctgaagagtgttttctaacttgattccattctccccgtcactttcaggtacaccaatcaaacgtagatttggtgttttcacatagtcccatatttcttggaggctttgtttgtttcttttcacttttttctctaatcttgtcttctttttttcattaatctgatcttcaatcactgatatagtttctttccacttgatcgaatcagctattgaagcttgtgcatgcgtcacgaagttcttgtgccgtggttttcagctccatcatgtcatttaaggtcttctctacactgtttattctagttagccattcatctaatcttttttcaaggtttttaccttcctcgagatgggttagaacatcttagcttggagaagtttgttattactgaccttctgaaacctacttctgttaactcatcaaactcattctctgtccagttttgttcccttgctggcaaggagctgtgatcctttggaggagaagaggcagtctgttttttggaattttcagcttttctgctctggtttctcccatctttgtggttttatctaccttttgtctttgatggggttttggtgtggatgtcctttttgttgatgttgatgctattcctttctgtttgtgtgttttccttccaacagtcagacccctcagctgcaggtgtgttggagtttgctggaggtccactccagaccctgttttcttgagtatcaccagcagaggctgcagaaccacaaatattgctgcctgatccttcctctggaagcttcgtcccaggtggggcacccaccacctgtttgaggtgtttgtcggccgctactgggaggtctttcccagtcaggctacatgggtgtcagggacccacttgaggaggcagtctgtccagtgtcgaagctcgaatgccatgttcagagcaccactgctctcttcagagctgtcagacagggacgtttaagtctgcagaagctgctgcgttttgttctactatgccctgcccccagaggtggaatctatagaggcagtagcccttactgagctgcggtgggctcctccagtttgtgcttccagttctctttgtttacactgtgagctactcaagcctcagcaatggcagacattcctcccctcatcaggctgcagtgtcgcaggtcaatctcagactgctgcgctagcagtgagcaaggttctgtgagcgtgggacctgccaagccatgcacaggagggtatctcctggtctgctggttgttaagactgtgggaaaagtgcagtatttggtcaggagtgtactgtttctccaggtacagtctgtcacggcttcccttggctaggaaagggaaatcccccaagtccttgcgcttccgggtgaggcgatgccccgccctccgtgggctgcactcactgtccagccagtcccagtgagatgaaccaggtatctcagttggaaatgcagaaatcacctgtcttctgcatctatctcgctggagctgcacaccagagctgttcctattcagccatcttggacaagatttttttttacttaaaatttttttaaattaaaaacttaagacatatctaaaaaaatgttaagaatttttaaatgatgggtgaaaaataacatcttgttttaatttgcatttcttggttcttggtttttagttgtttttgtttttgcttttttgagaccgggtctcactctgttgcccaggctggagtgcagtggtgcaaccacggcacactgcagcctcaacctcctgggctcaggtgattctcccacctcagcctcccaggtagctggaactacaggcacctgccaccacacccagctatttttttgtgtgtgaattttttgtagagacagggttttgccatgttggcaagtcttttctccaactcctgggcttaagcgatcctcctgcctcagcttcccaaagtgctaggattacaggtgtgacccaccatgcccggccaatttacatttctttaattatcagtgaatctgaactttttttgatctacatttatttattcatgtgctttgtctatttttctgttaggtttctaaaatatttttcttagtgatttttgagagctcattatgaattaaagcccttttaatatgaagtgaacagttttttccaggttcttttgttttgtcagttttaagcttgttatactactggatatagattactttttataacttttaattacatgagtagtgtatgaatatacttttgtagaatttcaaacattacaaaagtatatagagtaaaagattagttttatttttaactcattacccaagttaatcactgttaatagtttagggtttctttttaaatctatttttgtacatcaacatctttttttaaaaagttttattttagatttgggggtacaggtgaaggtttgttacataagtaaacgtgtcacagggatttgttgtacataactatttcatcacccaggtattaagcctagtacccaatagttaccttttctgctcttcttcctactcccaccctccccggtcaagtataccccagtgtctgttgtttccttctttgtgttcattagttcttaccatttagcccccacttataagtgagaacatgcggtatttgggacgttcctgctgaagacatgcgctcgttcttttttatggctacgtagtattccacggtgtatatgtaccacattttctttatccagtctgtcattgatgggcatttaggttgattccttgtctttgctattgtgagcagtgctgcagtgaacattcatgtgcatatatctttatggcagaatgatttatatttctctgggtatatacccagtaatgggattgctgggttgaatggtagttctgcttttaggtctttgaggaatcgccatactgcttcccacaatggtggaactaaattacactcccacgaacagcatataagtgttcccttttctctacaacctcaccagcatctattattttttgactttttaataatagccattctgactggtgtgaaatggtatctcactgccgttttgatttgcatttctctaatgatcagtgatactgagcttttcttctgtatgttttttggccacatatatgtcttcttttgaaaagtgtctgttcacgtgctttgcccactttttaatggagttgtttttctcttgtaaatttttttaagttcctgtaaatgctaaatattaggcctttgtcagatgcatagtttgcaaaaatgttctcccattctgtaagttgtctgtttactctgttgatagcttcttttgctgtgcagaagctcttcaatttacttcaatcgtacttgtcaatttttgcttgtgttgcgattgtttttgatgtctttgtcatgaaatctttgtctgttattatgtccagagtgatattgcctaggttgtcttccagggtttttatagttttgggttttacatgcaaatctttaatccatcttgagttgatttttgtgtatggtgtaaggaagggatccagtttcaatcttctgcatatggctagccagttatcccagcaccatttatttaatagggaatctttttcccattgcttgtttttgtcagttctgtggaagatcagatggtcatagatgtgcagccttatttctaggctctctattctgttccattggtgtatatgcctgtttttgtaccagtaccatgctgttttggttagcgtagccttgtagtagagtttgaagtcaggtaatgtgatgcctccagctttgttctttttgcgtaagattttcttgactattcaggctctttttggctccatatgaattttaaaatagttttttctagttctgtgaagaatgtcgttggtagtttgataggaatagcattgaatctgtaaatagctttgggcagtatagccattttaatgatattgattcttccatccatgagcatgggatgtttttccatttgtttgtgtcttctctgatttctttgagctgtgttttataattctcattgcagagatgtttcacctccctggttagctgtattcctaggtattttattctttttgtagtaattttgactgggattgcctctctgatttgactctcagtttggctgttgttggtgtataggaatgctagtgatttttgtatattgattttgtatcctgcaactttggtgaagttgtttatcatctggagcagcttttaggccaagactgtggggttttctaaatatagaatcatgttgtctgtggacagagatagtttgacttcctctcttcctatttggatgccctctgtttctttctcttatctgattgctttgcctaggaccatcaacatacttttatgtgtaattatacatgtagtttggtgttttctcttttcttaaaaatgatattatgctgtacatatttttctgcaactttttccacttacactcttagattgtagttgtgtttagatttattctcatactttctaatgatgacttaagtatataccataccttatttaactattctcctatcagaggtcatttatatgttcagacgttttatattaataggtagttggatgtattgatcttttccctaatggctatgactttggtgtctttcttactaaaactttaggtcttctgtatgctgaaattgtatgaagatttcaaccatgtgttctgactttggtctttgcacttaaatcattagtaaatctgaaatttattctggtgtatataatgagatatatggttccacctcgccccaccccagcaaccaccatccaatagctaaatagcaccattttttgaataagttgtcttctccccaactgatttgaaatgtcaatttgtatcatacattgcattcataggtgttccatcctcttttctcctttgaactttgtccattcttctattcttgtagcaaaagcaagtctttttttttttttttttttactgtagtactatatgttttaataactgccgggaacacttccttttcagaaatttctaaggaactctatgttattttttccaaataaactttttatcttatcattttgaccattttaagtttacaattcagtggcattcagtacactgacattgttatgtaaccatcagtaccatccatctctagaatattataatcatcccacactgaatctctactcattaaacagtaactctccattcctccctatccccatcacctgatgataaccactatctactttttgtctcatgaatttgcctattctaggtaaatttatataattataataagtggagtccacttatatggcatcccactatttgtccttttgtgtgtggcttattttacttagcataatgtttttaaggttcatctagatctatcttgtgacatgaatcagaacttcattcctttttatggctgaataatagttcgttatatgtatatactatatttcatttattcattcatctgttgctagacacttgggttggtttgtttttaccttttggctattttgagtaatgctgttataaacataggtgtacacatatctgtttgagttcccgtattcagttcttttaggtatatacctgggagtagaattgctagatcataagggaattctatttttaatattttgaggaactggcatactgtattccacagtggctgcaccattttacattcccaccagcagtgggaacctttaacaaaggttccaatttttccacatctccaccaacacttattaaattgtttttttagtaatagccaagtgtcttagtctgttttgtatgtgataacagaataccacagactgagtaacttataatgaacagaaatttatttcttagagttctggaggctgagaagtctaatatcaaggcatgggcatctgtgagggccctcttgctttgtcataatatgatggaaggcatcacatggtggaaaggaaaagagacggtgagagagagagtaagagggacaaaaccatgccctaaataacaaacacacccctgcaataacgacattagtccattcatgaggacagagccataatgacccaaacacctcttaaaggcgccaccccaataacattacattgacaattaaatttcatcatgagttttgaaggggacattcaaaccatagaccgtcctaatagatatgaagtagatatgcatactagatatgcatttccctaaaaattagaaatgtgttgagaatcttttcatgtgcttattggtcatttgtatatcttctttagagaaacatctttttaagtcttttgcccattttcaagttgggttgacatttgttactgagttttaagagttatttatatgttctggatattacttccttatcaaatatatgatttacaaatatttcctctcattctgtgggttgccttttcactctgttgatagtgtcatttgatgcacaaaatttgcttttaattgatgaaatataatttttttcttgtcttgcctgggcttttagagtcacatccaataaatcatagccagatcaaatgtcaagaagcatttcctctgttttcttctgagagttttatagttttacctcttatgtttaggtctctgatctattttgagtttgtgtttgtatatgataagggtccagcttcactttttttgcatgtggatatccagttttaccagcaccatttgtagaagagactccctttccccatttgactgttccttgtcacgcttgttgaaaaccgtttgaccatatatgcaggggtttatttccgaggtctctgttctattccattggtctgtatgtctgcctttttgtcattaccattgttttgattattatagttttggaatcagaaagtgtgagccttctcaactttgctctttgtttctaggattgttttggctatttgtggtcccttgagatttcatatgtattttggaatggatttttctatttcagaaaaaaaaaaccaaaaaataccatcatcaggattttcataggggttgcactaaatctgaagattgctttgtatagtattgacagtttaaaaatactaaatttttccaatccataaacacaagtgtctttccatttattttatatctttaattttttttagcagttttgtagttttcagtgtacaagtctttcacctccttagtttattcctaagtattttattctttttgatgctattacaaatgatattgttttcttaatttccttttcagattattcattgttagtgtatagaaatacaactgagttttgtatgttgattttgtaacctgccacttaactgaattcatttattagttctaagagatttttgcatgtgtgtgtatatgtgggatccttagggttttctaaataaaagatcatgtcatctgcaaacagagcgaattttatttcttcctttctaatttgaatttctttttcttacctaattgctctgattagaactttcagtcctatgtcagatagaagtggcaaacatggacaccctgtcttgttcctgatcttagggaaaaagccttcattcatttaacattgagtatgatgttagctgtgggtttttaatatatggcctttattatgttgaggaagtttccttccatttcaggtcaactctaaagcatttatttttattaatccctcttttttttttttttttttttttttttgagacagagtctcgctgtgttgccagactggagtgcagtggctgtgtctcggctcactgcaacctccgcctcccgggttcaagcgattctcctgcctcagcctcccaagtagctgggattacaggcacgcactaccacacccagctaatttttgttttttttttttttagtagagacggggtgtcaccatgttggccaggatggtctcgaactcctgacctcgtgatccgcctgcctcggcctcccaaagtgctgggattacaggcgtgagccactgtgcccggctaatccctctatcttttaattttaattagaatcacattggatttatagactaattttgagaaaatagtacagataaatttgcatgttgaaccacagaatgttgtcacagaaaatgtgagtggggaggaagaagaaagattatgacattaaatgtaagtttataaatttttatgatactactttgagaaacattaatatagtttataaggaaaattatattttaagggattttctacaaaggtgaaaaaaaatcaccctatgagtttaaaggattttaagctttatatttaattctttccttcttttattaatttaatctatatttcttcttttttcctag

SEQ ID NO: 139 - DNA, 2026 bp, Homo sapiens; identical to SEQ ID NO: 71
  source 1..2026: mol_type = genomic DNA

SEQ ID NO: 140 - DNA, 1095 bp, Homo sapiens; identical to SEQ ID NO: 72
  source 1..1095: mol_type = genomic DNA

SEQ ID NO: 141 - DNA, 4227 bp, Homo sapiens; identical to SEQ ID NO: 75
  source 1..4227: mol_type = genomic DNA

SEQ ID NO: 142 - DNA, 2973 bp, Homo sapiens
  source 1..2973: mol_type = genomic DNA
gtaagtgaaaggagcttctctttcattcttgactaccagtgggagctacaagaattgcttcttgttggtttcgatccttggctgttggctgtgagctatttcccatctgtgacttgtcattttctgttcacatatgatgtatatgttgcttgaaaagattactacctgccttcctttgccaaatgtcttaccttgtgactcttgtggatacttctgaagctcagggcaattgggaattaaaaaaaaaaaatatgtagccacttcctgtctttcttgatcacttcctgtctaactgaagctggatttcataaagcttttggtcaataaactactaccttgtgtccattttcagtgtttctctatcatttcttcttggtgaaataattttttgttcatgtttctaccaaacgatctaacttcctatgtcacctttttttaacctacaggccacttattatctgtcccttcctgccttctccagctgtggcatccatcttggtaactgtgtcaggttggactgcaaaggatttattatttctgttctggctctagtttttcatgctatcttgtgacaatttcctttgacaataagccacttcctgtatgtctcaggtcatttaaatcataaagtttccattgtgggcctcgatatttctcatggctacttcctgtgtgtcctagccttgatgtttgtgttttctggaagaattacccttcactgtcatgattccctttgcaggagtcacattctacctgttttgtgcctttcttttctctctgggtcacggtagccatgttgttgttgaaggttcacttcctggatcctctttccttcactgcttcctgtctgttcagccacttcctgtttgtccagtttgttttctagccatgttggccatgtttaattttcttcggccctggcatcattcttgcttccaagtgtttgtcattttgttctgtgtcccttagttgttctcatatcttccagtattccctgtcagtgggactgcttcctgtctactccgctccgtcttctgcctgccttgcagttctggctgcctcctctaccctgctgccgcatcccatacctcccctctcttgcctcccttgagcttctactgcctttcctttatgctgctctctgggtatttggggttgatatgggatttcagagaattttgaaacggatcattgctgtttggtcagaatgaaggtggagaggggcattctgaagatctttgttggggggagttggggtggtggtgaatgtctcccattctccatgttcttattttgtttctggccctagagttgggaacaggtatctgagtggaggtgtgcaagggagggaactggtgggcttggaatgtacttgagggccagaggaagggcaatgcattcagtggggactgctctccaattttttttttttttgaggcagggtctcactctgtcacccaggttggagtgcagtggcaggatcttggcttactgcaacctctgcctcctgggttcaagcgatcctcctgcctcagcctcccgagtagctggggttacaggcatgtgccactgcgcccggctattttttgtatttttagtagagacggggtttcacatgttggccaggctggtctcaaactactgacctcaaataagctgcctgtttcggccccacaaagtgctgggattacaggcgtgcgccaccgtgcctggcctccaaatttacttagagtatggatgcttaacctttggggcatatttaaacttgtgaaccctttgaaatcctaaataaaattctgtgcataatagcatatactttttcatttctggagaaagactcacagctttcatcagattcttttttttctttgagatggagttttgctcttgttgcctaggctggagtacgatggcataatcttggttcacttcaacctccacctcctgggttcaagctattctcctgcttcagcctcccaagtagctgggattacaggcatgtgccaccacacccagctaattttgtatttttattagagacggggttgcaccatgttggtcaggctggtctcaaactcctgacctcaggtgatctgcctgcctccgcctcccaaagtgctgggattatgggcgtaagccacctcgcccggcctagcttttatcaggttctcatgtgggtccatgccctcctcttaccccaaataaaaatctacccacaatcttagagagattcttttatgatgtattggggtaaatgtgtggaaggtttcttaaggttctagggagggagtttgggagatgggatagggtcctctagaagagggtttgggaaggtgggtggtttaaaatccctgaaaggggccaggtgtggtggctcacgcctgtaattccagcactttaggaggccaaggcaggcggatcacctgaggtcaggactttgagaccagcctggccaacacggtgaaaccccatctctaataaaaatacaaaaattagccgggcatggtggtgcacatctgtaatcccagtgtaatcccagctacttgggaggctgaggcaggagaatcacttgaacctggaaggcagaggttgtagtgagccgagatcgcgccactatacttcagcctgggtgacagagcaagacttcgtctcaaaaaaaaagaaaaacaaacaaacaaacaaaaacactggaagtttctggggaccttcctgaaagaggctctcagggagatggagaggttgtgtttgctgaggtggggctgggaactgggggggcagggaaccctgaggtctccttggcaggcttgaaaggtttgtgaagagggagttttaggggagggctgtggggctttcgggtagggctgaagtggtctcgagaggatctaagaatcaaggttggagttgagatggagaaaggcctagtgtcctggctgctcacgggccccactgggggctacatgtgtgtctccttca

SEQ ID NO: 143 - DNA, 2357 bp, Homo sapiens; identical to SEQ ID NO: 77
  source 1..2357: mol_type = genomic DNA

SEQ ID NO: 144 - DNA, 2854 bp, Homo sapiens
  source 1..2854: mol_type = genomic DNA
gtgagtatcctcagtgtgattgcctgcttttatttagtaatttctactcaatgtttgttctatggatgtaaaccgtctgaatgcttaatatgtcaaaaagccaaatcattccagaaagctaagggtatgtctgccatttcatgactcatttttattattgaacaccaaccctctcaattttccctgaaatgcatccacaaaatcaccaaatgggaagttgcacaaggaaaggccccagattcttgctcgcttactcactaggtttgaatagcaaaagacatatgcccaaagtttcagggtccctataactagaagagttaggacagactacttcacaagtacagattaataacacccccagccctccacagatgtccacgtcttaatctctggaatctgtgaatatgttatgtcacatggcaagatggcaaggggtaattaaagctacggatagaattatggttcctaatcagctgacattgagatagaggagttgacctgagcttgactatctggatgggcccaatataatgacaagcatccttggaagtgaaggagagaagcaggagagcagtcggagaaggagctttgactacaaaaacagaggccagcgggatgcagcaagagagacgcaactggccactgctggctctgaaggttgagggggaccaggagccaaggaatgtgggcagcctctagaatctggagaaggcaaggaatcagattctccccggggacctccagaaggaatacagctctgccaacaccttggttcttggcagtcagacccatttcagacttctgacctccagaaccataagataatatatatgcattgttttaagcctctgagtgtgtggtaacgtgtgacagcagcaataggaaaacaggaaaccaatatgagattgttcaacgagactcaaaatgacattgggagttaacacagggaaatgttaaacagtgaaaaaatacaaaaagttctgaggataatgaacaagaaattacggggagtgaaagaagtgaaggtggtgggaaggaatatggtccagtcttaactgatttggggtggacgtggaagaaatggaaaggaatcttaattgtggatttttttttaaagaaaaaaaaaaaaggaatgatcttactttttaatatctacagtggcagaaagaacaagtccagtgcagtataaagggactatgaaggagcttcggacctgacccgagctggccccctcggggccattctgtctgcactctttggagcatattgtccaacttttctaagtctgtttgctcttctataaaaggtttaagaaacatgctgtgcctacaatccttgatgagattatatagagaaaagcgacaattgctataaaatgcaacatatcctatttaaaaatgtccagtgataataactcatttaacaagcaagagttgtaaatacacattcaacctgatttaaagcagttgattcccggtgtttaacacctcctttatatttttctctttatttatttggttactacaatgaaaagccaacctggcttgtgttggaattatcatgaaaacagctgaggagagaggaaatttagtgtgggagccattaagtatgggctggacccagttactcgtctcccagatccacagccctgtaaacatctgtagtgtctgtcggcatctcagcaaaagaggaagaagtagagggtggagaacaaaggctcacttaggacatgaggttttagagaggagaaggctctacagagaacaaaagaacaaggatggcagataaatcacagcccagaactgagccccagttctcctaccatcctttggaatggtgtgacccgaagttctaaccacagctgttttaagcgttaaataagatgatggatccagaagctgtttgacaaatataaggtctagaaaatatatgcagatgtttaatgggtgttttgttttgttgttttgagacagaacctcactctgttacccaggctggagcgcagtggcacgatctcggctcactgcaatctctgccttccgggttcaagtgattctcttatctcagcctccggagtagctggggttacaggcatgcaccaccatgcccagctaatttttgtattttagtagagatggggtttcgtcatgctggccaggctggtcttaaactcctgacttcaggtgatccgcccacctcggcctcctaaagttctgggattacaagcctgagccaccgcacttggccttttagtggtcttttaaaattgcatatgtcctctgttaaaatttgtttgtaataatgaagttaccccagttggatttctgcctcacttataaggccctggactacataacttttccctaaatattccatattatttccttttttctccaaaccatcctcccagtccagttaggtttccttccaccttccctccttctagttgcttccactaaatggcattatgggatacactggtctcagcaatgtgcatgtctgaacaaagctgcctccttccttctctcctgcagttttcattctgagaatcatcttctttcactcatctgtccctccaggtctcactttcagagggtcctcacggtccccagcacaatgaggaccacacaaggggttcaacacacacttcttggctgattaaaaagaggaaaggcaatgatggcagccagagagaggaaagcatggatcttgtcactgatgacaagtcggctagtaggagcagcctcatagaaataaaaagtagctttctggaattaattcctttactctttttctttttgtttcacatgaaaagaaactgtttaaattaatctgcgtttttgtttttctgtag

SEQ ID NO: 145 - DNA, 9749 bp, Homo sapiens
  source 1..9749: mol_type = genomic DNA
gtatgagccgcatgctgattgttcattattttcatgatatattgctgaaatgaaattctagatcttttattttgtagctttttatatggagcctaaactactgaggagaaagcatgtctttccctttgcaatttgtttctaccttgatccaaagtacatcaatcatgggctaactggatccacacatcccttctattattttattttattttattttatttttgagatggagtcttgctctgttgcccaggctggagtgcagtggcaccatcttggctcactgcaagctccgcctcccaggttcacgccattctcctgcctcagcctcccgagtagctgggactacaggcgcccaccaccacgctcagctaattttttgtatttttagtggagatggggtttcaccgagttagccaggatggtctccatctcctgacctcgtgatccgcctgcctcagcctcccaaagtgctgggattacaggcatgagccactgcacctggcccatcctttctatttttatgtggaactcctacttaaatctttcattcttggccagcttttggatgtagagttttcaaacctcttagcacaacatggtagatgctccatgaacagtcattaatagctgcctacttgattttgagttaaaaacaattgaattggggcttggtggagcggaaacagagcctgcaagaaggaagtaggagctgttagaggagggatggggaaaaatagggtcttgctgtacgttttggcagttactacatggttaatcactggagcattgttcagtaactgccggggtggcaggatccttattcaagtatttaagcgaaaccattcttttaaaaagtgttctccatttaaaaagtgttctccagccaggcgcagtggctcacgcctgtaatcccagcactgtgggaggccgaggtgggtggatcacctgaggtcaggagtttgagaccaacctggccaacatggtgagaccttgtctcttactaaaagtacaaaaattagcagggcttggtggcgggcacctgtaatcccagccacctgggaggctgagacaggagaatcgcttgaacggtggaggcagaggttgcagtgagctgcactccagtctgggcaacaagagcgaaactccatctcaaaaaaaaaaaaaaaagaaaaaagtgttctccgaatggtttgttttctttccacatatccccactgcattgggtaatttacaaagatattagggagcccagggctgggcatctagaagtcactgttctctttagatccattgatagtagctatgagtctagaaaactcatgggcaaattctttgaaaaggaggaaccaggatgttctctctcctttcaccccccctcactgccccactatgatttggactttttttggttcagggacacaggaattggaagcagaactgaattttgtaccacttgtttttcttgtggttccccaaaaccaagaagttaagtgcccaagagatgttcctctcaacaggagtcagactcgttcttaggtggtgaccaaaacagccctggagccttcctcaaattaatttgggttttcgttgtgtgtgtttattgcattgcatctgtgtttgtgcaccaggttaattgggtgttggttgtagcaactttttttaacggcccgtgagaactgggaattgggccagtctttatttaactcatctttcttgatactccttgcatgcataaagttctgtcagtcggtattactagtcatcaacctcattttaaaaccaagctgccttgtgtatatatttgcaatatccagagctgggtccctccaacttaaaaaaataacttccaacttgaagacgtgacctataactgggttctgcaaattcaattcagtaagtacttccagactccctctactctttgtaaagtatgctactaggtggtatgggtgagtaagatgagtaagatgtgttttccccctccagggtctcataatcccatgaaagaaatagccagcagaatataaataacttaaagtaatggtagattattacacaattcatgttaaaaaggagttgcaagttgggtgttgtggctcacgcctgtaatcccagcactctgggaggccaaggtgggcagatcacctgaggtcaggagtttgagactagcctggccaacatggtaaaaccccgtctctacttaaaatacaaaattagctgagcgtggtggcagatgcctgtaatcccagctacttaggaggctgaggcaggagaatcgcttgaacccaggaggcagaggttgcagtgagctgagatcgcaccactgcactctagcctgggcaacaagagtgaaactccgtctaaaacaaaacgaaacaaaacaaagagttgcaagtcaagggtattgggagaatgggatggtgagaggttaattccagtgtggagaactacaggactgctaggaccccagtaagagctggtatttgactagagccttaacgaaaggttgggctttgaggagccagaattgttcaacagggagatggcgggagcacagactgggctggttggcctaataaccaggcatctaggagttagcaacatccttgctactgtaactgtggtcctggtccaggaactagcagcaactttggtcccgccccagacctacagaatcagaatctgcattttaacaaggtccccaaaatagttgcatacatattcaaatttgagacgccctgttatatgaatgcactccttaaagattcagctaagagtagaacgtttcttagcaaggcagtcctagctgcaggttaaaatcacctggaggatcttgaaagaatattggtacctcggcctaatctcagaccaatagaatgtggaaggtggcagagcctgaatgttaacatttttcaatgccccccaggtgactgtagcaggcagccaaggttgaaatgcactgctccacctcaacatcaaaattgaggccagagggatggttggggtcacccactgtggtggctttaaaaaaataaccaaagaaagtaactaggaagagaaaaatatgtgaatgggtcaattctttacacttgaacatgatagttatctttgacatgaacaagaacaagattctctctccatagactatgagcttctgaaagatggtctagtgcttatgtggcccaggtgtgcttgcctgtaatctctaattcccctgacttagggtttcatgggctcatctgctgcacgtggccacaggagggccttccctgggttcctgtgccctctctttattggagccactgaccctgcctgctggaagtggggacactccaaggccacctctctaacacctacatgattatgatgttttttaaaaagtgccccgtcgttctggtgaagcatcgccttctcttcctatgttctcaccatgtggcccagcttccctggggctcctttttgtcctgtgcacccactcccaagcccttgctttcttctggggcccctcttctctgataggagcctctgggttcctgttacaaaggacctctcttctccgccatgtattcctcggccttgtctatgcctgctgggcacactggctgtattgctcatcccgtccagttactaaagagtgacaggtatattctaagggcctaatgccaaaccctggctgacctgggccatctgtaggccatgttgctcattctctagcatttcctgaaggtattttttcagcagggtgtgaggggccatatacaccactccagcctgggcaagaagagcgaaactccatctaaaacaaaacaaaacaaaacaaaagagttgcaagtcaagggtactgggagaggttaattccagtgtggagaactgcaggacagctaggaccccagcaagaggtggtatttgagcagagccttaaggaaaggttgggcttatataccaccaccacatataccaccctcaagattgggtgctgaaaagaaatggctgccactagaaagaacaatgttcacttaaaatgatgttgttggtatcttcctgttttcccttcagaatcttctcttttctgctcctctacctcctcctcccctccagcctcaagtagacaaaaaagataactactgagtactgggcttaattcctgggtgatgaaataatcatcagtacaacaaacctccatgacatgagtttacctatgtaacaaacttcacacgtacccctgaacctaaaataaaaggtaaaaaaaaaattaaaaaatcttttctttcattgctaagctgattttgtaaccatgtgctacagctgagacttacctaaaaatgaacaaacttctggctctttcctgcccaatatgggtggatgacagccacacgaagtgggtcgattagtccaccacaggaggcctaatgctcttctacacacagatctctttgatctacaacttttccttccagggcggccctcaaaggctgaagcttcctacagtgaactcaaaagtgttttccattttgttttgaactgttcctgcctaatggatgtacccacaccctgttagggttgtgtttctcttcaaggcaacacttgccctctcaggaggtcatccatctaacactggagggtttgttttgatgtttagttttattccttaaaactaattccaagtagggaacaagtccgtaaggtggaaagctctgaacatagagctcaggttaataagaagagccttccttcctgtttctcaggaaatgtcttccgcctgacaatttctctttgcctcaccctaaagggagtaaagcccacgtgataacgtctggtgtgaggactctttttcccagatctatagtgatctcaccatgagtctatacatcaggaggaatccctgctgctgcctgttcagtggaagggagaaactcctaacccataagcactaaggcagccctttctagaatatattgcatgttggaatcatcttgttgggtgagacagagaaaggaatgctctgagctcactgttggggccccatgttccttccaagataactgatactctcttggaaggtggtggagttccagattccaccaggagtgccaccccggggagaggtttctgcccagtcaccaggaagggcagggctcctctcacccagatggggaggcggggatgtttcctttctcacctactgaatggtaaccacatacagcatgcagtccaggacactctgaaataattcgtttctaatcctgggagcacaaaagcataacaggagcatatcggacactgggatgtctgcactgagtgtagctcaaccagcacagggcatggaggggagagactggctggtcgtagggatgtaagaagaaggggacactctcaggcaggcaatatgaggacgtgactttacaatcagtggggcgtgtggaaccgagggcaggcaagtgagacatctacctcattacctgaacacttcaatcccctgcttcagctttggagccagatgatctttgctgcgaccactcaaccctgttgctgcagcatagctgtagataacacgtaaatgaatgcctgtgttccactgtaactggggttactaaaatgggcagtaaatggcccacaggctgtaatttgccaaccactgttatagagaccgtaagaagcttgagggcaggatattgtcttattcagtgtgatatccatacacaggcctgggtcatggagggtgtttggtaaacatttggtgaatgaacacgtgactcctggatgtagcctactgtgtggagcggtttctcaacctcagtgctgctgacatttggggcccgatcgttctttatcctggagggctgtttggtggattctaggatgttaagcagcatctcttgcccctatcctgctagatgccagtaatgacctcttcctccatgtgaggacccaaaatgcctccagacattgccaagtgtctgctggggtgaggggtggggtggggcggtgcagaaccacctaatgttgaagaccatttatgtagggaaggatgtggtaggagatgggagatgtacctttagcctatgggggaggcatttggtgaaggggaagaaaaaaactttattacaaaagaaaaaaaaaggtaacttaaaactaaacacacttttaaaagacacaattgcctgtatatttttccagttttatttctgcacgatcatcctaggcatacttgttggcaaactgttcttaacataaccttacttctatgtcattgcgtattttcctacaatattatctgtagtagctgaggaatattgccttatctgattgtgccataatttatttaaccactaccttcaccaattattgattggtttgctgccagctgctctgctagaaagaagttaatccaacaaggccctgctttttggagccacaggctagcagaaaatgaagacattgagcaagtcagtttggacatgttgagtgttaataaggggtaatgtgggaatttctaacaggggagctgaacctgggggtagggagggggcgtcacaaggaacatttaaggctttggttctcgagcttcatgaaccatcagaatccctgaggagcttgttaaaacacagctcgctgaggtcccccccagacctgatttgttaggtaaggagagggctctgagagtctttatttctaacatattcccaggtgctgccgctgctgctgctggtccagtaactactctgatttaaggagtttccactttctcactacgataagcaactggtaatgatatcttacttatacgcatccctgattatcatgaagaaatagtgtaatggataagaacagaggttctggaaataagggctgggtgtggtggctcacacctgtaatcccagcactatgggaggctgaggtaggcagataacctgaggtcagcagtttgagaccagcctggccaacatggtgaaaccctgtctctactaaaaatacaaaaaaattagctgggcttggtggcgtgcacctgtagtcccagctactcaggaggctgaggcaggagaatcacttgaacctgagaggcggaggttgcagtgagctgaggtcatgccattgcactccagcatggccaacagagaaagactccatctcagaaaaaaaaaaaaaaaaaaaaaagccaggcatggtggcccgtgcctgtagtcccagctactcgggaggcagtacctttagcccttgcaggaggcaggagaatctcttgaactgggaggtggaggctgcagtgagccgagattgtgccactccactccagccagggtgatacagcgagactccatctggaaaaacaaacaaaacacaaaagaaataaaagagcagagattctggaagtagatgacatatgttcataactctggctctaccacataagccatgactcagtttcctgatctgtaagaagggctgattgtgaggattatgtggattcactaacataaaaagcacttagaacacagcctgacacagaataaacagtacttgtgtttgctattattgttgtttctttaaactaaattccctgagtagaatttctggttttaagaataggcagaaatataggattttcaaaatatgccgccaaggtcatcaccggaaagagttttaaagttaaatcatctagagcactggttctcaacgtgtggttcctgggactggcagcatcagcatcacctggggacttctagaaatgcagattctcatgccccaccccgccctaccaaggcagatgctgatttctaccaaagtgtgagccagtgttccagaatgtcattggggttctgttctcaggagcagtaggaccgtgtcattgcactgtttagccctgtgtttcctattgatgttgctcaggtgggttggaggaggaagattgagtccagggttgctctaggcaagttagctactctactacttgtggacgcacagtcggggcctcacctggggccgcagaggggcagggaggggcctgcgtgggaaatcttcgattcttgctagcttgcaacatcaagtcaaacctccttaaacctccatgcatccttttcatgacagggttgctgctttaagggtagagggtttcggtcagcgtctgtgttaacacactcatttaatggttatcaggcaaggctggtccctcagtagggtgggggagggaggctccatgaattcctgggttgactggcatcctcagctttatcatcatcccccagtcactggagggtgaaggcaagaagcaacagtgaaagccacttaagcaagcccctttgatttaatgtttgattttaggctacgtgttggtctgctcgggccgccacaacaaagtatcactgacacagtggcttaaacaacagacaatttttcacagttcgggatgcagaagtccaagatcaaggagccacaacagggctggtttctcccaaggcctccctccgtggcttgcggatgccaccatcttcctgtgtcctcacgtggcctctcctctgtgccattccagggacatgcatccctggggtccgtttctgtgtccaaattttctccttgcataaggaggccagtcagcctggattagggcccagcctaagaggctcattttaacagaatcacctccttaaaggtcttatctccaaatacagtcacattctgagatacggggactaggacttcaacatatgaaatttgggggtacacaaatcagcccataccaggctactctgtggcagagagagagagacagagagagaaagagagaaagagaatagaaaacaagtagagactggaaacctggagaaggctagtaattcaggaaattaggtataatagcaataaactccctcaaagacaatgattgtgtctgctcccctgaccgaagggagatggtggctaattatttgaggccttgacaaaaaagtaactgcatacttaaagaaccccttaaggattaacgcaattgctgccaagtcccccaggttatatccagagctctgcagcttgtcaggcgcagggtctggtggttgatggcctctgcacttggctcccttgggcctaagtttcctctccacatgtgactgctctgtgacttttatgagccccagtctcttcactggtataactggcatgtatgagtacctagtcatatggctgctgagaagactgaattggacaatccacgtaaagggattagcatggtacctagcacattgtaaacactcagtaaaaagctattttaaaaaattgctgcacctatcatgctccagatttaacgtgaccccaaatgaaaccgattaagtttcattcatttctccatctaggctttgaaacaatcattattaaggaaaatatttattataaatgccatacatgttcagtagtttttttttttttttttgaagtcaaatatatgaagactatgaagaaaatgtgaaaacctgtctctcaacacctccctggtctggcttcaaatcctggcctagccctttatgggatcactgactttaattaagcaaattatttgacctctcggggccccagttacgccaactgcaagtggagatagtaaaatcccaacttcatgtcattgcaaagactaaatgagctgatgcattcagtcaaagtgggaaggaagcctggggctggcacacggctggcatacggtataagcacggtaaatgctagcaggtgtcatggttgctttcaccaccagcatcataaacttttgtgca

SEQ ID NO: 146 - DNA, 8775 bp, Homo sapiens
  source 1..8775: mol_type = genomic DNA
gtacctatatacatactgaattcaaaatgttttcaacaactcaaatatcaaaaatggaaacaggacttgaatatgatattgcactaggtaggtcattgataccaaagaatttagaaagtacttcaggagttggaaacttcttttttttttattggattattattgtcatttccaatgttttggggtgatgactctataagttagtacagtcacagtcactactttttcaaagcattcctataatttcctgtatttatgctatgaaactttgagaagtagtatgcttttttcttgtggaacccaagaatttgctgcctgcttgtacctccaagtcttccagcttcccttaaatgcacagagtcactttaatgtcctctagagactttcactttacctccccagccaccaacccccttgatttctgacttccactgaattctctacttcatttggcctctttgactgctccttcttttggtcctcattcccttgggcttattaaatacctaacctttcattctacctattcaaagcaggcttactgcaagctgttgtgcagtacacattgctaaagatttggggtgaaaagggaaattataccattatcaaaagtggtatgtatcaatattagaaatcactgaactgaaaagtaactagtacaccagggacctgaaaactaccacctgtgagccaaatccagctggccacttgtttttgtgaataaagttttactggggcacagccacacccaatcgtttgtctactgtctctggctcccttttatactacaacagcagagctgagtagttgcaacagagaccccaaaagccaaaagtatttactatctggccctttagtggaagactttgctaacccctgaactatatcatactatgagaaatttctcactggctagttccccttttaacctgggctttccatcctcttcccaggcctctctctctcattggatactcctctcttttgttcaaatctttactgcattctcagggtatgcagtaaatacaggcattcagactctcgggcttcttgcaaattcaaaactccatttttctttaaaattcagagcaatttatttggctctggcttactttggctatgcccaagaatcctaaaatgtcctacccataggtgtttggaacattttcaggaataagatcaccatatgccctagaacagaattaggccagtcctgtagaaagcagaagcaaaagcaccacaatcattactgaatttcctttctttatgtcctacctctttctcatatacctgtgcattaatctaaatttggcatgttacacctacatacatcagaaatcctaaattcaacagaggacagtggaaggggccccaggaaaagtaaaggaagtggaaaaggtattttatagttaaccaaaacataagtagaagcaattcaaacttttctaaacaaaaaattacagattatgtcctattttctcctataatagaaatgaatttgcaatgccctgtttattatctgtcttcctagttgctttgcttctagcttatttgtcattactgtttatgaaaacaaatgaaatatgcattgcttttttaaaattcagaattgatattttactttttgaagctttaatgtttatctggcctgatccttctcaaatgggcatatgtatacactgggggatacatggctaatgctaatataccaaggggatataaaaatcataagatgaaaatggcatggtttcctagagaatatatttttctaatattactccaatagttcaaataaaaattgtattatttcaacatgaacacaaacacatttataagggaggaaaagacaaataaataatgcaggaagtttaagataaaataagacggctgggcgctgtggctcacgcctgtaatcccagcactttgggcggccgaggcgagtggatcatgagtcaggagatcgaggccattctggctaacacggtgaaaccccttctctactaaatacacacacacacacacaaaatttagccaggcgtggtggtgggcgcctgtagtcccagctactcgggaggctgaggcaggagaatggcgtgagcccgggaggcggagcttgcagtgagccgagatcgcgccactgtactccagcctgggtgacagagcaagactccgtctcaaaaaaaaaaaaaaaaaaaaaaaaaaaagataaaataagacagaaaatattgtgctttcagggatgctttagactatgtctccaaagttcttgcgtgaggcattcattttcctttactatcagagtgctatgggggaaaagtcaggcagaactgattcagggccagctgtgtggccactcatttacaaacagacgaaataacagcagactggaagaacaacaaccatttttacaagagttcattttaaaaatattccacaatgataaattatttgatttagcctcattcctgtcagattacctgcctaaaacacttttccgcctttctttctatctaaattccctgaacccagctccagctctgaattcaatcaaccaagatgctctcccaaacaactctagtccaaaatgatatctctctttgaaactcacatttcctgactacaccatttaaaaaataaactaatttattttaacagtaatatctcatcattgttaaaaacaagaaataggggaaaatataaaaaatataaaaattacctgcaataatctctatctagtagtattcttaagcttctttgcatattgttagacatttgcatatacaccttgagattatattgattgcacaatattgaatcctgctttttttaccaaatgacaaacatttctcccatcattataacagtacataacctatagtaattgacatttcctgtgttgttttttgcctgttaactctattgcattcatgtagttgcttatttattcttcaaacattcttagccacttacaatgtgccatacattgtgcttatgtgtgttttcttttccatgctaaattaacttctgatgaatagagacaattttttaaagatctccccaatctctgagtataatcaaatgagaaatgttcagtaatcaactgagcacgttaatcaattgagaaatttttcatgcacgtccctgtgaagagatcaccaaacaggctttgtgtgagcaacatggctgtttatttcacctgggtgcaggcgggctgagtctgaaaagagtcagcgaagggagataggggtggggccgttttataagatttgggcaggtaaaggaaaattacagtcaacggggctttgttctctggcgggcagaagtgggggtcgcaaggtgctcagtgggggagctttttgagccaggatgagccaggaaaaggactttcacaaggtaatgtcatcacttaaggcaaggaccggccatttacatttcttttgtggtggaatgtcatcagtaaaggcggggcagggcattttcacttcttttgtgattcttcagttacttcaggccatctgggtgtatacgtgcaagtcacaggggatgcgatggcttggcttgggttcagaggcctgacaaaattaatttatgaaaatttcatttatcctcaactttttggaaatactcttacatcaaagtacacctcaaattgtgtacactgactactgatcacttttcggtaggtataaagtccttaaaaattttgtttcaactttcccttttaagattagaattttgaccacagtgttccatgggaacaaagtgaatcatctgtggcaaaatatgctagtcaagaagtgagttagaatctgtgccaagcgttaagaccttgtgcacccaggttctggggcggagtaaagaggcaggctccaaagacatagctgtgtgttggacatgagagtatttggaggaatacaggtaacaggtgatgctgggaagtcctgtgaaatggaaggagaacgaagatgaggaatctggtggcagtaataaccggggaacagatgagctggaggcctcatcaggaggggtgtcccttggtggaaggacaccattcccggccttaaaaggagacgcttcagcacggctggggaagcacgtggataccttgtactaaatccactactgcagctcattcttaactgtaagtagaagaggaggacatgctttctgaagctgacccctccaagatgaccagttcctatttctgtcccctgctaccaccatggtgtagaacaacagaatcaaaaaaacattttttctgttatgggtgacctgtacgttttctagaatggaaggaggctgtttagtagctcaactctgagaacactttttctttggacaaaattaaaaaaggaaaaggtcaagttaatcattaatctctctgttttctactaatgtctccattttcgccatactttctatgtcctacatagcagccatcacagagggcaataaacacttctaatgaccgtgtaatttatatggaatgctgaaggggtgggttggccctccacacctgtggatgtttctcattaggtggaactagagacttggaaaagaaagagacacagagacaaagtatagagaaagaaaaaagggggcccaggggaccggtgttcagcatacggaggatccaccggcctctgagttcccttagtatttattgatcattaatgggtgtttctcggagagggggatgtggcagggtcataggataatagtggagagaagttcagcaggtaaacacgtgaacaaaggtctcggcatcataaacaaggtaaagaattaactgctgtgctttagatatgtatacacataaatatctcaatgccttaaagagcagtattgctgcctgcatgtcccacctccagccctaaggcggttttcccctaactcagtagatggaatatacaatcgggttttacaccgagacattccattgcccagggatgagcaggagacagatgccttcctcttgtctcaacagcaacgaggcgttccttcctcttttactaatcttcctcagcgcagaccctttacgggtgtcaggctgggggaaggtcaggtctttcccttcccatgaggccatatctcaggctatcacatggggaaaaaccttggacaatacctggatttcctagacagaggtccctgctgccttctgcagtgttttgtgtccctgggtacttgagattagggagtggtgatgactcttaacaagcatgctgccttcaagcatttgtttaacaaagcacatctgcacagcccttaatccatttaaccctgagttgacacagcacatgtttcaggaagcacagggttgggggtagggttacagatcaacagcatctcaaggcagaagaatttttcttagtacagaacaaaatggagtctcctatgtctacttctttctacacagacacagtaacaatctgatctttcttttccccacatttcccccttttcgacaaaaccgccatcatcatcatggctgtttctcgatggttgctgtctctttggagctgttgggtacacctgcagactaacaacagacaaaacaggcacacaaggattaatatgaaatttataatcgtagtacttccgatggtcttaacccaagtgacagggttaagatttgcgaggccatcagcaactcctgcgattgcctcagttcctggcaccaaatttaaatgggcttttgatgtttcaaaaatttgttcctttaatttggaaatgtctaaagtgagattatcttctgttccctgtagatggcatctgaccatgtcccagtgatgctcagactcattataaacttggggtgtaatacaaaaatctgagatattccagtcacactgtaactggaaacgatggtctaagttcataagcctgtctcccatccaaatgacagtttgtctaagatcattaatttggtttgccaatttttgatcaataccagattgtgaattccacaatcttgtagaatttttttgccaatcattaacaaagtttactgactgaacagaagagtgcaatgcaactcctgccatagcagccgtagctgtgactgcaattaatcccataatcactgtaattaaagtaaaaatgaatcttttggatctatttaaaatggcttttaatacttcagtcaaaatatggacggatggcaaggcctcccacggttggtccatggacatagaaatccacacggcttctcttgccctcaccagcagaatacactgttgccaattaaaagttgaataaatgcaagtaaacaatctgcaattttcacagcttatagtttgagagtctggtttaataactatatttcctacaactagcatataagggggctttacacaggtttggaaaggaactgttagactggaatttaggttgatagtataaaatagcttacgatctcgtttctaaagtttgatttctagaccaaattctaatgcagtatgaggccacagtaagcctccataattctggatgttcaggaccagaaacaggacttattatttttggtcttggggtagagattcctttttctccctattcccaagggtagaaagactgtaattttttagcttatgtttgtctaaactttctgttaagtcgctatcaacagctagactcacttgtgcactgggacacgactgagtttgtcctgtgcaattgtggtagaattgacctcgaggtgcccaatctataatagttccgaattcactgttttgtaatatcaccgcactattggccacacattcttcccaaactaaaacttctgtattttttgatcctttgggaatttccttggggcaaggtttccctttaggtctaaattttaatgatctttgataagaaaagtcttgtaaataatttacccgtggcctgagtgacatcccgcttaccatgtgataagtgaatctactgatgggactgacagtaggtacttctaccaaccaattttggactgcaggcattaaacatcctggtgctctccctaggcagataggaggataatgatacccaatggaaatatttatcatcatcccttcttcctcaggtttggcagggcaatgatcatctgtggggccaggtacccatacactatcattaacatatacttcaataggattatccatccatgtgactggtgtttccatctccgcggtggcgcttttctttgcatctccgatgggttcatcgtagatcttcaaatgtctagtgggtatccaaacaggaagctgattttctcctggtgaaacacaagcaaaacctctcccccacgtcaccaccttccctatttcccatgtcttatttttattatctttccaccaaatcagttttccttcatgtgggctgttctttttaccagtaaaatgttgttctgcagaagtagtagtctgatttctataaatgtttaaaaaatttaaagtatagagtgctagattaagttgcatctgaggagtggtacattccttactgtctcccccttctttttgcttaactgagttttgagtgttctattagttctttcaactatggcctgtctgtgggaattatagggaattcctgttgtatgtgaaactttccactgatgtaagaatttttggaaagctttactacagtatcctggtccattgtcagttttgatctttttctggaactcccattacagcaaaacaagataataaatgttttttaacatgggaagtactgtctcgattatctggccctaaacaatgtaaaatcacagtactttgatacacttctgaggctgtgcctacgctgacaagccctgtaacagcctttagtttaggccaatttttggccactgatttaaagcaatgatagagacatctgctccagtgtctactaacccttcaaactgttttccttgaataatggccttacacgcaggtctgttctctgagacccgacttgcccaatatgcagcctttcctgttggatcagtgcttccaaaccctcctgttctttttatctcactatttccaaccttaatataaggcaggagtaataattgcgcaatcctgtctcctggactggcactccaaggaattgaagagctaataaccaattgaatttcgccattatagtctgaatcaaccacatcagtacgaatttgaactcccttcagacttagacttgatctacctaagattagtcctacagtcccctcaggcagtgggccatatacccctgtggagattttttgtgggggctcccctggaagcagagagactgcctttatagtacataaatccacagctgcactgccgcttgtggcgggggacaattgttgtactgtggtaactggctcattccctgaggcacttgggacagtgggggttgttgtccctgaaaaccctgaggaacaaagggctgaattgggaatgccccagtttgttgcggggcctgaggctggcccctttgctcattttcccgacaatggttgcccatttctatcaaatttagaatgacattgactagcccagtgttttccttgtttacatcttggacataagtcaggtggctcttttttatttgagactgggcaattcttttttagatgaccaatttgatcacaattataacatttccctccaaatgttctaacttgtcctcctaaagcaactcctgttattgtggaataaagtttagaaaatatccaaagcttatcagcctgtaaattctgggtagttcagttgtctaccatgctgttaattaaatgaaaacatcctgttatttcag

SEQ ID NO: 147 - DNA, 1699 bp, Homo sapiens
  source 1..1699: mol_type = genomic DNA
gtgagtacagtcgtttctcttggcaccccaggctggcctcatctcttggaggacctctggggtccctttgcccccaggaagaaggcaatcacaggggcgacttcagggccatacaccagccctctgggttcatctgaaatgtatgtcacttagaaaaacattagcagtcctagaaattcaggacagaggttccttttggggtgaggaagaggggatgtaatctggaaggggaatcaagaggaattttcatctgttaccaaaactttattatttatttatttttcagagacaaggtctcacactctgtcacccaggctggagtgcagtggtggtggtcacggctcactgcagcctcgaactcctgggctcaagcaatcctcccacctcagcctcctgagtagctgggactgcaggtgtgagccattgtgcctaggcccggggggcactttttttttttaattttatttttgagacagggtctcactctgttgcccactctgaagtgcaatggtgcaatcacagctcactacagcctcgaactcctgggctcaagcgatccttttgccttggcctcccaaatagctaggattacaggtgcacgccaccatgcctggctaacttttttaagtttttgtagattttgcaggatctggattatacaaaacatagaaaaaattattattatttttttttttgtagagattgggtctccctatgttgcccaggctggtctcaaactcttgggtccaaataatccgcctgactcagcctcccaaagtgctgggattacaggcatgagccactgcacctggcctgcaaagccttatttctttttctttttttttctttcgagacacagtttagacggagtttcgctcctgcccaggctggagtgcaatggcgcgatcttggctctttgcaacttttgcctcccaggttcaagtgattctcctgcctcagcctcccaagtagctgggattacaggcgcacaccaccatgcccggccaatttttgtaaagccttatttttaagagaagtgagtactcagttatttgtagcattattctttagctcttgtttttttttttttttttttcaagaccgagccttgttctgttaccaggctggagtgcagtggcataatcttggctcactgcaacctctgccttctgggttcaagcgattctcctccctcagcctcccgagtagctgggactacaggcatgcaccaccacacctggctaattttttgtatttttagtagagacaggggttccccatgttggccaggatagtctcaatttcttgaccttgtgatctgcctgcctcagcctcccaaagtgctgggattataggcgtgagccaccgcacccagcccagacttgctacttttataggctagaaacggttgaatgtcagcaatgtcatgcttcaactgattatgtcttagtgcataagaaagtttagaagagggaaaaacgactcgcacacctccttgttgagctaaagccttggggtcaggcatgagccacagagtgccaggcacacagtgaggtgtagaagggcagggaatgtgtattccatccttagtttaggcagatggcaaccaggatggaattcttggcatcccacccagcctcagggcctcacaccagcccatgtggatgacctgagggtcctgtttcccatcccaccccag

SEQ ID NO: 148 - DNA, 3767 bp, Homo sapiens
  source 1..3767: mol_type = genomic DNA
gtaattaagcagatcttcaagcccatcttttaggggggtagaaacttgaacttgagaagtgacatttattcttgtcctaaggaatcatttaaatggaagaaaaagatatcttatacctgatataatactagattttctccatgtgtagtcttcaactagataaataggtattgtggggaggggagcaggaaggattcctacgttaaatatgtttagataaagactggcttttctttcctgtggggcctctcagtgtttttactatgctaatgtgcattgtgagtctgtgggcacgtggcaggcagcagttctaggtcagactttatcacagaacacttttctttgttttggtagaacatctcaccagactagggatctgccaaactttgggaaattctgcttcatgaacctggggttctagaatgctaaaatgtgaaaggacatttaagaccacctgggacaacatcatattaatgctggtgtttttaacataatatccccacaggtatttttccagttatttcttatagtcccgtgatgtataatttattaattaatgtatgtatttatttatttgagatggagtctcgctctgttgcttccaagtagctgggactacaagcatgcgccactatgcccagctaatttttgtatttttagtagagacggggtttcaccatgttggttggccaggatggtctggatctcttgacctcgtgatccacccacctcggcctcccaaagtgctgggattacaggtgtgagccactgcttctgacagatgtataatttattatcttataaggaagccaatctaagcgtgtgcaatattcattattgggaagggaaagaaaggagtgaacatgtattaagcaatgattatgggttgtggacaatgtggtctctttcaaaatgtcttattcaattctcagagtaagtttactcagaagaagcttgttatttccatgttatggattgcgaagtcaaggctcagaaaaattaggtttgcatgagatctctcaactatgaagagttgggatctggaagcagatctgttctgtttctttgtgagacaccatgctcccttcacaggacttgctttacattgattttaaaggcatctccctattattttttcaattggtctaagttaaattccctgtactcacaagtggaactctttctttttctttcaacttttgttttagattcagggagtacatgtgtaggctcgttacaagggtatattgcacgatgctgaagtttggagtatgattgaaccattacccaggtgactggcatagtatccaattagtagtttttcaacccttgccccactctctcctccagtaatccccagtgtctattgttcctatctttatgtcgatgtctatccgatgtttacctcccattataagtaagaacatgcagtatttcattttctgtttctgcgacaaacagaattctgatgtcactccattcgccactcttaggatctctgcagacaactatcctgtgccctctagtgccctctccccacattgcacattttcagttcctttccttgctttctaaccactttggtcagcctccgtggatcgattccagtctgtctaagtacctctgagtgtgtcatacctggggaaaatctcgagaagtagaatcagaagagcttacccattgggcactacttggttactatccctgcagagccaggaaaagcagctgttacatttactatttccttactgattgaccatttagtggataaaggctgaggtctaaattccccaggtgctgtttgcatttttctagcaatttatttaactcaaggaaaccagcttgacttctgctgctgctgatttttgtcagctttaaaaatcatcttgggaactgacaagttgaaataattgtgtgttacacagtctacgagctatgactttgacgtcaaatagacctaattcaaatcatggctctgcctcctcccactctctgactctgggcccattattttacctctcaaagcttcaatttcttcatctgaaaaatgcatttaaacctacttaacaagatccacatggaggtaaaatgagatcatgcatgtagggcatttaacccagtacttagtacagaaagtgcttaaaatagcaattattggccgggcatggtggctcacacccgtaatctcagcactttgggaggctgaggcgggtggatcacctgaggtcaggagttcgagatcagcctggccaacatggtgaaaaccgtctctactaaaaatataaaaactagccaggcgtggtggtgggcacctgtaatcctagctacttgggaggctgaggcaggagaattgcttgaacccaggagatggaggttgcagtgagccgacacactgcactccagcctcagtgacagagtgagagtctgtattaaaaaaaaaagttattactaatattggcaatcattgatattaattccttgaagtaatattatattaatatgttaatatttgaatgaattcaacaaacactacatacctgaaatgctcaggtctggcaaaacaaccctgagaaaagtaatcatgcaagtacatatttagaaacgtgataactgcccaaaggaaaaaactcactgtggtctgtaaaaacagactagcaggagtggtcagggaaggcttccaaaaggaagtgatgtttgagctgaggattagcttcaagagttagcttgatgacaaagtggggaggaggaacattcctggcaaggcaaatagcatttaaaaaggatgctgaattaagtaggaaaatggcatgtttgagaaactgaaagaagagccctgtagtgggagtgcaggcagagggggagagtagtgcagaccaggaccaggtgaagagtctttgccctgagagcaatgggtaactattgaagtgtgtcaagtcctaggtatgagcagtgggggctgtggaggtggggaatgacatgactaaatcatgctagaagctcactctcttccagagtgtgaagcagattgaaaggggtgacaggatttggggcacagttaggaaactataacagtggtccaggcaagccaggaagaagtctggactaagtgagcattggtggacatggaatggaggtgaaagtaaaattgaccagtctcactgatgggttggataacgacagagtaaaggaaaagctccctctgggaactcctgtgtttcttagcatgtacctggatggacaggggctccttgcatgggtctacctgattctattactaaacctaccatggggagtggggtgccatgtactagacattggaggaaagagaatggtgaaaccaagatgaatgagatgtcttttacctttgtagagctgccatcgttatagcttcactgagcagctgggctggttttggtacagtgcagactgactgttggattattctctcatcagtgcattcatgccccctccttccaagccctactgaaactgacctgtccctgtaaggaagctcgatcctgcagtcaagagtagccagacatccttgttaaaattcccagcagggaaatccaatctaatttgaaagctgtcccagacaaagagaagggtcctgggttgggggacacaggagactgtgtaccacaattggggagggtggggcagtatgttcaggcccccggcaaggaagccggaggatgaccacccctctgcataggtgtgctttttcatgggtcaagccttgcctgagtctctgctgctttctctag

SEQ ID NO: 149 - DNA, 4446 bp, Homo sapiens
  source 1..4446: mol_type = genomic DNA
gtgggtgtgtatggcagagcccaaagtgaacagtctgtggagaggtagattatagctagaaaaccaggctctgagtttgctgtggttggagagtgttttttgtatctgtctctgtgttttattgtttgcttgctagctatagatctcatcttgacattggccagacgtggttgcttttgcctctaatcccacactttgggaggccaaggcaggaggattgcttgagcccaggggttcaggactagcccgggtaacatagtcagaccctgtctctacaaaaaaatttaaaaattagccagacttgatggtgcacacctgtgcccccagctactcaggaggctgaggtgggaggactatctgagcccaggaagcttgaggctgcagtgaatagagattgtgcccctgtactctagcctgggtgacagagtgacaccatctcaagaaaaaaaaaatgacattaacaaagaagtaatcatccagtgaatgaccataaaatactggaaataagaacaaaattgcctcttcttattttaataaatcaatagtttatattttatgcctcatccaatccttattgtatgctctacgtgacttaacattaataaaattgcatctgtagcttcagtaaccttattttcacttaacattttggttttgtttatttgtttgagacagtctcactctgttgcccaggccagagtacagtgcatgatctctgctcacggcaacctccgcctcccgggttcaagtgattttctgcctcagcctcctgagtagttgagattgaacacccgtcaccatgtccaactaatttttttgtatttttagtagagatggggtttcaccatgttggccaggctggtctcgaactcctgacctcaggtgatccacccccttcagcctcccaaagtgctgggattacaggcatgagccactgcacccggccaacatttggggaggcattttttaaggtgtatatataagctttctatctgtatctttcaatgactgtagaacattttatcaagaggatctgatataatttaactgctccactattacttgacattacaataaacattataaatagtactgtttcagcctgggcaacatggtgagatcctgtctctacaaaacaaaaaaaaaaattagccaagcatgatggtgcatgcctgtggtcccagctacttacgagactgaggtggaaggatgacttgaaccctggaggttgaggctgcagtgagctgtgttcacgtcaccgcaatccaacctggtgacagagcaagaccttgtctaaaaaaaaaaagtactctttttggataaattcttagaagtgacatttctggacgaacattgagtgactactcattctgctttgccaaggctgaggggtttctcaggacacaggtctttcagtgctaaaactggtgaaagtccccggcaaaccaggacatcactctacacagaggtcatgaacattttatggtataatgcatgttataaattggaagacattaagtttaacaaaagaatggaatatgacaatcttggtgaaatttttaagaagaatggagggccgggcgcggtggcttacgcctgtaatcccagcactttgggaggctgaggtgcgcggatcatgaggtcaggagatcaagaccatcgtggctaacacggtgaaaccccatctctattaaaaatacaaaaagttagccgggcgtggtggcgggcacctgtagtcccagctactcgggaggctgaggcaggagaatggcatgaacccaggaggcggagcttacagtgagccaagattgtgccactgcactccgcctgggcaacagagtgagactccgtctcaaaaaaaataaataaataaaagaatggaaatatggtctgtagttcacaggtcccagtgtcctagcacagggacacagtttgatgccagggccgtgatatttttttccttgagtgaatggcagtgaggttctcaccagaaccttgtagaagtctttacgtttgttgactccagcttctcttttgtaactgagaggcagttttgcctaatgcttaggagcttgagctctggagtcactcagaattcattggcacccctgctttgtcactgtctggctttgtgacctgcagcgagttatgtagcttccctttgcctcagtttcttcatctataaaatggggttagcaatctctatctcagtagattatttgaagataaataagatggcacaatgaaaagcatgtagcacaggccctgacctaaaggaagtactcaaaaaattgaaacttgttattagcaactgtattgactgatgtcagtggtgggttccaacccagatgtgccatccacagtggctgccttgcaaggtctttagggcctgaggctattcaagtgtcaggttctcactggcaattttcctaagatgacagtagatttgtttgcttgtatgtttgttaaggggttagagaggcagctcttcagcttgtttcttctgttctgtttgaatgtcttctgttgtctacgtttaacctcccgctctccatctctcaacattgtcctccacctctcaacattgttctccacctttagtggtacaggattagagcagccccaaaggactaagttttcttctttttttttttttttgagacggagtgttgctctgtcacccaggctggggtgcagtggcgcgatctcagttcactgcaacctccgcctcccaggttcaagcgattctcctgcctcagcctcctgagtaactgggattacaggcctgcgccaccacacccggctaatttttgcatttttagtagagacggggtttcaccacgttggtcaggctggtcttgaactcctgacctcgtgatccgcctgccttggcctcccaaagtgctgggattataggtgtgagccaccacgcccggcctgtttttttttgagttgaagtctcactctgtagtctaggctggagtgcagtggtgagatctccactcactggttcaagcgattctcctgcctcagcctcccaagtagctgggaatacaggtgtgcgccaccgcacccagctaagtttctgtatttttagtagaaatggggtttcaccatgttggccaggctgggcttgaactcccaacctcaggtaatctgcccaccttggcctcccaaagtgctagggttataggagagacccaccacacccagccagtttcatttctttttgagttataatttcatatggtgaactgcacagattttaggttttgacaattgcatttatttatctaacccatacccctgtcaagatataggacatttcctgccgggctcagtagctcatgcctgtaatcccagcacttcgggaggccaaggcaggcaatcacctgaggtcaggagttcgagaccagcctggtcagcatggcgaaaccccatctctactaaaaatacaaaaagttagccagatgtggtggcacatgcctgtaggcccagctactcgggaggctgaggcaggagaatcacttgaacgtaggaggtggaggttgtagtgagccaagattgcaccactgcactccagcctgggtgacagagcaagactccagcttaaaaaaaaaaaaaaaaaaagatgtaggacatttccatctctccaaaaaaattccctggtgccccttctcaatcaacttctgttctacctcctccttttcctctctaggcaactaccgttctgatttctgtaactataaatttgtttttcccattctagaactccatataatggaatcagacagttgaggatttttgacatattcttcaactctgagcctgttttatcatttgtaaagtaggcatgaaaacagtagtgtcattttaaagtggttgttcaaagaatcaaatgaaattatgtgaaaaccctttgcaggctattaaatgctacacagctgtccagttgttgctttttttcttttaactcagcctctcaacctaccagaataatgaagttatgctgtgagtaataacaccttgtgtttttatattgttcgttagccaccttgtaagggatggattgtgatcccatattacaggtaaggagacttcaacctagagaaattaaatgatttgattccagtcacataagtgcatgctggagtcagggactagagcctatgtctttacactctcagtgcagagttctttcttgtagtgcacaatgccatcagcattcactaagatcacatttttcagtttcttcaatggtggttttctgcttatttgatgcattaattctgacataaacactgatgttatcctagcttcacccagctttggggaggagaaaagtctgtctcctatctccaactctgagtcaggaccaaaaagtatctcttatttccccttcccactcttccttgtatcctagctccttgccttctcccctctcag

SEQ ID NO: 150 - DNA, 3896 bp, Homo sapiens
  source 1..3896: mol_type = genomic DNA
gtgaacacagagtgaggagtagtggcaccggggcgaccgctcccggatctgctttcccagtggacaaaggcagtggccgcctggcctggaccgttgggcgattccttcagtccagtcttcggggtggcgggggtctgggggtgtgtgagcgtctcccactgatagctgctgggagatcccccggggcaacgaaagagggaatggtgttcgatctatcgagggaggtggcgagtgtgtccaacatagtgcgggcgcgcgggcagagtgccccaagtccgcggagtcgggggctggcagaggctgggcccttcctgggagtgacttagccttcttggcccccgagacgtttcttagtcctttgtaatgagttgttttagtggttgtttctgccattcacgaacgccaggcactgtgtatcatgccagttaggcattatattacccccattttacagatgacgaacctgagctttagggaggtgaaatagtttggggccttacagtaggttacagcttgcttggtggtatgttaggacagcagtgggcttgttctgagcctcctttactatcgcatctccagcgcatagtatgtagtggatgctcagtaaatatttgttgagtgaatgaatgaataaatgaaataaaagcatgccgtttggagtcagaatctcagattaaattattgcaaggggctgggcacagtggctcacatctgtaatcccagcactttgggaggcccaggcgggaggaacccaaaagctcgaggctgcagtgacctatgatcggaccactgcactccatttttggcgagagtgagaccctgtctctttaaaaagaaggaaaaaaaggatagaaaaaaaaattcttggttgggcgcggtggctcacgcctgtaatcccagcactttgggaggccgagacgggcggatcacgaggtcaggagatcgagaccacggtgaaaccccgtctctactagaaatacaaaaaattagctgggcctggtagtgggcgcctgtagtcccagccactcgggaggctgaggcaggagaatggcgtgaacccgggaggcagagcttgcagtgagcagagatcgcgccactgcactccagcttgggtgacagagcgagagactgtctaaaaaagaaaaaaattcttggaagacagttaacctgactggactgggattgaattctttttttttttcctaaggcggagttttgctcttgttgcccaggcctggagtgcagtggcacgatcttggcccactgcaacctctgcctccctggttcaagtgattctctcgcctcagcctcccgagtagctgggattacaggcgcctgccaccacgcctggctaatttttgtatttttggtagagacgggggtttcaccatgttggccagactggtcttgatctcctgacttaaggtcctcccgcctcggcctcccaaagttgctgggattacaggcttgagccaccacgcctggccgggattgaatttgttcaagacattaattttgcagatcttcatattccacatctgtaaaaacaagagagttaatttaatttaatttatttattttgagacagagcctcactcttgcccaagctggaatgcacaacctctgccttctgggctcaagtgattctcccacatcagtagctgggactacaagctcaggccaccatgcctggctgatttttgtattttttttgttgtgacagggtcttgttgtgttgcccaggctggtcttaaactcctgggctcaagcaatcctcccgtcttggcctcccaaagtgttgggattacaggcatgagccactgtgcttggcaagagagttaattttaaaataaacattttcatgaggactaaagttattgtataagaaagcgtttcataaaaaaataaagcagaagcatctttctcagggttaaacaaggcagaagatgggacctctgtagggtggcatgggtttgaggaatggagttgccccccagcaggctgtgagctattcagggttaaggaccatatcacatccatcttttatttcttgcaattgtaacagtacttgttacatagtagtttctccaaagtattacatttaggtctagacacctggcaggcactgcctgtagtctcagctgcccggaaggctgaggcaagaggactggaggatgacttgagcccaggaggtggaggttgcagtgagccatgatctgtcttctgtcactgcagtacaccctgggtgacagagcaagaccccttctcaaaaaacaaaaacaaacaaaaaaccaaatggcaacctttgtttgaattggatgggaaaaaatatctaaggaagggtaattcagtcatttttttaaaaaatagagacaaggtcttgccatgttgctcaggttggtcttgaattcctgcacccaagtgatcctcctgcctcagactcccaaagtgctgggattacaggcataagccaccacactggcctcattcatttaacagatgtttattgaacattggaaatgtactagtttgctatttaggtgttgaggatacggtagtgaacaagagagaaaaaaaatcctgttttcatagagtgaagagggaagatgtctagaaggaatgactttttatgttaatgaaattctttccaaccttgttttggctataggaataaagatggcatatagcataccagagattcattccaactagcattccaactctgacagtgacaccaagaatgttttcctgggactgcctggtgcttgttctccctggcattgtcttcaggtcagggatttttcttttttctttctttcttttttttaaattaaaaatagagatggggtttcgccatgttgcccaggcttgtctcaaactcctgagctcaagcaatccacccacctcagcctcccaaaatgttgggattacaggtgacagctactccgcctggccaagtcagggattttttctaacactattagaattaggtggtggagttgtttgttccttcccatcaacagttttaaatgctgctcatagtttatgtcttactgtgattgtatttttcctttttttgctctttaaatttttttctttattttttttcctcacagagaaatctcttactttttttttttcttttttgagacggagtctcgctgtgtctcccaggctggagtccagtggcgcgatcttggctcactgcaacctctgtccctggggttcaagcgattctcctgcctcagcctcccaagtagctgggactacacgccatgccaccatgcccagctaattttttgtatttttagtagagacggggtttcaccatgttggccaggatggactccatctcctgacctcatgatctgcccaccccccagcctcccaaagtgttgggattacaggcgtgagccactgtgcccagcctattttttttttcttaaaattaaaagctataaatgaagtataatcacacacaagcacatcttccatcattaaagtggaagttctttaaaggctgtgacttatttatctttgaatcctcttgatgcctgctgtggggtcaaactgttggggttaaaattctggcttacaagttgggtaattgggaacaagtcagttaccttctctaagcctcagtattcttatctgtgaattgggtataacagcagtatctaccacatagggttgttgagattaataaatacatgtaaggtttttatattaaaattcaacaaatggtagttttaatttctcaaagcatttagcaaaatgtcttgcacatggtaaacacacaaataaatgtttgttgaacatatcagtgaacattttgttaagataattcagtttgttattgaattctattaatgaagtttttaatcctcataatttta

SEQ ID NO: 151 - DNA, 3789 bp, Homo sapiens
  source 1..3789: mol_type = genomic DNA
gtaagagtcttataaaatacaaccatctgaatcaaagaagaaatgacctaagatcttgtttaactttttttttaatgtgtggatatctagaaaaataaaacataggcttaaccctcaataaataaataaattcaggtaacttaaatgtattaaaagtggtatataccctaagaaagataaaaatagagtgttataggaatttagaatttcagctaccaaattaagttcttattcaagtaacttagttatttagggtctactatgtactaggattagcatttatagtaccagataataattaggtttataagagtgtgatatgagtctccacgtttcggaatcctcatttattttcattattgttctatctgtaataggaagtagaaatatagggaaaaaaacactaatagaacagatagtttttaaaagcagaagggggagatggattagctaaaagtaggcagtttaaataaaagtaaagaagctattagcaatctctcaagtataaaatgtcacctttgatgcattgtgataactggaaatggtgttatggtttatttttcatattacatggattatacctatttttctctttgtcttgatagcatacttcttatcactttagtgatatggggacaaggaaaagacgtggaactatactgcttaatatctagggtaatgattttatggcagaaaagattgaaaataatagataaatatgtatattggggccctccaaggaaacagaaatgacaagatgtgcatatatatcttatacataggcatatatctttatatatatacttctatatagatatagatgcacaagcatattcacaacaaattaaggaaatacttgtgacaattacagttctcatttttgatacctgtcatgtggtcacagctggtagttataagtaccttcctcctctatccatcccatattccctttcccattggagaacaacacctcagccggttgtaattctatatctggtagggtgacccaaatccacagtcctgaagggtctgggagattggtagttctgcctggattggattgttgtagttttccattgaccttaatcacaaggcatgattatacaaagagatccctaagggatctcatgtatttcagacctactctttcttacacctccactgtgaaacagcaatccaatttccccttagtagtcaggattagtcatccagccagcacagtagctgtcttctttgttgattggaaggcatgaggagttcaaagttgctgttgtatctcctggtggaagtgttcctctcccttagacaaagacctctaggcctgccgaacataaggtcacaggaacaggaagcaaaaatgttgccagtggatcactaggtggtaatggtgggtgatgccactcgcatttccatcccttgatccctggacctgtaaatactggctatgggagaaaccatgctataatatattagacactgattcagagcatatccagctttctggagaaccctggcccagccctgcaaggtacctacctggcagtgtaatggagtcttaaaaggccattctacctttctgtcaaaccagctgcttcaggatggtggggaacaggtaaaaacagtcaatttcataaacaaagcaaaatttactaggtgattaacaaatgctaaaggctactttaatacctttgctaataaaaatactaatatatcagtgactgtcaacaccagcaggcagtgagagaaagaataaaggatccaacaactcccatgaggtagtctactactgaagttattcactgttcattaaacatttattcggaacagctgtgtgcaggacaatatttcaggctttgggagaaataaaaagactgctcctatcctggagaagcttaaagtctatgggaaagatactactgggtaaaacaagcatgtaagaagaaagccatgaaccaaatcactaaatctgtttgtgatgatctaggaggacatcataaatgaagtcatatttgaactgaattttaaattgtgagagttcggcaagtagagatgaggtttggggagtagaataaatgcggtatcatgaataaagatgtatttgtcaggcttttgtcaagaaaattagaaaaatatactcaaaattgaattagacttaagtcagtttaactttattcaatatgaagaatgcagctcttgggtcttttttttttttttttaatatgggagttctataataatacctaatgttttttagtggcgacaatgtcctaggcactgttaagaacatgaactctgcattcagtcatgagttcaaatctcagctctgttatttatcagctgacaacttaggcaagatgatacttacatttctagggtctgtaatcacatataagatgttactctttttagaagataatccgtttttatataggtgttttccttaatatgggaagataattcagctggccctccaggagtaggatatgaagtttgtgggcttttgcatttggggagactgatttgtactgaggtaccttgactggctatttttaggaatacagattattactcttcattttctatgaaaggaattggcccatggaacgttgaaatctattgcttctccttaactccatgctttaaccagctgaggcaactactaaataaatgagtatgtaagtcataatgtaagtcttaaagtaaataatgagtatgtaagtcataaacttacccttataagggatatcagacatcatctaatttattcattaattcatgcatttattcaacagacatttgttagactttcggtttgtcaggtagtgcccacccattggaaatacaaagagaaacaagaatgattttctgcattcatggcccccaaaatacagtggcggtgggagaagggagctgcttacacataattgcaaaaaattaagattaagtttaaatacttcaaagtattatgtgcagagtgttatgggaatgtcaagacaggggtctaagaaagccttacagaggtgaggagatgagcagaatgaaagaagaatagggttcattaaatgcaaagaggaaggccatcccagtggagcagacagcagaagcaaaaccttgaattgtgagacagcatggtgcaaattgactggatgatacagtgcaggtcagtgaagtcagcactaaagggagaaacaggctgcttagtggaggcccctgtgagtgacagatggtgagttggcttctgtttgacttggtacctccagtggtaggtacactgactcgtggggcaacccaacccatgtcagctttggttcctaggaaggtttatggctaaaatagtacctgggtataataggactgattaaaattttcccataaaattgacaggtaattagctaagataaaaacacattttctgtaattgattacaaaatgtcacagaatgtaaaagatatgaggattaggaatatgatattttggtagatgataggaagtattggacagcacacatcactagtgcagcagttgtaagaaaaagtgattaacaagtgattcccaattaaacatgtcttttttatttttaatttttttctaggaaacataagaatgtgtttgcttcatttatacaaacaggactaaaaatgctgttaatcaaattcaaaatatactatttattaagatgagttctatgagtttatacatttttatgtgtcataagattgaactgattttcacattaccacaaaatttaaaactgttgcaaacctttataaattttatctctttttaaag

SEQ ID NO: 152 - DNA, 31734 bp, Homo sapiens
  source 1..31734: mol_type = genomic DNA
gtgagtgaccggggagcgtggggtggaggacagctcgcgacggccgggtcggggccggggcagcgtcgcggcgccggggctggagtccgagctgggagcgcgacggcggcggccagatgccccgtgagcccagccgtgggaggctcgggccgggcgtaggaggcggcaccgggccgggagagcttccctgacgggagtcgcggccccaccgaggcgtcggccgcccgaagagcctcccaagccagcgcggctgtcacgggcagcggctccccggaccccgcgggctcgggcgcaacttcgtggcgtcctgcacggcacttgggggtcccagaaggccccggcctgaggaggccgcccacctgcgggaccctcctcctcgcgggcgggcgccggcgctgcctggcgggggccgcggaggagccgaaagggcgttgggatccaggggaagggtctgtcctgcgcttcgaatccttgtttgaactttttaaaaattcgaaaactttggggaacgaatgcaacagggagtaaggactctcacccgagagctggcttctgccacttgccctgccggtttcttggtactgggaggctgcaggcttccttctgtgcaccgagacttccttgagcaagtggagctgtgggaattgcactcttggaagatcccgcatgggttcgaggtgaggccgcttcagaacctcaaatgaaagactgtctcctcgtgggagagcacctggggccatcagaaatgtcttttcatctttttctggaggagacgaatgatagggcctggtttacattcatttaactctttatgaccttcactcagctgtggatttgggggcactttgtgggagacttggcttttttttttcttctggttggaagaacctaaattagcgaatgtttttcacaaaatgtattgttcaggatgtgagcgtggcaaatttgtccgtgttctgtttaatgacctctttaaaggtactgtgtactctttaatagggatatcatgtaccaggtgtcccagtagagcactgacatgtgtgtgcctgagtgccagccaccgtgtgaactctttggaggttttgcattttaggtaaataactgtctgtactcttggagtaacaagaatttggaaacaggagaagtaaataaataaggttgcctttttcaaattcagggtttttttttttaaataaaggaaaatttgtagactctttataatagaacttgtggaagttaagtttttctttcaaataaaaaccccacttttacaactaaggtcaggttttgaacttgagcacctcaccttggattggtaactactgcctggcatctgttcacaaacgaaggtataagcagaatgaccaaatgtttgacatgaattcgatcatttcataacgtcaagggataggtgtataatggtttcctttgccacatctttccttttgctactttgtcactggattctagtgtttggttattgaataacttaggctaaagagccaaaaataacgatttagctgtagttggaactatagtttcagttcgtgtaaatatttccaatttgtatttagaaatccaaacttctcagagttcatgataaaatattccagacccttatcaaaaggttatagtttagcgtaactatatttaggtgaaaggtcaggccgggcccggtggctcatgcctgtaatcccagcactttgggaggctgaggtgggtggatcacttgaggtcaggagtttgagaccagcctggccaacatggtgaaaccttgtctctactaaacatacaaaaaaaaaaaaaaaaaaaaattagccgggcgtggtagcgcaggcctgtaatcccagctactggggaggctgaggcaggagaatcacccgaacctgggaggcagaggttgcagagatggagtcactgtgctccagcctgggtgacagagcaagactctgtctcaaaaaaaaaaaagaaaggtcagaatttcactcctagaattttctcccaagggtttttacccccaaacatagtaagaattattattttaaaattgtaaatgaaactcatagcaaagtttgcagttaaaccaggcaacagtgatgtgcagaacgcagtgggtataaaatcagacaaacctgagttctaactggtcacttgctagctgtgccctaggcatattcttttactactactactactacttctttttttttttttttttgatatggagtttcttcgctcttgttgcccaggctggagtgcaatggtgtggtctcagctcactgcaacctccgcctcccgggttcaagcgattctcctgcctcagcctcccgagtagctgggattacaggagcccaccactacacccggctaatttttgtatttttagtagagacgtggtttcaccatgttggccaggttggtctcgaactcctgacctcaagtgatccacccaccttggccttccaaaatgctgggattacaggcatgagccaccgcacccggccatgattttacttcttagagactccttcctgataggtgaaatggggacagctaacatgtgaaagaaggcaccaccttcacacgtgcttaatagataataaatgtaaattctctttatgctccaaagatgctttttactctaagccatcattttttgaatgttatactatgcctctgcaagaaatagtttttgatatttctttttgattgatgtagtaactattgcattggaggcaatactgtgattttctttcagtgtgtgtcttattgagccagacattgactcattatgagttgagactttaggctaccagatccaaaacgcaataacattggtattattaagcacttgaggctgtcttttgttaatccagaatgtgcttatttagtcagtgagtttttcctttcttcctagacctatatcttgctcctagagttggttagggttacatcatcactgtcagcagtcctcattttatggttatttaggtgccacatctctcaattaccaaagagatcagtacaatgtgaggcaaagtacctttttttttaaaagctataagatatcagatttctttcatttagccaatattttggttttagagggaggtttttaaaaagtcaccgagaactgaggatcatgtgtgtatagaaacactgtaatctgatagatgagtcttaactagcaatgtctttgcttatcatttattctgacagtgatcacctgcattaattatcctaataggcgatatcaagtgtttatactgaggccataagtagaatgttcattgagtttgttatcagggctgctgatcatgaaattaaactgtagttgtgcacatgtgtattgtttcattaacttgcctgcctattcagccttctgcagtaatgtagcttctcagagcacaggagaaaaatgtatctgagagttattcgagagagagttcaacaatagcccatatttccgaacataaatctagtgagccgcattaaagtttcttcatgtctggatggaatagtgtcacttgcataggtctgagggtttcattatttgcctgccccagatttggactccgtttttcaggtgaaagaatccttggataactgtttcattttcataggaaacctctttggtttcgggatccaaagtaatatgtaggttcaatattttgtaggttttataatcaaatgtctccctaaagagatgacatagggaagaaaagcctaatgtatcatcttaatggattcagtttttattatgcacaaataactgggcttgtaacctaggaatatgattagagcgtgatgctggcttaaaaaataggactggtgaatcacagtttgtgaataataaactactggttggaaatatttcccagaagcagttttttttttcctttctatctttacctatatcccatgtttggtttcaaacttccctgccttagagcaacacagctggttttagacagtctttctatcaatatcttataatctttgctcatgtacaaacatacagcaaatacaacggtataaaaatacgatgttatctatttttgttcactttttccccacagaacatcttctgtaacccggtagaaaatgttctgagtacaccatcacatttgtcactttagtagcaccttagtaaaccatcatccatgtaaaaaaacattgagcttctcagccgggcttggtggtttgcgcctgtaatcccagcactttaggaggccaaggcgggtgaatcacttgaggtcaggcgttcgagagcagcctggccaacatggcaaaactccgtctgtactaaaaatacaaaaattagctgggcaaggtggcatgcacctgtaatcccagctactcgggaggccgaggcaggagaatcgcttgaacctgggaggtagaggttgcagtgagctgagatcacaccactgcactgcagccttggcaacagagcgagactctgtctcaaaaagaaaaacaaaaaacaaaaaacattgagcttctgtgcccagccgtgggttggggactggggttataactgatcagggttgatgtggtaataagccgagctttgcctgccagtcatcttgctgtggccatagggatcataaagaaaggggtattttcattttttcaattattttatgtttggtgctttctgtatgataacaggggaagatatttttttttgaggcattatctcaaagtaatcatattcattgtagaaaagttagaaaggatagataagcctaaattaaaaaataaaaaacaagccttctattatcttattttccaaacattacctctatgaagattttaaacaattttattgagatataattcacctatcatcacaattcacccatttaaagtgtacaattcggtgggttttagtatattgacagaattctgcagtcatcaccacagtccattttagaacattttcatcatcccagaaataaacttcatacctattagctgttacacaccgtttccccccaaacctcctagtccttggcaaccacaaatctactttctgtctataaatttgcctattctggacctcttatataaatggaatcatacattatgtggtcttttgtaactggcctctttaacttagcatcatgttctcaaggttcatccatgttgtataataacatgtgtcagtactttgttcctttttattgctgaataatattccattatatgaatataccacattttatttatccattgtattagtccattttcatgctgctgataaagacatacccgagactgggcaatttacaaaagaagtaggtttaatggacttacagttccacgtggctggggaggcctcacaatcatgaaaaaaggtaaggaggagcaagtcacatcttacgttgatggcagcagggaaagagagagcttgtgcagggagcttcccatttttaataccatcaaatctcgtgagacttattcactatcacaagaacagcacgggaaagacccatccccatgattcagttgtctcccacggggtccctccaacagcacatgggaatagtgggagctacaagatgagatttgggtggggacacagagccaaaccatatcatccatccattgagggacatttggattgtttctgctttgggactattaataattctgccatgaacatttgtgtacaaatttttgcgtggacatttattttcactcttcttgggcatatatctaggaaagagattgttgggtcatatggtaactctttgtttaacctttcaaggaactgtctgactgttttccaaggcagctgcactattttacattcccacctgcaatgtaggaaggagggttacagtgtctcttataccctcactgatactcgttattacctatctttttaatcttagccatcctggtggatgtggagtggtaactcattatagctttgatttgcatttctctaataactaatctaatatcttgacatatgttctttcagatgctttttctgtgcacatatttacaggtaatacttttcttccccacactggaacatatagatctatgtcaatcagcttaattctgcaacattattcttaattggctgcgtagtatttctctgaatggaatggatgtaccataatttgaccactcaatcatttagatattgaggctgtttttatttttttttattttttcactacacagatatgtttttattttcattataaaaattataacaatgtaatgaactttcttgttgctaaactcttgaatgagttttaagtgcttagttatttcctggagatagattcctagaattgaaatttgctgattgtatgtagtattttacagccctctcccccagccctaagcaatgttgagtgttttaaaaacaaaactaaccttaaattgtttttatgataggcggtttaaagtatgctattttcttttatcagtggccactttcttttaggagcgtagactttaaaagttggatgaaaatagaatgtttacattttgtttatattttgaagatgtaaataaaccaaggcagtctctggatgataccctttgtacctaaaagctattgagaaaatgttttatttggatttgttaaatgactcatttgtggggtcctttagtttgcagtggtttcagatcaactttctaggagatgtggcacccatgagcaccctgaaatacctcgggataattctctggttttgagggtggcccgcctcctacagataagattctttgtatggtcggttgtgaggccatttaaaacttttgccttaagacttcataaatcagagttgatacattgattgtcccttttggaggctgcagttcttaaaacatgtggctgtttttcctaggaatatttaagtaccacttgataataaagtactaccttttgctgggattatctacctggaaaaaaaaagggaacaaaaaattaaaaataaaatgtaatatctgtggtgttttattttttgttttgttttgcttttcctgcaaatttattcttccaaaaaaaatgtccctttcaaaataatcaccctttggcgtgaatttacgggttattgaaatcagtcttaaaaaaatttccagttaaatttaacaacttatctaacccatttaataattcaactttaaaacaaaaacgaacctttgaaaacaaatatttactcttaagccagttatccttatacaagttaaaacattctccaattccttccagtctttgcttaataggacttttacatgattcacactacacttttgatcaaaattgttattacccagtttgatcacacaatttattgaggacacttggatttggttttcagctatttattaaaatgaaatccatcctaaagtgaacaggatttttaccatttaggggattcaaaagtatattctttgaagggaatttccaaagaattccagaaatattttgagccctagaagcatgtatgaatagatgtgtagcctcccaagataactggaatcagagtgcattagactgcttgatgggctctcggccatgtagtccaatgagtctcaattttttccccttccagctgcacataagaaatatggcgcacatccctcagtaacagtatgagcacatcagaacctaggagggtggtgtttggggcaccctctctcaggcattaccctcctctcccaagctgagaaaaattactaccctgctctgtcttccagagcagacagatgggaaaaggcaaccagcaagggctggtaacctgtccagggtcatgtgtgagtggcagaaccaaaccttaaacttgatcctcctacctccctttgaagagaagcccctgcagtgcttatgttctggtgcgtatgttgggacaaaccagtctggctaccctcagtcataccctgaggagctgaccaaactatgtggccatgagagaaggatctagagaaggtctaggccagtaggctttcttgtaagcttcaggaaaatacccagataatgttatttttcctccgttaagaatcatggccttctaccctttgttgcagttgtgcgaagatgccattttgagatgggaatgctgccttcacctgagagtctccatcaaggaaattggccattttcaactgtagagtcaaatccagcaatcatggagagagtagggattaaaagcctgctcggctgggcacagtggctcacgcctgtaattccagcacttcaggaagctgaggcgggcggatcataaggtcaggagttcaagaccagcctggccaacatggtgaaaccccatctctacaaaaatacaaaaattagccaggcatggtggcgggcacctgtaatcccagctactcatgaggctgaggcagaagaatcgcttgaacctgggaggcggaggttgcagtgagctgagatcctgccattgcactccagcctgggcaacagagactccgtctcaacaacaacaacaaaaaattgcctgctaagcctaattcacagtttaagctaatttctttgcttggagtctaataatatccaagcaggtgcatgttttcagtaacatctcgcctagtcatatgtctgaaagaacaaaactgaaagttctttccttagaggcctttaacccaagccgctcttctctagctcagtcacagccttcaccaagaagtcctgaaaagatagaactcttgcattaccgtgctggttctgggtgtttgcctttgcagaggcgccacctgccaagcagttctggcaccagggagcaggtctgtgatgacaggagagagacagtggctgtgactctggctcttaaaccacaatggagggattcaagttagcttaggtagctctcagaggagactaatgagggaaggaaggagcaaggggggaaggaaggtgcccctgggagtgtgtctcacttcccttgctggttcatccgagaaggcagggaccctggcttgctgatggttgcatcctctgtggcatttaacgtggcatgctggttatacccactgtagggggcactcagcaaatatttattgaattcttctttgagactcattaagaccaataaaggggctgtattatatcatcaagcaagtgggttgtggatgggggtgggaggtattgcttcagctatattttatattctttaatgggattgcaccagttgtgtgtctttctacagaactagaggagctttcaggatatttgcttgggtggacgtgacccatagtgtgtagtgttcttttggtgggctcttcttatcagtaatgagattaatttttccattgccaaactccatgaggtaaacagtttgtgattatttcatgtcagtttcatttttcactcagcatgatgtttcactgttaaaaaaatgaaccttggcccagagttgtcctctcatgtattaaacatgacttcctttgttagtagactaatttataattataattcaaaaccatcccattctccagtggattatttcccccctctctgtcagatgaaggaataattgtttgtctgggctgcaggagtgtctgtcatggaaaccgaatttttctgtacattctctgaacaaacagtgctgtcacatccctagaacctgacattgtcattgatctccagttgagtcagagaagtttgttgaccaaggtaaatcagatctctcttctcttaaagcaaatggcccatgactcctgaggggccactaggagtgagagaatcacctgtacagggggccacaactgtggctaggaatgtgttacttgaggcggtgcttcccagccatgactcagtcacctggggagctttttaaaaacgctgtgctggggccccatcctatgtgaatgaaattggaatctctgggagtgggggccggcatcttttcttttttaaaaaaaaaatgtttaaggccaggctcagtggcttacacctgtaatcccagcactttgggaggccaagacaagaggatcacttgaagtcaggagtttgagaccagactgggcaacaatgaaagaccccatctctaccaaataaaccagcaaaaaatgttttaaggcccaagtgactctgatgtgcagccaggatgaggccttcaagtaatttttgtaccttaatcctggaaagaacaaatgcatctccaaattcccagtcacgtcacagagcacgggaccagactagacacagcatttggctcattttacagagaggttaggattgatagagtccgctagttagtgttagaactagaaataaagttctaactttatttctagttctaggcgtggtggctcatgcctgtaatcccagcactttgggaggctgagacgggcggatcatctgaggtcaggagttggagatcagcctggccaacatggtgaaaccccgtctctactaaaaaaatgacaaaaattagccaggcgtggtggcgcgtgcctgtaatcccagctgcttgggaggctgaggcaggagaattgcttgaacccaggaggcagaggttgcagtgagccaagatcccaccactgcactccagcctggggaacaagagtgaaactcaatctcaaaaaaaaaaaaaaaaaaaaaaaaaaaaacctagaaaaaaaggaacctaatattacattttctctactgtactatatcattcaacttttaaagagcaggtaatttaatggattttttcctttgaatacaaactgttgaaattgcttttatcagctttaactaataggccttatattaaaacatatttagttactgaattgtaagatgtttaaatgtttatttaaagttacccgacttatgcttgtttatttatttatatatttgtttattgccttttccatatattaagaggcttaagaaatcaaaacaatgttgttttccaggctccttcacagtatcctgatgggtaaaatcatcttcatggttttaaaagaaccttccataacaaaaatgaaatagccattgcgagtgaggagaagggatttgtagaaggagtgagttagttaaagcacaagaagaagcttgtgaaccaacaggaactttcctatcagggtgggaacatatgttttggaagcaaatggtgggagggtgcaggctgtgacactcccttccccttttcatgtgagagctggctattagcctcattgcctgagtcaggcagagttccctcgaagggtttttatagcaggtgccgagctgacaagcccaactgtagaacacaggagaggaccagtcagttgtctcagctcccggacccatctcagttgtttctcagaggatctttattagctggtttagaaacaggaggacacttgctttcaagcatcacattgagtgggctggaccaaatccaaaactctgctggaaccaagttgacaaatgtcagtagaattgggagcccgctctttgaatacaaccttggaatggggcttggcacctggcctgaaagcgctgtgtggactccagcaccagggctgtttcctaatttaacttaatgcttaaaggaaatcccaagtggcagaccagttctgcactccttgagcagataggcatttagctgtttttaaatgtaaaatcattttagctgtttttaaatgtaatcatagggccagtatcttgtttctatatgtgtgtttgccccatatgatgaaattgtatgcattctttcagcaagtgagagtccggaggttctgtactagctagctgtgcaactttgggcaaatgagttatttccccctctgcttcctcatctgtaaaacaaagcaacggaaccagaaaatctctttggtgggcctgtttccaaatgtcttcccaaattaggatcaccatttaggtgaaagcgactagtcccccagccgcctctttttctggtgcagcctcatacggggaggtagaagatgggagggctgctttgctttgagcctcccagcttcctagctcttgaatgtagtgaatttcatctgttcatccatttatttatcaactttttgagtacatattttatgccaagcactgtttgagatgcttgggaaacatgaacaaaacaaagacccccgccctcatggaacttctacctagttggttgggatagacaacagcatggtaaatacattatatagaatgtgataaggtgataaaattctgcaggggttgcaggggagaaacatagagcagagcaagggagatggaggcctcgtaagttgccacacaccgtggtgtggtttcatcggctctcgctcacctgtcttgtatagggcctagggccttccctgaccactgtactctcgtagactagatcccttcctgcactccaaatagcaccacgtcacttagtgttggggtaatgtacaggttggtgctcctgtttgtttcttgtctaatcttctggaggactggtgttgatagtcctcaggtatgtctgaaaatcctgagcaaatatgagggactgagcgtgaacattgttgatttttctttactttctatttcttttttcttttctttttctttttctttctttttttttgagatagagtctcactgtgtcgcccacactggagtgcagtggcgtgattttggcttactgcaacctccgcctcccgggttcaagtgattttcgtgcttcagcctcccgagtagctgggattacagccatgtgccaatacgcccagctaatttttgtatttttagtagagacggggtttcgccatgttgcccaggtgagtctcaaactcctggcctcaagtgatccacctgctttggcctcccaaagtgctggggttacaggcatgagccactgcgcctggccacattgttgatttttttaaaaatttttattatttatttattttttgagatggaatctcactctgtcgttgaggctggagtgagggcagtggcatgatctctgctcactgcaagctccgcctcccgggttcacaccattctcctgcctcagcctcccaagtagctgggaatacaggcacacgccacaacacctggctttttttttttttttttgtatttttagtaaagacagggtttcaccgtgttagccaggatggtctcaatctccggaccttgtgatccgcccacctcggcctcccaaagtgctgggattacaggcatgagccaccgctcccggccacgttgttgatttttaaggataacatgataagacattaaatcctgtcagggaaacctcagaaaacccccacaactcagaggggtcagaaccagccattctttgatttttgtgatggctgtgcacccaaatacacaaatgggtgtgtttgtgtgtgtgtgtgtgtgtgttattttttttttacattaaataagattacattttttttccattgtaggagtatttgtaacatctcccgataaattgaaatgcggtaagaaagttctaagaacaaatttggggaatctctgacctttaaaggtactacctcattatgagcaatccagtgaccttattctagaattctgttagggttcgttttccacttgccatgagctggttttgcaaagaagaaaacggtttcctttatatgtggagattaagaacaagtttatctgtagttttggtgctcgactaactgggaaccaagccacagttgcttgtaaaacggaccctaagttatcttgatcttgatggttcagtgcttggaaatctctggggctttcggtgcctggtaaaagttcaatcacttatctgatttgtggttggcagaagaaaaggtatcaccctttcagtttaggagatggttgcttttagagtctatagtaggtaggtgtgcctgggaatcagccacctggtcccatgtaacattagttgattttcatggtatttcttttccccatcctgaaccttaaagtgagtcagattattactaatttctaatgttgcaatattttgagataagcggagacacttagatgttgcaagaccaggattggaaatgactatgttcaaaggcattaggacttctaaactctgtcaaattgttatgcggattttgggcatgttttgattggttggggctagaagaagctgcagcaaagcctgaggagagatgagggtctggtaagtcatggatcatcatgcttcagagctgcagccaccatccacctcaggcttcttactttcttggaaacccatgcctggaaaaatctaatgacttgcccagagctcaaaccagaccatgcatctgtgtgcccacctcatcttctgtcagcttcattcaccccaaaagcatctatatgttccagactcatgaggatacctgaggaactttggttttgtttttaaaccaaagagttttgagaggataaaataacaggttttgaagctatatggacacaggctagggcaaggagtgagaagacagctgagcagggtagggtgggaccagactcttggaactgctctgggcaggacctggatatgctgccaagtcagctttcgggaagttcggccatggaacttgccgtctttttttctgcattacacgactctcctgctagacggcaaaccccttgaagccaggagttttacaggccttggggcggcattgccttgtgtgtaacaggacccttctttctgcatatatgtaggataagagtccagcttaggggcagggttggagtaagtgaactagcacacaggagttgaaatagaagagtcagccaacaggaagaagtatgaggcagggagtgcctggaagagattggcaaatcctgaagtccttgccagcctacttgagtaatgtgagaccatgagccaatgacttaccttgtcctgtaagtttagtatccccaagatttctgcctcttgtaatgaaaatagtcctggcactgactgcaggtactgtggagatggggcgcctggaagattaaaaagacgggaaggtgcaggtttaactcctcaacccttcagagggagctttctgattccatgcatgatggctagtcagagaaatggctccccctcaaatgaggagtcttaggaagcaagaaaacctgccttggggtttgttctgaaggccacatttcatcacaaaaacagccatatttactacgctctcctacgaagttctgatgtgttctgctaatattcagctgtaaaccagctaggcaacatcagtcgaatgttagtataaattaaaacactggaggagactcaccgagagtgtgaacagattgtggttggtgtattacacgcctcaccttagggagagtgcttttttttcttccaggtggctttacaacgatgtgaacagcaaccttcctgttctttccttcagctgcatagataacaaataagacacgtaaaaaaaagattctgactcttgtggcccacgccattctgggacttctcccccaacctcaccgtgtcccatatcccctctgccttctctgtccagctacactggtccaccgggtcctcaaacacaacaaattctctgcagtctcagaattttgcataggctattccctctgcccaggaaattcttctttccttctccctttcctatagatcttaactcaaacatcatttttaacactgtgcttcccccaccatcacaagaccagatgctcttcttctgttatgctgtcgcagtttccagtatgtccctttcatggcacttactacaatttgtcattttatgtttgtgtcattattgattactggggtctcctattggactgtaagctccatgaaagcaggaaaccagatctcatttgttgtgattagatcctagtgtctcatacagttcttaatgaataatagtaactgacacttacatgatgcttactgtatattaggcccgttcaagagctttacttatgttgactcaacactccttgcaaaagcttttttttttttttttttagcatttaccttcttattacagtctttgaaagcccatggaattattctagggacacagaggactttgtggcatagatttaggtaaaggtcaccgggcacggtggttcacgccggtaatcccagcactttgggaggccgaggtgggtggatcacaaggtcaggagttcaagaccagcctggccaagatggtgaaacccccatctctactgaaaatacaaaaattagccgggcatggtggtgggcgcctgtaatcccagctactcgggaggctgaggcagagaattgcttgaacccaggaggtgaaggttgcagtgggccgagatcacgccactgcactccagcctgggcgacagagtgagactctgtctccaaaacaaaacaaaacaaaaaaattgcctggcggcatggtgactcgtgcctataatcccagctactccagaggctgaggcgggaaaattgctggaacctgggaggcagaggttgcagtgagccgggatcacgccactgcactccagcctgggtgacagagcgagactctgtctcaaaaaaaaaaaaagatttacgtaaagggcaaaatgctctggaaaaataaagtgttagataccagggagatttggccatagctggaaatgtttaactctgcgaatacttggagccactaattatgtatacttgttttattcataatttgtaatggtctaggatagcaaaagtaatgtgaatcatggttgaatttaataaaatgtttttaacctcatcctaaaatatccactgatccatctcattcaatggcaatatgcagtggttaagggaacataaaaacaaacatccacacagctgcacagttctcatgaaagtctatctcattattggtgggggtagcacatttaacagcttaaacatataggtcactgcatgatgccgcactggtaactagatagccagggaaccaactaaccagtaactgttaaaatatttaaaatacagcttttgtttagatcatcctttggatcaccttcttgggaaaaaagcctgctagtcacagtggaaatatattaaggcccgatcttctgatatccattcccagaggtttctttcagctagattaagcctccacctccagagcacacccaagtttgtgatctccagcattgatgatctcttgtctaccagagcagacagtgtgagcctcacaccaggcctcagagtctgtgtgtagcccactccaattagactagagttggtgacttttgcatttactggtttatgataaaggatacagatgaagagacgcatagggcaaggcatgcgggaaggggcatggagatctcatgcccttggggtatgccccacccatcaggaatctccatgtgttcagctgtgcagaagcttttcccaacaactttttaaagttaattagcattatccccattttatggatgagaaactgaaggcacagagaggtaagtgattgcctgaggtggtctggctccacaatctacctttttaacaaccacattatactgctcaggaactacactgaacttaacaagtatctattgaatcgtttagccgcagcatcataggtgagtttccaaatgatggaaatacaatcccataacttaaaatatagtaatgtttactgacaacctcctcagcagttatactctgcttccttcttcttcttctttttttttttttttgagacagagtctcggtctgtcgcccaagctggagtgcaatggtgcaatctcagctcactgcgctgtccacctcctgggttcaagtgattctcctgcctcacccactcgaggagctgggattacaagcatgtgccaccgtgtccggctaatttttgagtatttaatagagatggggttttaccacgttggctaggctggtcttgaactcctgacctcaagtgatctgcccaccttggcatcccaaagtgctgggattacaggcatgagccactgctcccggccactgcttccttcttgaacaccacgagccaaacatattttaactcttccttaattattcctgattgtctcctagcaccagttgttacattattgctgtctgcccatgagggtaagagatgaggagcaatggaggtaagagatgaggagcagtggattatcaggtttttgagtttggtttacttcctgatgatttctttggctgccaccaatttttttttaaattaaatagtctcccttaatatttgtataactcttacttttgaaattctcaatatttgttttgctttcttagtgtttagagagatgttgctattcttcagtttttaaaagaaaaaacaaatgtggaagcttagccaccttgccccacaatccagatgcccaggtccacttctgggacctagagaagatggcaataagattggatgacctggccgggcgcgatggctcatgcctgtaatcccagcactttgggaggctgaggtggatggatcacctaaagtcaggagtttgagaccagcctggctaacatggtgaaacctcgtttctactaaaaatacaaaaaattagctgggcatggtggcatgtgcctgtaatcccagctactcgggaggctgaggcaggagaatcgcttgaacccaggaggtggaggttgccgtgagccgagattgcgccattgcactccagcttagacaacaagagtcaaactctgtctcaaaaaaaaaaaaaaacattggatgacctccaggctaggcggaagcctgaccagggtagtgactttagaaagagagattcctgggaaaactgagaatgacagcagagaatatcctttataggatcattatagccattccacaatgtgtacatatatcagaacatcatgttgtataccataagtatatataaattttatatgtcaatgtaaaaaataaaaacaaacttttaaaaaatattttataatatggtcccttgtccattcctgcctgggacagccatttttcccttttcacgagggagttcttcctttgatgtctggaaaggcctcctctttgagcccataggtttgctatcttctggctggtaattctttcctgcttctgtttcctgccgaccacttgataagctggagaaagcaacgttgttcgctcttggccggttcctcatgctttgcccctttttctgagtcctgttttcgagcctcaactcggaaggtttggttgtgccagcacagtcttcccagcagtttcttgtgctttccaatctctattcaaacgtgtgaggctgcataaagatcgcttctcagagaagcctagataatagaaaacctatgctgaaattacagaaatctgatgtaatattgacatgaaaaagtcagtatcagaataggctttcttttgtgtgagcatcttattgctaccaagtgaagcagccatagcttactgtgtggggcccatcagtttatgcttggtcattaaaatgggccttacagttcaaaggagttgtcctgtgctgatcagtaatgcgcgtttccttggcactgacattaaaagaatgttggcttcatcaaaggaattggcagtggctacattatcatcgtcttcatcaaaggacattttttaaaaccattagaactgggctgttcaggagatctattatataacatggtgactatagttaataacaacatattatatacttgaaaatggctaagagagtagatttgaaatgttctcaccacaaaaaaatgataagtatgtaaggtaatggatatgttaattagcttgatgtagccattccacaatgtatacatacgtcagaacatcatgttgtacaccgtaagtatatataatttttatatgtcagtgtaaaaaataaaaacaaactttttttaaaaagactggtttgggtaagtgtgtattgtaggaatttttttatggtggttaaagctgagacctttgaccttttgttgtgttattcccattcccacccacttagatgtacagtgagatctcaggaattttcatgctgaacattttttaaagacccctccctgtataatttgcagtgccatttggtatattgggtttctatagagactctaaaaattacattttggtctcatccaaaagatccaaccctcatatcaaagtggagtgctgatcttcatctaccccagcaggattcaaagggggagcttcaggcctgaagtaatttaggctttggctctcagtgaaccgtgatttaaagtagtgaaattatagtgtggcatagtgggcaaaagggctagacggggaggcggagaccttggttccagtcctgtgtctatggttaactgtctgtggtgccctgggcaagtcacttcacctctctgagccttgatttcttttcctgtgaaatgagagggttgggtaaggtaatctcttcggtccttttcatctcaaaaattacacatcccagaagcagtaaacagtccctactggttgatctgcattgtgtggaaccgcatggacttaaaggattatccagctaattggagagaggaaggtggtatggtggcctgggccggtagagaagtgtgtgatcctcaaatcaacttcaaacaatgggggtcctggctggcagaagtcagtcaagccagatatctcaactcggggtgtatttcatagtacttcttttctagcctaaagtttggcaacatctggccagtgtaggtagcaattatgtcataaatacagttgtttgtaggtaattttaatttaactagagtatttttccactttctacttgactctcctgtctactcctctactgtcccctgcaagaaattcctaactaaatatgaagagcaaaattgacagtttcagattagttgctgttaccaggactgaaaaacttggtatgtaattaaatttttttcccttggggtttctacgtgaggacttcttttttttttctattttttttgagatggagtttccctcttgtcacccaggctggagtgcaatggtgcgatctcagctcactgcaacctctgcctcctgggttcaagtgattcttctgcctcagcctcccaagtaattgggattacaggtgcccgccaccacgcccagctaattttttgtgtttttagtagagacggggtttccccatgttgaccaggctggtcgcgaactcctgacctcaggtgatccacctgcgttggcctcccaaagtgctgggattacaggcatgagctactgcacccggccaggacttcttaatagtaggtttaactgcatatgagtagacatactcaaatggataaaatttgactttttgtaaggccaatggtgcacatacaaatttatagtctgtcaggcctgtattagtttagtttgtttaggatgtttctccattaaagtaaattagcctgatacgtttcttggttgttactagatatcagttgatgctgtttccctttagcaaagacaacaaaatagagtagtgacacctgcattctaaagctcagccactaaatgagcatgtaaccttgggtttcagttttcctaaagtgtgggatttggcttagctccccaggtatcctgagggaccttagggatttgataccaccctaagaaaaagggcttgttttcctaaccacgtcagggaaaacgatttcatgtagcaccattcatgtccagatatgtttcttcttccaatgatggcaatgtaagttgatggcagagcaaccatgaacataaacagaactgcaaatggttgaactcagacactcagcccaggccccaaaaccagtttggggggaactgtattcacctattatgaaattagcatacctttgcattcaggaatacagtggatttatgaggtacttttttttttttttaatcagatctattaaaggaggacagtagcctaaactgaagaagagtcctaactgtcttgggtggtggttaattacaccatacggcagacttgccacaaacactgaaagtttaactctctcagctgcttagtttggaaaccacacagtgctgttcagttaggccttggccttttctgcatcccagctagacacttgactcccatccaaagcaaatgtcatggttgcctttattgacttaatatcaggaaacataacagccgatagactggttagaaggaactgtatggttgatggattattgctgacctacacacaggtaaacgaagtataacagaatttggaatgatttactggtggactgaaatctttaaaacagtaagacttttgtttgtgtctatggctgatgttttaattcagttctgaatgttcttccacagacaggagactaaaagtagtgaaatatttgttactcactgttcaggtggctgtatagaaatctccatatttgggtataagtactttgctgcagtatgtgtaaatgagatgagggtcagggaacagggtttgatttgaataaaaatctgttttgtaggccagccgctcaagcctgtaatcccagcactttgagaggtgaggcgggaagattgcttgagcccaggagttcaacaccagcctgggcaacatagtaggaccccatctctacaaaaaatgaaataaaaagccaggcatagtggtgcatgcttgtagtcgcagctactcgggaggctgaggtgggagaatcgcttgagcccaggaggtcgaggctgcagtgagccatgatttgtgctgctgtactccagcctgggtgacagagcaagaccctgtctcaaagaaacaaaacaaaacaaattttttttgtatctgtcttaattaagtctttacttaacataacttcaaagatagtcctttgtgagcggagagttgagcccctcctgatcattgtgaggcttttactctgagggcttgctttaatcattgagagagttttatgtcatggacctttgcacttactgggcactgatttcagtgttctactgctttggtgaatttttgatgtctttttggccatgatcggacagtctcctactatgtgatgaaatggtattagaaagcggtactctgctggctgcctttataaagcagagaatcacaaatgcccaggctttgagtttatagtctgagacagataatattgctgcaagtagaagaattgtagacacagatgtccttgttttgaatatcctttagtgcctttcaagggtctgtgttatagaataccattttgaggtacttcttcctgttgttttgatgttactgcacaggttgagtgagagagagcttgtgtgtgtgtataagaaaccctgtaggactggtgtcctatgagagaaagagacagcgagcttgtgtgtgtgtgtgtgtgtgtgtgtgtgtgtgtgtgtgtgtgtgtgtgtaagaaaccctgtaggactggtgtcctgttatggcatgccagaaagtgtcttactggtatttcttaaaatcagctgatccatcctgtggctttcagccggttatagccagcagaataatccagtctatttgccattactcattattaacccctactttcttatccatctagacagcacccctcaccacatccacatgtgtggtggatcagccttatcttgctttttttgataggtgctttggcataggcacattcccctgtgtggcatgcccttcccacctccaagcatgattgccaaggttaataattataagctctaattccttagcacattctaatccacttgaaatcattattctacatttagcaacatgcacttttaattgttctcaagatttcatatgtcctaactgggcagtaaaacaaaatatcttggaaatctttcttatataatccttctctcacttgcataacttgtttcaagtcttacctttaatactgtaatatgtattcagtagccaactaaaaggaacccttaacgccaatttattgctttacctctgtgccaaccatccagtagatttgagtcctggcaaggaaccctgcactgcaaaaggcagcctggctgttgttggcaggttgcgggttccaggaactgaggtacacatggtattgtatgatattctattgtccttgctcaaattatgtaagtatttttagtttggaggaatggttttctttcttttttttttttttgagttggagttttgctcttgtcgcctaggctggactggagtgcaacggcaccatctcggctcactgcaacctccgcctcccaggttcaatcgattctcctgcctcagcttcccaagtagctgggattacaccatgcctggctaatttttgtatttttagtagagacagggtttcaccacgttggccaggctggtctcgaactcctgatctcaggtgatctgcccaccttggcctcccaaaatgctgggattacaggcgtgagccactgtgcccggctgttttcttaaccttaaataaataaaactaaagttgggattatgcaatataacagtaatccaatgaacacagaggactattagcaaaacaaacaaaaacacacacacacagagaaaaaaccagcctctgaacaaattctagacattggtgtgatattcctaaaacaaatttttattattagccagatgattatataaacttctggtctgttggagtggaggtgtgatgggaagaagattcatagaaaagatttttatttgaagtcttttttttattattattatttttaagcttatgcctgtaatctcagcaactcaggaggctgaggtggaaggattgcatgaggccaggagttcaagaccagactggtcaatgtagtgaaactcccgactctacaaaaaatttaaaaattggccaggctggtgtcacacacctgtagtcccagctacttggaagactgaggggagaggattgcttgagcctcaaggctgcagtgagctctgatcgctcaactgcactcccacctgggtgacaaagacctcatctcaggaaaaaagaagaaaaaagagagagggatgtacagttgggttggacttgatccatttacatgccacctgagaagtgtgtgactctcttgttcacaatcgtaggttttctgtgtgtgtgtgtgtgtacacgcctttttttttgcagggataagatgctccagttttgtaaatggagcagagattataaacctcgttaagtatagatcactggaaaactgtgggtatggaacacgtgtgcatgacactgtatcttgccattgacttagaggtgaaaagtctgtgccattttaatgatcttatttctgaccctttttttttgagatggagtctctctctgtcacccaggctggagtgcagtggtgcgatcttggctcactgcaaccccttcctcctggattcaagcgattctcctgactcagtctcctgggtggctgggattacaggtgtgcaccaccacgcctggctaatttttgtatttttagtagagacagggtttcactatgttgaccaggctgttctcgaactcctgacctcaggtgatccacctgcctgggcctcccaaagtgctgggattacaggcattagccaccacacctggccctgacccttgttatcaggtagtcaacctgggaatcagttcttgaaatgtatgtctgaaattgacaagctgcatttttttttttggcaaaagcaacatttctgaaacccctgataaggaacattcagctttcacacgttctgaatctcagaggagcttgcagggtcttccctgctgtacttaccattgcagggggcaacaaggcagtggtaagtggaaacaaaccaaaacttcagtgataaggctgctgaaatcaagccctgtgttttttgtttgtttatttgtttgttttattttgagacagagtctggctctgttgctcaggttagagtgcagtagcactgtcttggctcactgcaacctttgcttcccaggctcaagcaatcctccctccttggcttcctgagtagctgggactacatacataaaccacaacacctggcaaattaatttttttttttttgtcaagatggggtctccctatattgcacaggctggcctgaaactcctgggttcaagcaatcctcctgcctgggcctcccaaagtattggaattacaggcgtgagtcaccatgcccaggaagctgtggtttttttgctggttgttctctagccactgatgagcttgcctccctgcctgaccagtcagtcccaaatgcaagtttagaaactggtggttttttgttagaggccatttcatttgtttttgtgctgtttgaacacctgtctgcccctgtgtccataattctctttactgaaaactttttctaaatgaagttatttcagaaggcatttaagaaaatatttttttcttacctgaaatatatataagtagttaattaatggaagagccctaacaattagctgaattcacaatattagggaatgattaaattgttggtgatgtacctttcaatcatctctgcataagcagttgatagccacttctgtatctttgtagtaaatgcagagtgaatggtggattttatgaatggggaagctgctggattttgtgtaacattgcttttttttttttttttttgagatggagtcttactctgttgcccagcctggagtgcagtggcgtgatctcggctcactgcagcctccgcctcctgggttcaagcgattctcctgcctcagcctcccaagtagctgggattacaggtgactgccaccacatccagctaatttttgtgtttttagtagagacagggtttcaccatgttggccaggctggtcttgaattcctgacctcaagtgatccgcccacctcggcctcccaaaggtgctgggattacaggtgtgagtcaccacgtccagccgtaacattgctttatgatcagaacattgaacatcaggatccagtgctggtcttgtgttggctttcataggagggagacttgctgcagtccagctgagtagggctgcagtgaggacccttatactgctgaagcccactgagtgacacatgctggacagagtctgatgtctgtggggaccaattagctaatggatgtttagttttaggctagactagatgcctgccactacccttcccaccctccacagttactgttggttacttcctacaagtcaccatcaaagccaggagtatatattccactttttttttttaacctcccaactactagttttaaaactgaatcaaatttcaaatggttgttaacttgaaacagatctgcagactcgacattttctttccattttcaggctctctggaaaccagtgtgtgtgccgtagggtatgttgcttgtagagaaaagtgagcactgaggactgaaatggctgggcaaagacaaggcacaagttcatctttgtgaagcagcgtttttcagtgttcaggtacaaatagttctcagctgtgctcagtatcacacaaggcatctggaaacatgtttaattcatgttagctatagcaactacatttgaactcaggcatgttcatgcttttaaaaatgccagaggggaaaaagccagaaaatttgtcatttttgtttgccttatgagagaataacactgttccgagtggctcccaggagtttcgatttggtacagttgagagccttgagaagaacctgccagttgtaatagtttgtggcatttctgtagacattgtgattgacagaattctcagttgccaaattcagcttctctctaaactttgtatttttgagatttttccaagactaaattagtcatgtgattagtgttgttgttgtttttgtttttgagacagagtcttgctctgttgcctaggctggagtgcaatggtatgatcttagctcactgcaacctctgcctcccgggttcaagcaattctcctgcttcagcctcccaagtagctgggattgcaggtgtctgccaccaggcctggctgattttttagtatttttttttagtacagacggggtttcaccatgttgactaggctggtctcaaacttctgacctcaggtgatccacccacctcggcctcccaaagtgctgagattacaggcatgagccaccggtcccggccatgattagtgttttattttgatccataaaccaattgtagaatgttgctcttccagtggcttccaagatgctcagacaaggcaggtggcttttgtttccactagtgcttccactagtagcaaaggagcactgatatgttttggtgaatattaaccctttttaatattaatactgtgataagatatacttgggggcacttagttcattatggttgtactgtaggctttaataacagcaaactcttcttattcttggatgcatacattcttattgggagacccctgtgtttctaaactctggtcccttgtttggtggagattaatgatcaaaggtggttgacttgcctactatcctgaggtggaaagtgcttcatgtggaacttaggcacttgctgaagctccttcgaattcaagcttctctcctacctgctagcttgtccatctcctttctactttgtgaaaacttctactttgtgaaaaatttgctaatctacagattagcaaatcatattattggaagtttaaaaaatgagaaaagaagaaatattgctataattttgcagtattgttttccctttcttttttttttggagacagagcctcgctctatcccccaggctggcgtacagtggcgtgatctcagctcactgcaacctccacctcctgggttcaagtgatttcttctgcctcagcgtctctagtagctgggattacaggcacccaccaccacgcccggctaatttttgtatttttagtagagacgaggtttcgccatgttggccaggctggtctcgaacatctgacctcaagtgatctgcctgcctcggcctcccaaagtgctgggattacatgtagtcatgagtcaccacgcctggccctttttttccctttttctatctgcatttttcctcattgggtgtgtggtggggactgtttgggctgcaagtgacagaaacctaattctaacaggcttaagcaaagaggggaatttattgtaaggactggagggtctctgagcccaagggcaagaacttagctgggcctgaggagctgtggaagccagggtgggctctcccagtcctttcagtcatgtttcttctcaggctgctttctgtttctgtgtctttctcattcagctttttccatgtggcagaaaacacattcacagagctctctgaagttttatttccattttatttatttatttatttatttattgagacagagtctcactctgtcacccaggctagagtgcagtggtgtgaccttggctcagtgtaacctccctgcaaactctacctcccaggttcaagcaattctcctgcctcagccttctgaatagctgggaatacaggcacatgccaccatgcctggctaatttttgtgtgtttagtagagatgggttttcaccatgttggccaggctggtctcgaactcctgacctcaagtgatccgcctgccttggcctcccaaaatgttgggattacaggtgtgagccaccacgcctggccttatttccactttagccacccagagtttaactcactttcttgtgtggcctcccaagacctgttgtacagagtggttattcctgtggtaactttggggggtggaggagggctcagcagggatttccacttcttggccccaggtatgcataatttgccctttcatttattcatcctccaaactgtcacacctaacataatccagccatcccacaccaagctgcacacccattccccctcctcagtggcagacagccccaattcacttagcccctgtttactcatgaactcccagtggccttgtcatagggccacagttctccaggcccaggtacctgtggttcaggtggcttgtcaccatctggaccctctgggctgaaataattctaaccactcccaaacagtgacctttgcatccccggctagggcagataccacccttgaggcttatgttttcctggccgatttatactctgatattaatttcctagttccagaggtagaattaaaagcactcttcttcctcagacttcaggctttgcacagagtagactcggtaggtggcaacacagcttactgtcctttctcccattccagggagtgggcccaggccctggccctgggcaaagcgaagaggtgggatgtgcaaagttctagcagctgtttcactccctccgttggtgggtctccaccacagaaaaggaatacgggaccccagagtatttgtcctgccacctcaggctgccccagagagagcctgtggggccttccctttgaaggattaactaggcatcctggctcttaccgagagtagccgggccttctgggatcaggctcccatgcacaaataaccccaatccttttacatttaatgctccatacttctgtatttcaaaaatagcatttgtgccagaattcaaactgttgcagtataagcaagttgcattggcatttttttttttaattgaagacctggggaaaaagctatttgtaggatagtatgtgacaaaagaagagaaaatctcattacaagggtggggttgctgaagggacccctacctcaaaagggaaatcttatccaggaaaccttaccagctgtcacctgcatatgcgtccgtgtgtacatgtgcgcacacacctgctcccatggaaaccctgtggaatgagggtacaattcctagcaaagccagaagacaggcagacaaaaaaaaaaatctgtccagtataattgtaaccacagtggatatcaaatcttggattctatatttaattgataatgtatataagcatttttctatattgtagatttttccaagtgttattttaatgataattatttcactgaacatatgtctttatttatcttagccatttagatattattggaagtttggttctttccagtttttgtgtttataaatgggacgtcatgagtatcattgtgcacagaactttttccatttctggagttatttctttagagtatagaagtggaattacaggatcaaaaactaagagcacttttatattttccagaaagatgatactagtaattttcagtgctactagcaatggatgggaaatgtcacagcctttggttatttcttttaaaattttttttgttttgttttaagtttgttgagaaaaaaggtacattttaatttaaattttatttttattctaagtgaggaccagtttggggttatgctttttattcatttacttttataacatatctttactggaatcttagtgttttattttataaattctttgtataatgaaagctgtttttcctattttgctttaagcattttcccctaattctttgctttttaaaatttcatgaatgtgtgtatgcgtgggtattggcattcttttttatcataacgtcttatgagatgcccaggttttagagaatagaataggcccaagagaaggaagtcagaaagctgagcatactttgcccctctgtttcagtggaggttgcccatggattatttcagaattcttgtccttgtaatgttaggtcatgagcctgcctgtctgcaggcaggatcactgcttagagtgaggtgacctgggttctagtcctgactgagtgggaatttaggctctccaccttccatttcttcatctgtaaaatggagggttttagtaggataaccttgggagtggggggtctgtgattgtacatgcccaaggtgaagaatcatatcaacattaagagtcttctacatctcgttgcag

SEQ ID NO: 153 - DNA, 384 bp, Homo sapiens; identical to SEQ ID NO: 85
  source 1..384: mol_type = genomic DNA

SEQ ID NO: 154 - DNA, 2971 bp, Homo sapiens
  source 1..2971: mol_type = genomic DNA
gtgagtacctaatagagagatggataggatggcaccactctgctattgagaaggtgattcttcttcagagaggtgaaagagagcaggatacttgatgtttcaatgttttaaagaaaaataaaagataatttgagaagattaagatttatcacggattttcctggtctctaatggcaaaccagtagggggtgatgttggactgaacatgtacctttctttctctagaaatgaagctgtagctaagtgacaccaaaacagccactcaatttgataaaaacagctaaaatagtattttgggtaaagaaaaaaattggccgggcttgtgggtttgtgggagtcatgttgagaaaagaactacataagggactaatattttccatttttcaactagtttgtggagacgcactgaagccagctgcctcccagctggctgctgtttgctgttgcagtcccctttttgaaccagttaggaccccaggagttctggcttcatcaaatagcctctacaatttagctagcaataatccctcaatccaagtagcttggaattctgaaataatttattgcaacttccctgtatataaaacccttagcttctatcaaaacagacatactatcaaagataccatttcttctctgcttctttgaaaagaaaactgtacaaaccatatgccatttgtctgttgtttgtaagatgctggctcaactcttactcggttatttactaccactacagaatcacaatgtgccttttgcttatatcatggttgagcaaagcattttttatgctactataggaaaagcatagagaataacattaaattctatatgcagttttcatttttcatggattttgtaccaaaaaagggaagaaaccacttaagcccttagaagggcttaactctggcaagacgagttcttcccaagcttcagcactgtactcaaactagtccctgatgttatggtggactgtatcacagtgggtggtgccctgtctgaccccacttcccatcactcatgtgtagaaacaggcttacacaatgggtccagtcttagtcaatctagcctgtgctgccatgattaaggaggcagtatggaacttagaagctgttgtcagaataaattttctgacatctgggaaagtcttcaaactccttagatatggcagaggccatggaagtagtcatccaggaactgctgcattaatataactttgcatatgactttactcttgaagtgcaacccaagatgaagtgaaatttatcatggaactgcaatgcagatttggcacagtattctggactgatgtaagcttgtagaaggctgaagtcatattctggtctgaaccagggaaaactccacacatttcacattggaaatacaaagttgagaccagaaattgaattttgagatgtagacagcaccttgcccagtgatcagctagaacgaagaaaatggagtgaatcacccacagcaggtgtttattaagcactgactgtgcaaggaagttattgtgaagcatacaaagaagtatacgcgtgtgctctctgtgctaaaggagctggttaatgtgcttttctaaaagctaatgactatgacccaaatatgacattaagctccacaactgaatggagatctgtagagaggtagcctctcctcacattggatatgaaatcaggacatgtcacatatctattaataaaaaaattatttcatcaatatctcctttgtgctcagttgaaaccactgagattctggaatggaagtgactcgtgacccagtcctggagtgattctccctaccatacaagtggatggtggttggtatgagctatctctcttttaagctgtgtgttccctaccatcaagattactctactgaaaggctccctgaagaccagatgcttgtgggatgcacacataggactggctaggaatatactggctgggcatgtgtattttaggaataggtcaaccttttttgagtaagggctttggatgatcatgagttaatgaggaaggcacaaacaaacaacagtactgagctatcaagagaaagaaagtcactgtgagtatacacagcagaaactccttgcagttctctcccgccatgccttcctactcaggttgtaatcagctttttttttaaaaaaaatgattttctcaagcatgtgtgaaaactagccttggacttttatttaagactcaacctcaacaaggtctcacttcatagggtgacagtttttagaaatgtcaaggatcttacctgagtgaacaagtgattattcttaatcaaataattacccttaggttctaaataaaattttaacgtggcagttccctatgtaaatctcttatcccagattgagatcattggttagaaaatagtacattcatgtgtaaacacagctaggtgcccccacccaaacgtcagctataaatgtacagtcttcataaaatatttgttgaaagagttcttgggatatttctcattgatgttttatttttaagtgtagcaatgttgagagagagttgtaagaatgcatatggaaaagacatcattttgcctaagatatgtaaagcatgagagttcagccatagtagcagcctgtgaaagaagctgctgaagtcaagctttcttcaaatgacgtcacgtttcagctgagagcacagtagatgctggtttctccatctcaacctttgagttaaattaacacctttctattgcatggcctttcatttaagatagtgtctaggaggctgataggtgctacaactaatgccttatttcggcctggtgaagaaggccatcactccgtctcctcctcttgtgaaaccctaagtaaacctctctcaggacgttgctaatggtctagttcatttacaagtgaagacatttattacattgacattttctcattaattttgccagtgagaaaggagcccaaatcatgtctctccttcttttgcag

SEQ ID NO: 155 - DNA, 10954 bp, Homo sapiens
  source 1..10954: mol_type = genomic DNA
gtaagatattcaacagctgtctaatctactgctttcttggatttcaaaatgaggcaatgatttagtaattagtctttgggtaaaaatactggggcttttggcaagtctttccagtttggtgtctgtgtttgcttatggactcgtttggttgacattcttagcaattattttcctcagcaacaaatctacttatttataacttcactgatctttcaactccatgtatttactatgcatgtagaaaaaagttcttgagacccaaacatttaaatgtgtctgtcactccagaagatatatagataacaatagaagaaatgactccctgagtctattgtttgtaatgagatgtctagagacatgcgtgtgcatggcagggtttggggtacccttctcttcaaattctagttgttcttcctgtacttgttatcctctgatactgagactttaaaatttattcagttatttatttttcttcacctgttctgcctcttggagtaacaggttactttctgctgctgaaaatagaaatcctttttattccactgaggtttctgtgtttcaagctttaagaggccaccctgtaccacctgatctaagatactagaatttggcaaccagaacaaatcttgcatcagagagatgaactgtttcttctcagcaggaatgagttaagcagggggtaaaagggaaactagactgcctttctgttccttctaagtgaggccttctcagtgtggtttccttgttttgtttgaagatactcccaagagcagcaaacactctcaacttaacagtaactacaaagaaagtccaaaacaggacagaatgagtttttagattgtcaaccacattggatttttcaagtgaatactcttctccattagataaataattgacagggaccttactatggtttgaatgtgtccctctcaaaattcaggtgttgaaacttaatggccaattgatggtataaagagatggggcctttagaaggtgattaggccatgaaggctcctctctcatcaatggaattaaaacccttatagaagaggattcatgcagtgtttggctaatttgcccttctaccttctgctctgggaggacacagcattcctcccttctggagggtgcagcaacaaggcaccatctttgtagcagagagcagccctcactagacaaccaaacctgttggcaccttgatcttggacatcccatccttcagaactgtaaaaaataattttctgatctttataaattacccagtactaacagactaagacagaaattggtaccagagcagtgggttgttacaaaaaaatacctaaaactgtggaagtggctttggaactgggtaatggggagaggctggaacacttttgaagggaatgctggaaaaagtcttgattgctgtgagtggagtgctaagggaaattctggtgaggatttggaagaagagatgaactgtatggaaagcctgattcttcttggagattacttaagtggtcgtgaacagaatgaccacattggtaaaaatatgtacgttaaagacaattttgaggaagtcttagatggaaatgaggaatgaagttggaaaagaagcattctttttataaattggcaaataacttggctgaattatgtccatgttctaggaccctgtggaatgtagaattcgtgagcaatgaatgaggatttttggtggaagaaatctctaggcagcaaagcattcagggtgctgaatagcttaactgcttatagtaagatgcaaaaagtgagaaatgacttaaagacagaatgtatttaaaaaaaaaacaagggaatcggaacatacagagttgtaaaattctcagccttgccatgtgaagaatgaaaaagtatgtttaggagagaaaaccaagagtgtgacaaaaaaaaagtttgataaggagattggtatggatagaaggaagccagatgctattcatcaagatgacgggagaatgggagaatgaccccaaagacattttagggatcttcaaagctgtcatgtccattacaggcccagagtgccggggccttgagggtcaaactggtttcaaagtagaggcccaggacactgatgcggtccagggcacctgtgagatcccagggcttgttgcctggggctgactcaaatctctgcttcccatatttcagtgcagggctctttggccttcccagttgtgactcagctggtccaaggtgtggcttggcctactgctctggaagatgcaagccatacatctcggtagtatccacgcggtgccaactttgcaggctctcagagtgcaagaggtatggaggcatggatacatccatctagatttcaaaggatgtcttgtacagcttcaggacccaggcacagacttgccacaggggcagggccactgcagagagtccccattagaacaatacccagtggaattttggggtctgcgccaccgcaaagagtcctcactagggcaatactcagcagaactgtggagtcagggccaccacaaagatcctccactagtacaatgcttagtggggctttgggacatggccacccttgacaccccagacctgtaaagccaccagaatgcaatgccagtctgggagagctgcagtcatactggctccaacctgtgagagctgtggcatgggttgcacccagctaagccatgaaggtggaatccactggggccttgggggcccaacacccaccccagtgtgtctgggaattggaacatggagtcaaagattactctcaagacttaagacttaatgttgtttgttttgttggattttggaattactttggacctgttacctctttcttcttgcctacttctcatttttggaatagaaatgtttatcttgtgcatatcccaacattgtatttcggaagaacatgatttgtttgatttcacagattgatgtgatgatattaagatgtgaggacattaagaggtaattaggccacaagggcttctactttgtgaatgatattaaggctcttataaaagaggcttaatgcagccttcagctagcttgctattctgtattctgccatgcgaagacatagtgttcctcctcttgggagaggatgcagcaacaaggcatcatcttgaaagcagacaacagacctcaccagaccaccatacctgctggtaccttgatcttggacatcccagcctccagaactgtgagaaatatattcctctctttataaattacccagtcataggaattctgttatagcagcacaaatggactataggccttcaacaccaacattggcatggtgtatgtttgttcagtctatgtgagggctttgacttaaattagtagcaggaaacctctggatcttgccttggacttaattcaatcaaagaggagaactgcttcaaatgtaaacttgaggtattggggaattgtcagctctactctctcaaagacctaagatagggtaatcagatggcttttgaatgtcaaatggaatgagctgatggctttagaaatgtattgacacctctgggattctgaagtaaatctccataaccttggtttttatctgtaaaatgaagggttgaactaagttctcaatcttggttgcttactggaatctccttggagaaatttaagaaatacctgctcccaggccccaccctcagcaattctgattcagttggcatgaggtggggccaggtattggtatttttttaaagttctctgatatgtgcagcctgggttgagaattgctggtctaacagatctctaaggccttttctggctgaatatgctatcattctctgattctgtggaataatttatgtgttaaattgtggtatgttttacttggtggggctggaaggttatagtgtagaattgagaaggggaaaaaataaacatctgtatgtaactggcctttaagagtctgtcagatcttttcacattttggaaggaggcagagagctaagttagttcccagaatgactattggtcagtcagatcatgagtatttctaaatggtgtaggccaaatcgtgtaggccaaatggggactttatttttacaaaaggagggtgttatgagaataatacctacacggtgaagtcaatattaggctgatggcagggtgtgaaggaaggcagctgaggctagaaaactggcctgactaaagaggactgactaaagaggttaaagaggactcaaagagggaacataagccaatcgcattaacagatgaaacaaagaagtagtgtgtcttctgaaacagtactctattaggaatgttttaaagaagacccattgtctagtttctgtttaaaataaatcaaattttctttttttttttgctgttatttcattattgtttattttcttttttttcttcttttttctttttttattattattatactttaagttttagggtacatgtgcacaatgtgcaggttagttacatatgtatacatgtgccatgctggtgtgctgcacccattaacccgtcatttagtgttaggtatatctcctaatgctatccctccccactccccccaccccacaacagtccccagagtgtgatgttccccttcctgtgtccatgtgctctcattgttcaattgccatctatgagtgagaacatgcggtgtttggttttttgtccttgcgatagtttactgagaacgatgatttccaatttcatccatgtccctacaaaggacatgaactcatccttttttatggctgcatagtattccatggtgtgtatgtgccacattttcttaatccaatctatcattgttggacatttgggttggttccaagtctttgctattgtgaatagtgccgcaataaacatacgtgtacatgtgtctttatagcagcatgatttataatcctttgggtatatacccagtaatgggatggctgggtcaaatggtatttctagttctagatccctgaggaatcgccacactgacttccacaagggttgaactagtttacagtcccaccaacagtgtaaaagtgttcctatttctccacatcctctccagcacctgttgtttcctgactttttaatgattgccattctaactggtgtgagatgatatctcattgtggctttgatttgcatttctctgatggctagtgatgatgagcattttttcatgtgtcttttggctgcataaatgtcttcctttgagaagtgtctgttcatatcctttgcccactttttgatggggttgtttgtttttttcttgtaaatttgtttgagttcattgtagattctggatattagccctttgtcagatgctggcaaaccgaatccagcagcacatcaaaaagcttatccaccatgatcaagtgggtttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcatgctaaaaactctccataaattaggtattgatgggacgtatctcaaaatcataagagctatctatgacaaacccacagccaatatcatactgaatgggcaaaaactggaagcattggctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagacggcatgattgtatatctagaaaaccccattgtctcagcccaaaatctccttaagctgataagcaactttagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatggataggaagaatcaatatcgtgaaaatggccatactgcccaaggtaatttatagattcaatgccatccccatcaggctaccgatgactttcttcacagaattggaaaaaactactttaaagctcatatggaaccaaaaaagagcccgcattgccaagtcaatcctaagccaaaagaacaaagctggaggcatcacactacctgacttcaaactatcctacaaggctacagtaaccaaaacagcatggtactggtaccaaaacagacatatagatcaatggaacagaacagagccctcagaaataacgccacatatctacaactatctgatctttgacaaacctgagaaaaacaagcaatggggaaaggattccctatttaataaatggtgctgggaaaactgtctagccatatgtagaaagctgaaactggatcccttccttacaccttatacaaaaattaatttaagatggattaaagacttaaatgtcagacctaaaaccataaaaaccctagaagaaaacctaggctttaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctgcaaaatgggagaaaataaattaaattttcataagaattgtcattggaagacctggaatttccagataaggtgcccggagtagcagatatagcaaaagacaggtttaggacatgccatcacgttgtactacgctcacacaaattcacacttttattgtacacacagatgcataacctttggaattgtgtgggaaaatcagcccttatttcacagatagcctttgaaatgtgaaaggaaagccagatgagcggactgccaggcagaaagagctgtgaatggcagatgcagtggggacatgtcaggatctgctctaatagttacagtctgggtgagatggggtgtggtgggcagcagtgtaaccctgacacattcagagagaacccactgaattcatcttccctcttcattttctgactactctttcctctttgcttctccctgtgttttcctctttgtctcatctttctctctctccattcatctctctttctcagatcattttttctgtcttctcacattctatatcccttgtagctctctccctgccgcctcccttccgtcaaccatcttttctttcttatcacagaatcgcagatcatcagagctaaaaaatcatctagtaagtccagaaatcacctagtaagtcctaaagaatcatctagtaagtctagctttatcagtgaggaaactgaggctcaggcagattgagtggctgttctaaggccacccttgagtttgaagcagggccaggtctaggatctagtgctctttccccttattaatacaccgtggctttagttcaaaactgatggactttaaattacttctaaaaagtttagtgaatagagtttgatgtttcttgctcttaattaaaaagtgagtgatgagtgaagtattttatcattctctcttaaaagaaaaaaacaaaacaaatagtgcatgtgtggtgaagataaaacttgcccatttcctcccttttcctcattattcatgaagtagaactcacacagactcaataaaaatttgcttacaaagtttgtgagaattatttaaatcttaaaacaaacacacacaaatctcccaaaccaaagaaagcctaacgagaggaaagagcaacaaagtaggagatggaagaccttgggtcaatttgcggctcttttactacctagttttctgaccttgggacagtcacttaatctcttaagttttcagtttctttatcaaaatatgaagggattgtgttatggatacctatgaccctttccagctctcacagttgttgatttggcatgaaaaagctctgcttagctgctcgtggcacttaataagccagacagaaggctagcccatgtttgcaatagggctggctctaggaagaaggtatcaggtaccaggtttgaggcagagtcaggactgcgagtactgatgttcaggttgtgtactgcaaaagggaactacatctaagagggtaatattcacattgtaacatatgccaatttatgcgtgagtggtaccaaagtgggcacagagattctggcttcccagcctagttctggaatgaggtggtagaagagccttctcacatctacatctatactggcactcccagctatgcacatacatcatcactggtaaactcatgtgtagctgggtatgtactatcttgactatgttccagaagtttcttgaggttgcttttctctcctgcctaatattctcagagaaccaatttcgacttctcaccccctctcctaaagcctgactccaaaggtgacaaggaggcttcactgggcagatagaatttggtgatgtgcagagcatccatgctgctagtggaatgtgctccctggtgtctgggggatgtatccataaatgagagtatggtacttgtatgtatacagccagggtgtgctgcctaacatcacagggctgccacaggctgtatgatgatatactcacaaagttaagattttttaaatttgagagaaaataccctttctaactagcacaaaggtgccatagtggctagcagtgaccatgggctcagtaacatagctgcaaaggtgccgggaaggcttttttgttcaccagtctttcccacacataggctgattccataaattttcggttagagttttattctttcagcttaataggtagcctttgatcccgctaaaggacaaagttctctgaagggtaaaacttcaagcttgtgtcaggccctcctgacttctgtgaatgacttttcgatccctgactgagagcagattttgatgaaggaaacgtagtaagaggtaaatgaagagagtgtgagtgaggagagttccataaatacgaggaaaaggcaaaggctgggatggtgggtcacaaattttcacctgtattagagtcacgtggagggcttgttaaaacacagtttgctggacctcaccctactacgatttctgatttcgttaagtgttgggtggggcttgagaattggcctttctaaccggtttccaggtgatgctgatgcagctggtccagggaccacacttggagatttactggatcaaatgctttgaccattctgctgcaggcaggcactgatccggtactacccttctgaactctctgggcactgagcctggccagtgcagttttttttcttttttttttttttttccagctgctgaaggtctctgagggccatttcttagttaaaggactttgagctccttggctagtaaatgctaatacaaagtgctggcaggtaactcggaagcctgcagcttccattagcctttgcctctggcaggtttccagatgcagtgccatagctggatatattccttaataagagagtggttacactcttttttttttttttttccagacagagtctagctctgtcgctcaggctggagtgcagtggcgccatctccgctcactgcaagctccgcctcccaggttcacgccattctcctgcctcagcctcctgagtagctgagactacaggcgcccgccaccacgcccggctgatttttttgtatttttagtagagacgaggtttcaccatgttagccaggatggtctcgatctcctgacctcgcgatccgcccgcctcagcctcccaaagtgctaggattacaggcgtgagccaccgcgcccggcccggttacactcttatttttggaatttgactgcacagtgccctctgctttattatctctacttgatgacaagttggtgcagcccgaaatggaatctccaggctgtaggtaatggatgtgaaagcactttgaaaagtagagagcattgtgcaaatgtaaggcattattactattatggagaaaaaagaatctatattgatattttttttaaaacaatttgggttggacggaaactaaatagggctttatgactgatgaatccttgaggctatgcacgtagaaaaaggttatctatcaggcgctggtgttgaagtgaaaacaataaaatagttgttgtttttaacttgacagaagccttaaaatagcagttttttacttaataagtcagaaatagacttttggaagactctagattactcacattactatggtagtacattgagcactcaaataaaaaatatttaatctagattaaagacaattggattgtgactaaagcataagacagccccccctccatacacacacacgaatggcctgtcccacgagagaaaaatggatcaaggtaaatgcaggaaacatttgctgcactacatctcccaccctacatttccctctacagacgcctcaaggcagtgggaattgcaaccactaactatcaccattaatcgcagggaacctggtgctacatcatttagctatgaaaaagtgaaatgacctagcacttcctgcagttagttaagaaaggctttgcaaagagtggtatcattccgtttctggagtctacatacttgcaattgtttccctgtcttgagtaactgtaatttttaagtttaacttctgtgcatgacctcatttcagctcagaatgcagaatgtctgtgaggtggagggtgggagagaaggaaaatgtctatttggattgctggtataggtataaaccctttatgtggaagggacatttttctaaaactgctggcaactaagtttcatcactattcattctcctccttttctttctag

SEQ ID NO: 156 - DNA, 19069 bp, Homo sapiens
  source 1..19069: mol_type = genomic DNA
gtgagtcggacttgtcccgccctgttcctgggccctgagagtgcctgcctggggacagttcccccagggctccagagacgccctatgggcttttgtccagccctctgatcacaggcactccacttcctcctcgagctgcattaggttttcatccaaagataactactataggactacggttcaatcaggagattaatttatggaaaatactgtgccagcagaaatctaaggtgatccttctgaccgtgttcaagctagccagggtcctagtgagactgtgagcaagggctgagtagagaccagagaaaacactcaaaattggggagacataatacaagaactatgcaaagttacatacaagtttctggcacatagaatgtttggcgggcggatcacgaggtcaggagttcgagaccagcccggccaacatagtgaaaccccgtctctaccaaaaacacaaaaaattagccaggcgtggcggcgcgcgcctgtagtcccagctactcgggatgctgaggcaggagaatcggttgaacccatgaggtggaggttgtggtgagctgagatcgcgccactgcactccagcctgggcaacagagcaagactccctctcagaaaaacaacccccccccccaaacaaaacaaaacaaaacaaaaaaagtgtaaattgtgaaagaaatcatagaacataaggaagtgagtttccagcggccacttggaatgggatggtagatgtaattagccgggactgaaaagagggtattccaggcaggaagaagggcttgagcagaggcacaaagaattatgattgagttcaaagttcaggtctagtggatgtgatgagtgggggctggggattgaggagggatgagggtggggaaaatgtggggttgaagagtcaagagcgctttagacattggtttcacataaaatggaaggggctaacagttttcttttaggcagctatgtaatcagtactgaaaattgtatttgaggataattattccacagcacatttgtaagtcgagccaacaatgtaaaggaatacaattctgctgcatgggttcaaaatttagaagtttcttgataatctggaatctagctctttggttatattgtatagatgttatgggggtgggagccacatttacggttaagtcttgtagtaatattttatatgatgtttcaagtgtgtttaaattactttcacaaaagttatcatttgatatatagaattaaaagcatttaattatacagatgacccttagagagtgacatttgatttggggaaagaaacacaatctcagcatcagggtagtccttaactggtaaaatgcattaagctggagaggataagaggcctgctgttgagtgtggtagatcacattttcctctgaatccttcatgacaaataatagagtgccttacccaagattggcactcagaatatgttgattttggtttagaagagtttgagcctggtttatggaaaaaaaaatccgtctaactggtatatgtcaatcccagtgctgggcactctgaaggttacaagaaaagtcttaagacctaggcctaggctctatagttcaattgcgaaaatatgaaacagagggaggtacacagtgaattataagattctcaaaagctttataggttgtttcctactattgtatacatgagaataattcctttcctttttttttttttttttgagacggagtctcgctttatcactcagcctacactgaggctgagtgcagtgatacgatcttggctcactgcagcctccgcctcctgggttcaagcgattctcctgcctcagcctcccgagtaggtgggactacacgtgcttgccaccacgcccagctaatttttgtatttttagtagagatggggtttcaccatgttggccaggctggtctcaaactcctggcctcaagtgatccacccacctcagcctcccaaagtgctgagattacaggcatgagccaccgcgccatacctaattcctatacttctaaattaggccttcacctccattgctatagcaccatagtttaatcaagtagatagaaatggagagattgtaagataatggaatactataaattccctaacaaaagagatttagagccagataaattcaataagatgtttatttccatatattaccttcctgtaagttcattagctttattagttgagggttcttgtccattgagagaaaatgaaaactgggttgggtgaacattaccaaagacttaaaagtaacttctttctctattgctcttcccatggagtcttccctttggaatgtagtttcctgtggaggcttttaggtgactttgagctaaaatcctagttctgcagaaacaaggatgaagcaatagcatgggaaacaaatagaggtagagcaataccaacaaggctgaagccagaatacatttctttatgagtctgattttagtaaagaaggcaacatatgcaggttaaatcttaactaacagatttccatcctcttcctccaaacaacttatttgtaggctctgggccagtaggttttgtttgtttgtttgtttttgtttttttgagacagaatcttgcttagtcacctaggctggagttcagtggcacaatcttggctcactgcaacctctgcctcccggtctcaagcaattctcccacctcagcctcctgagtagctgggaccacaggagcatgccaccacacctggctaatttttgtattttctgtagatggggtttcgccatgttgcccaagctggtctccaattcctgagctcaagtgatccccctgctttggcctaccaaagtcctgggattacagggtggaatgagccacctgaccagcccagtgtttttcctaatgcaatacaacttctggtttttgtctgaacctgaaactaagaattcatactcccttttctgaaaaagaagtctggtattgaggttcagttctattttgaattcaccttcaagggttagtcccaccagttgctaaatggtctgtgaaggtgtttagtatttgccacctttctttgtcattgagaggtgtttctaccaattggagggtgtgtgttgcatgttgttgaacctgttaaatagacttattttaggaactagatacttgaatgaatctagttccctgtttgattattaagccacatcctgtttgcaaagcaaagatgtgattatttggaatttggaatggcacccatctaatgttgctccagacatttaataagcatggtgtggagcatggtgcttgatggagctgataaagtccaaatttttccaagtaaagtggctaagtctaattctgccattagactgcattttttttttttttttgagatggagtcttgctctgttgcccaggctggaatgcagtggtgtgattttgactcactgcaacctccacctcctgggttcaagtgattatcctgcctcagcctcccaagtagctgggaattcaggcacccaccaccatgcctggctaattttttattttttagtagagacggggtttagtagcgatggggtttcaccacgttggccagactggtctcgaactcctggcctcatgtgatctgcccacctcaagattacaggtgtgagccactgcacctggccatgactgcattcttctttgcttttcctgaaactggttgatagaagccatagtatatcatagatattataaggttcccatcctggtctgatgttcacctgcacatccctgtgagttgctgaggatgccattgtccttcaacagaataatcctgccccccttctccagcccttttattctggaatggaagtaagattattatataagagcctgtgtccttctgcagccattatcagtatttgatttgctcatcctcagatattaaagaagtgactaaattaataaatggcatagttcattataatctggatctcctaaaataccttctttggccatttcttctgtatctggaacgttgtagatatgtagtaattatttgtaaaatatattaacgttaaagagctactttgtgtaaacatttgtaagaaggctttatgggtttgggttttgttttcttttttttttttttttttttttcttttagagacagggtcttattttgtcacccagtctggagtgcagtggcacaaacacagcccactgcagcctcgacctccgaggctcaagctgtcctcccatctcagcctcttgagtagctgggactacaggtgcatagctaatttttgtagagatggagtaccaccatgttgccccagctggtctcgaacccctgggctcaaccactctgcctgcttcagccacccaaagtgttgggattacaggtctgagaagatcatcaaaaagatatgatttgcaggttttcattgaggattacctttcctttcaggttaccaatttggagtgtaagtgtgtgattccaggcaaaggataatcacactatgctgcttattgtgtgatcccaactcgtgctgctcttaactcagcatgcagtgagagatgcattgggattgcatctaggagggaaacagataaggtcaagcagctgggctggggagaaagaataaggccgattagttctctccactttaattgggctagcggctaactatactttaacctttcccacggcaaagacaaggcatattcctgccaaagatgattgccactaagtttattgttttaaaagcaaagaggaagaaaacaacacgggaagaaggttttgtagtagaattactttttctcatgaaggggtttctggagaacgagggatacataggagaaatacagtgatgaataaattgtctttagaaagaaggtgatggcagaagcacagtttttagttgaagggcaaaataagtgtcatatttcattttgaatcccagggcctagattagcttggcctgcagtcttccaccagcctctcttctcacagccctgtttttttcttttcttttctttctttttttttttaagaaacaggtctttctctgtcattcagactggagtgcagtggtgtgatcacggcttacagcaacctcgaactccaggactcaagcagtcttcccgcctcactgatgagtagctaggactacagacgcatgccaccgcacccagctaatttttttattttttgcattttgtagagatgggggtcttactgtgttgcccaggctggtcttgaacccctggcttcaagcgatcctcttgtctcggcctccccgagtgctgagattacaggtgtgagccaccatttattacctaaagcatgatacttttctagtatccctgtatagtactgagtccaagaagctaaacttgatcaaggtgtatgtgggtagcctgggcctggtttatgaaaaatttgagttttatttctgtgagctgtaggtgttcccctgctttggatattctgtttgaacacagtatacattggaggactcaggatgtggaacatgattcattcaggagtcagctgagaaagtgtttattaaccccttaactctgtgccttcagactaattgcctaatttccaagctgttgctgctacttccttttttttttttttttttttaactctgcctgccttccagacatttccgaggataacaagaaaatagttatgaatgttttttcagtctttaagggagggtataatagtgggaagaacttggtgattttaaaaataaaacaataaaaattaaaagtccaagccccagagatgcctttccttccatttccttctaccccagttccttacctccaaacaggagcgagaagcatagcattggaaggtttttgacaatggataccttgtcgttttgttgttgtttgtttttaaccgtctcatgctagggcatgttgtctgtttcttagcctgttcaaggcataagcctcaatccctttcctgttgttatatagagggaaaggagttttacagccttaccagtacttcttttaagaaataaagctgggcatggtgtctcatgcctatagtcccagctactccagaggctgaggtgggaggatggcttgagctcaggaggtggaggttgcagttagctgagatcgtgtcattgcactccagcctggacaacagagccagaccttgtctcaaacaaacaaacaaacaaacaaaaacctagaaacaaaaacaaaagaaagggatcactcttatgtttctgcagtttcctaaatttcttctactggtcctgaaaataagtgataaaatagagtcaatttgcatcatcctcaagaggttccatgacctttttggagccactgacaacaaagtcagctgaagaaaggaggttgggtctgtaggggtcagagaggtgtatgtgtgaagagttttctgtggtgtgagctgtctcaaggtttacatgtttacagtccattgtaatacagaaatggattatattttcttctgtattcctggctgtaatgaataaaacccattattgggtcaggaacttgagtcttctctcttcttgtcctttgttcctgtttcaagctgtggcatttgcttaagcttcctggccacacactcagccctgatccccagccaactgctgtatgctattgttgtgtccacatcttgaggctggttaggcttgggtgtggtgtagagctcctttctgtggaagcgtatactcaaaaatacaggacgtatgggtgtttgtcagctgtcattaagcagccttccccttcttttgtaaagctcttgggattgagggggtaagagagatgccttactaggtacactgttatgcatgaaaagtttaactacttactgtttgttcaaccttgtccttgttgtaactaggattccacattagtggctttgttgttttgcctggagctgcagtcctaggttgggggagattcagagttctaaggccatgtccctcttgtattttgaagtgtcagcctgttcatatacagaatggcatctcacagtagtgaagccttcagtctcctataagaggctcatgaaaaacccttcagggaagctgctcctagagtgtggctttgccataggagaccctgccccaggactcctctggccaaatgagagagtcgaggtttgctggggcaaaactgtcttattgggaaaagggaagtagaacacggaaggaaactagcatttattgtctggcacttgatgtatgttattgccctttaatcttcataaacagctctgtgaggtcagtgttatcccaatctttgagaatggagacatagaggctaagtaacatgcccagggttacacagcttgtagggatggagcagaaattccagtcatgcataaattttgcttttgtcactgtacagtcttgtaatatactcatacacgtctttgtcagtccagttagcaatttggaaaactactggcctctggcaggattaagctctaatcacatcttagtgttaattacttcaaataggtagtaacttctaacatctagttactcataagcactcaggttatgaatattttgatccctggcccattgttaccagattccagtagcatttcttccttcctcccatctattcttagtacaggtagtatttattaagtaactttaattgtcaatagtactaggtccaaggaatattaaattgaacttccccgtccttaaagaatttacagtttctggaagtggggatacagacagagtgtgatatttttctatgataactgaagcacaaggtactttgggagtgcagaagaggaacacctgacctaagtgtatggggggaaaaggagaaagtgcacattgaaaaggctttcctagagagctgttgaaggagatctaaaagtagaagttagtgggggtgaagatagtattccgcatagaaagaactgcgcgtggaaaaggcctacaggcgagaagccttcatgccatattcaaggaactcaaggtgtctagctgaagtacacaactctagggtggatcagcaagttctgaagctaaagaggtgatagatggaaaggtcatgaaatggcctaataagccctggtaaggaatggagctttatcctaaggtcaaagaaggccagtaaagtccagtcaacaggataagtgatgtgactaaactctagctacattggggcttgctgtagagtgggattagaggcaggaaacccagttaaaaggctgccaacagtggtctagataagagagagtagtggctgaagttgggttgatggctgtaaggacagagaaaactagaaagactgaagagagatttaggaggtggctgcttggaagtgggagttaggttggagggaaagggtgctgaggatgactcccagatttctgacttagcagtttgaatgttggctctcattcactcgtgctgccattaacaaagatagggaaaatagtaggagaggaagggaaggagtaaaaagagctaaattggtggtcgtggtggctcacacctgtaatcccagcactttgggaggctgaggcaggtggattacctgaggtcgagagttcgagaccagtctgaccaacatggagaaaccccatctctactgaaaatacaaaattagctgggcatagtggtgcattcctgtaatcccagctactctggaggctgaggcagcagaatcgcttgaatccaggaggtggaggttgcagtgagccgagagtgcgccactgcactccagcctgggcaacaggagtgaaactccatctcaaaaaacaaaacaaaaaaaaaacagtgaaattaagaggttgagaggtagagtgagaatcatgaaaagtaaatttgattttgacgtgttgactatgaggtatcaagcaaacagttagctatgtagtactagagcttgggagaatgagtttgaacacttccgaggagaagaaggtccaaaaggcaaccacaggagggtggttgaggaggaggaggaggatgttgttggatgactgctaagccagaacatgggttagttcttcctcttgggtgtgaaaatcatctaggataatagccagccttgaggtggagaggaatactgggcaacaggatccaaagtattaagtaaataaggttgggcatggtggctcacacctgtaatcccagcactttgggaggctgaggctgtgggatcacttgaggtcaggagttcgagaccagcttggctaatgtggtgaaaccccgtctaatttgtaaaaatagaaaaattagccaggtgtggtggtgcacacctgtaatcccagctacttaggaggctgaggtaggaggatcacttgagcctgggaggcggagattgcagtgagctgagatcgcgccactgcaccccagcctgggcaacagaggaggactccatctcaaaaaaaaaaaaaaattaagtgaataaagaagtgatcaggaagctacagagtgttgtaacaaggagagctgaagatttaacagctggatgacatgaaccacagaagaaaggtgttttattacttggtggtggtggaatggatgacccagaagcagccccatatctcaaccctatgatgtgggaagtggctgcctctcagagcatgttgtaggggaagtggtgtgtggtattcctggggagagccaggcttcagttagggaggaagtagaagaggctgagtaattaagtaactacacaacaagatctcagagggtttacaaggtgaatgatatgtagtacacaggtggtctggtggagaagaggaagcaacatgtataaaaatagaagtgcaggaccagaagtgagcaaagggggttatatattgggcaaagtgacaaaatatggtagagatatgacatggcggatttccctgacaataagattaccaagaaaatagattccagagacaagcaagcatgtgtatatatgtgggaatttaatatatgatcaaagaagtatttctgatcaaatgtgaaaagatgtattagtcaataaatacctaaggatgactggttatccaattgggaaaaaaataaatccttacctcatatcaaactcaaaagtaaattccagggagattaaagatctgaagataaaagaccattgaagtgttagacagaaatgaaggaaactattattataattttaggggtagaggaggcctttctaagtaagcaaataaagagaccgtaaaggaaaagagtcatagctttgactacataaaaattaaagcaaaagaaagcataaggttaaaaaataagggataaaatgaggcagatatttgcaacaagtcaataaaagaaaagtaactttaaaaagtaaaaagaatggctgggtgccgtggctcacgcctgtagtcccagcactttgggaggccaaggcgggtggatcatgaggtcaggagatctagaccatcctggctaacatggtgaaacatcgtctctactaaaaataataataataataaaaaattagccgggcacggtggcgtgcgcctgtggtcccagctactcaggaggctgaggcaggagaatggcatgaacctgggaggcggagcttgcggtgagccgagatcgcgccattgcactccagcctgggcgacagagcgagactccgtctcaaaaaaaagagtaaaaaaaatttggctagtaaatgcaaagaaatgcttgaggccaagagttcaagaccagcctgggcagcatagtgagaccctgtctctacaaaaaataaaaataaaaattagcctgacatgctggtgcacgcttgtagtcttagctgtttgggaggctgaggcaggaggatcacttgagcctaggaggttgaggctgcagtgagctatgattgtgccactgcactccagcctgggtgacagagcaagaccctgtctctaaaaaaaaaaaaaaaaaaaattaaattaaaacttaaaaagaaatacaaattgaaattgaaacaatgtatgtgtttttttaaatccagctggcaatggtgaaaaagaattgagatgttctagtgttggaaagatgtggagagatgggcccatatatgtggatttgggtgtaagtcagtacagtaacttggaagaggaatttggcagtatcaaaaccaaaacttttcttacctgtggcctagcatttccacctccaagaatttatcctacagatatctttcacaattgcttatatacatatatatgaatatttgtttactagagtgttgtttataatactaaaaacttagaaacattaccgaatgtctacaaacagaagagaagttaggtaagttaatgtatatctcatcattggaattatattcaacatttacaagaaggatgtaaatctatatatattgacattaacagatctacagctcattttggtaaggggaaaaatgttacaaactaatagtattaggatcccattttttttttctgtttttgttttttgttttggggtttttttgagacagtctcgctctgtcaccaaggctagagtgcagtggcgtggtcgcttggctcactgcagctgccacctcccaggttcaagtgattctcctgccgcagcctcccaagtagctgggtttacaggcgcctgctaccacgcccagctaatttttgtatttttagtagagacaaggtttcgccatgttgactggcgaaccttgaagtcgttcgctgggctcgaactcttgaactcaagtgatccacctgcctcagcctcccaaagtgctggggttgcaggtatgagccacctagcctgggcccatttttattttaaaaattaataaatttatgtatttacaaaaaaattggaaaattgtgcaaaatgttataactaaagttatcccttgagatctagaattttagggagatgttctctttccagtggggatagggttgggagggacagatcagttttaaaagtaggggaaaatagaaaatttttaactacagcttttcccaaaaaaagatgggtacaacttttacccaaaaaatatgggatgggaatgagaggaaggaagaacattcaggattcatctgtgggctggagagagtgatacttccaagtaggtattaatagtctgtggagggtgaagaatcttggaacttacaggaggaggtaccatgatctagactaaattcagcagcactaaggagaaggccccagctcagggcagtcggcttcacagactcccactttactgggataagaagtttgacaaggttggccttgacttctctcctagctacaccaattcacttcccaggcttggaataccttttctcctcttggtagcttggtgaacaccaattcagggttcaagatcccactcagaggtccccttcaacgtcaagccttccacctttcctggacgtggctattaaatctaccatagcccttatcacaatgtttgtaattattgtttgtgttcatctctcctgctagactgtgatctcctcaagggcagggaccagggtttgtttttctttttaactgccccagcacctagcacagttcctgatgcacattaaatgcacaatatatcttggttggaatgaagaaatgagtgggaaatgaatgatataatgggcttttattaggcagaatatgggggagatgaaacctggatatgatgtgtataaaggtgggagggggaagagaagaaagtgggcatgggaacaaactttggcaccagcctaggagggtaccaggggatatgggagcagagtagacattaaagagtgggaaggtggcaaagtctgggttgcctttcttagttttcaatccagaagcaaaatcagctaccactttataaccgaaaccaatgtgttttttttccatagtgctgggattctgtgaatcaaacacattgatacgatggaagtgttttgattcaggagggaacgggtggtagagggaaaggctattgtgcactgaggtaaagattgatagtttccaggttaccctaatagttattagtgaccctaatacagcaacgagttcttcctctcagagaagtggaaagacctaaatcttagaatttatggatccagaggtcttcagagcagtgtctgaaaaggcactttgtgtaagtctgggcgtcttcttagcatcgcccaccccagtctcaggatttcagaaatactaggtttggggatataaaagtaatctctacattaactacttgctatttatgcctgattatcacatagcacaatcataaaatatgcattttttgaattccaacatcattcattttttcagcaaacatgtactgaatgactgctgtgtgtcaggcactgggaatacaaagacactgagattggtccctcctgttgaggaactcacaacctaggtgaggagatagacaaataaacagcatatcttaagaaaagtgttttgaaaaatgtatgtatacattgctgcatgatcacataggagggtttcttaggaaagagggggggaataacagaaaagtttcctaaaaggaaaatagagctgtttcttaattaggggagatgtggcgggaaggcaaagtttgtttcaattggaggaagcaatatgtgcaaagaaaaatatggagaaaatatggcattttcagggttctgttaagagttcattgttcattgtgagagttcctgcacaggagcagaaaaagacaaggcattttcttatgattacccagtgaattctggactgtattctgaaagctatgggagccattggaagattttaagcggagactgtcatgctcttatcttcatattctaatatctctgaggatagtagattgacatgggtattcctggaggcaggggaagactgcctgggagattttttatagtcatccaggtgagaaattacaagaggctgaattaaggctttggcccagtggggctgggaaaatggcgatgtgttaagagattataaggattgtgtaattgtaagacttttaaaaagtatttttactgttgtaatctcagtgcttaacacaatgtttgagatatcagacagtctgtaaatgttattttgagttgatgaacttgtgatctactcagttagatggaaggtgtagaagaaggagatttctggtataggtgaatagatggggctgttatcaaagtgagagagaggatcagccaggaggaggaatgaagagttagattagttttatgtttaagattcaagtggcttttgagacatttgagtggaggtgtacaagtctagagctccagaagaagagttggcttggaaagatagatttgggagtcattggcctgctgtgggagtggatgacattgtctagggagagtgtaagcgaagggaaaaagagaagtttggaaccttggataccctgggtaacattagtacattgggattggtaaaggagaagttgaatgaagaagcatattcaaggagttagaaggaaaaccaagagagcaatgtcccctaagctaagggagtttagtttcaagaaggtcagagatgtctgatgctgtcaagaggtcccagaaggagtgagtggtttctattagctctctgacagctgggatttttgtctgttttgaccactgctgtatccccagcacttacaacaccctggcacatagtaagcattcagtaaattactgttgaatgaatgaatgaattgaaaagagtcccttgaatttggttacagaaccacaggactttggtgaagccattttgagagaagtggtggtgaaggaagccagattatagtggattgaggaatagataggttgtaaggaagcagctacaaaatactaagtatgaccaacatcatgagcacataggaggtaccaggcactgagctaagcactttacatgtattaactcatttaaccttcccagcagcccaattatataggtattatgatccctattttacagttgaggaaactgcagcttagagagggtaaataacttgcctagagaaggcctgcagctagaaagtgttagaaccaagatttgaatccagatctgtcttcctttggagttcaggtccttagctgcccaggctacatttcctctagggagtctttgtggcaggaaggcaaaagaaagagtaagtgaggccaggaagattgcaaacattttaatgctgatgagagttgaaagaaataatttgaaggctttgggaaaaggggaaataatttatacaagaggagactgagaagagctccagagcacaggtaaaaggaagccccttccatcaaggtggaggtccaggagagggtacaggcaggtgtgtgttgcagatatttttgtcagcgaggagaggggaagagggtagggatagttgaaagttctcttctgattgtctgctgagcataagggaggtggtgatcaagtagacttgaggaaggtgtagagaatagaatgaagcaatgatggagatagaagattttcagggtagcatcaagggcccagccaagatggagaccattattttgcagtggtccagtcctgctgttttgtgatttttctcccttccctccagtagggtacagtagccggggtcaggggcacagcaggcagatgttagattgatccagggttgaaagttttgcccattggttgtgacagaagaaaagagacagatcgttgggagtattggctagattgcgtttgaggtgatgaatcactacatgtaggccagcagggaaggaagcaagaatgagagaagactgagaacagaagggaaatggaggggtcatagtactggagtctggagaaggttcaacagtaggactttggtgatagagcgtccttgttattagaattccatgtccagaggtgacctgtctgtgatgaataaggcaaaattactctataaggtactacaggggtagaaaactaccagtgatgtttgtctctttactgaggggactaaggaagggtaccaaagatactttttttttttaatcgtaaatattttctactgtttggtagtactgtttgattttttttttaaccagtatgtactactcttttttttttttttttttttttttttgagacagtttcactctattgcccaggctggggtgcagtggtgcagtctctgctcactgtagcctccgtctcttgggttcaagtgattctcctgcctcagcctcctgagtagctgggattacagggcccaccaccatgaccagctaatttgtttgtatttttagtagagacagggtctcaccgtgttggccaggctggtcactaactcccgaccttaagtgatccgcctgcctcagcctcccaaagtgctgagatcatggacctgagccaccgcaccaggcctatacaactgttttgattttaaaaaaagatacaaagttttcagtgaacccaaagagaagagtaggtttacatgaaagcagggagatgagtgagctgcagaggtagcaggctgtggtcctggaatgggaccctggagtgtattatctgtctatggaatcacaaggtcttagatctgaagaggagtagctggaatctggtcccaccctgccattgtttacagggaaggaaatgggagccctgagacttgctcagcttggcagcagcaaaaccagaaccagaagcaacctgtcctgatttcccagccctctggtctgtttttcatgctacctcctaagccctggaggcttctcaatttcctgctgttccagccagactcatggcacatgtgctcatgacattgctggctgaccgggctgtttgccatactgtgcttcccacacgttggtgcttctcagtgttcagggtgtgggcgggtgtgtgtagaggcggctgtactactgtcccctgcctatttcctgccctcttcatagccaggcaaagtagcaacttggaggcggaaaaccacagtggtgataccctatttacatcctttacaatgacctagtgtccctcctgttttgccagctctcatgttgctgcctcccccaaacatccctctcataatttgtttaaacagcagccatgcccccgtatctacttctttcagcccaaacccagatgagtcactgagagaacttcggacagggattcttcaccatgagattgatggcagggagtggaagaattgtaattctggagaaacagcccttaaattaggggcattgttctgggaaaaaaagtgttttcctattcagcagatctgcaaaggagtctgtgactctccaaaagactacagatttagggagtacagtgcaggtgtcttttagaaaaataaattttttaaaaatcgaaagattaggtatttttctgtcttccaagtaatagttcagataaacctggtgtttgtgtggcctctcttattttgtcatgagggcagcgagccatggtagttgcatatggattagttgtgatttctccttatgtggcaggctgagccccagaggattagaactaaagctcaggacttcggctgtcttttggatggctgcctgggtagatatgcagatgaattctccacacaatgatattggggctccatgatgtgtggggttgggagtgggggcaagaagtcagaggatggggtatagtttttcctcacccttgctcctaggttaagtcctcattggtctccctgtagagtctcctgtggagatgggtttgtagcctgtctgcttggatggccctgcagattctgccttgagtgtggtctttgccttgaaggtctgcttgtccttttgtgttgtaacaatgtagttttagggttcaagtatggagctgtgaattgacctggcccagagttgcctcagattccctcctctttgcagaatgtaggcaggtattggtgtggggatccagggtatttactggtaagggaaagaatgtgttgttcatgatggtaggaaaggcccccttattggcttgcttcttggcagaccaaagagctgagatacagccatgtggtagtgctcaagaggtctgagcaggcttccgtgagatgatctgagcgcttggattccttctgcctggagatgggtaacatttgagattccagtttggttctgaattctctcattgccttctgccaggccatcctatccctgacattgtagtgccataagaagtcatggatgttgtgatgccagtgggatgaatatggctccaggaaagaatagaatagagaggggttcattaagttaaggcttggggctataacaccagagccaccctgaaaatcacagggaagaaccagcaggagggtgagaagagacagtgtattcatattttggctttggcattttttctgcatagacaagggtctgtaaagctatattagatactatgttggttcaaccctccactattagggtaaaatctaccttggatagagaacctgtttgggaagaggaaggaaggaagcaagatgggtgggtgaccctgatcttctctgaggtatcagttgcatcatctcaggcctcctctgcctgatccttctgtcatctgctccattagctcctaggcttttgcaaaactggaaacccttcatctggagccctcaagagcagtactacttaatatgccaatcttcaatgagataagaagcatatgtaccagaatgtaagactgatctcttcatcaagaaaatcttgtatgaaaaaatgttagaactagacagtgtgtttactctgacataattgatttacattcaggcttcatataagttttctatatagtgaccagccagtaacacagtttgcaaattggcagctaatctgcagaccatacttggagtagcagtgctctagagctgcctttcattcagaagcagttgttgaggtcatggagttgtttgtttggtacaggccaagggcagtcagaaatatagagccctggttaagaagagctgtcacccagagcattcagacatgggtcagggcagctactgaggagaagaggggcacaacgagagtgagacagctgaacagatgatcaggcactgcctatgccaagggtaaatgccatgtcctccctttcctttaccacaggcgtgtgagctgagggactagagctagggtcttggttttgcctgttgcttctaatggcag

SEQ ID NO: 157 - DNA, 683 bp, Homo sapiens
  source 1..683: mol_type = genomic DNA
gtaagggttttcgggggggaggtggagggttgggcctgagagcaggagttctcccttagagacccaatcccatctagccacctctggactagtacccttctttcaggcctgagagagagcaggccgtgcaacgagccttctgaagatttgtgtgcaatattcactctccacatgacttccgtctatatccctccagctgccctttggtatgtgggatagggattgttaaccttacttcccagagagataatgaggcctggagaacataggtgagttgctcaagacccagcacaagcatccatgattcctgtaataaggcttccctctgctgttttcactgcagccttaccaagtatggttgggtgtgcaaagtttacattttaaggacctctgctgctgccactgtcattgtggttaatgatggctttaaggtttattcttattcccatatctttgagagaggaagagagtgggattgctacccacattttaatgaaggtggagctgagccgtagaactctctgggagccatccaacctggctgtggctcataacaaggtattgatcacttcctttggcctgagtgagtccagggtgcctagacaagaggtagcagcctgtggatgtccagcacctttgcagggaatacagggcccaatctggcacatgccccttttcctcca

SEQ ID NO: 158 - DNA, 1927 bp, Homo sapiens; identical to SEQ ID NO: 93
  source 1..1927: mol_type = genomic DNA

SEQ ID NO: 159 - DNA, 3710 bp, Homo sapiens
  source 1..3710: mol_type = genomic DNA
gtaagttcttattattacctgtggtacctgcaaagttgtactccaaagactaaggagagaaccaagcatggtgactgatggcacctcatataaatgtgaaaaagtgacctttgtgctagaaacatatgagaatttttattgccttagatttccagagagaattttttgcattacttgtttatataaggtgtcattctgcttatctctgtaacaagaataaagaaaaataagaagatttctaaaagaaacatgcaatcatcattaccacattcacaggagaatgtaaaatactgggaatatcacttgacctgatatcacttgacagaattactctgtccttcagagtgtgtcagctggcttttttgataaaattgagtttttatccatagaaagtttcaattattagacttcttaatgcctcatgttaactaaaaatacatttctttttttctgcatagtctttaatctatttccttgcgtgtaatagtaaaagtgaaaaagtcatggagaaggctctgcatcttacaagtaaatagtcatacaaataaaatgcctactcttttcaatgtcaatgctatacatctgttgtagaacaagttgaatggaatgactaaactgttaagaagaagttttagtcttactcattaaatagttgacatctaagttccctacttcatagtttttctgtaagtgtctgaaagaagataccataaatctttcttgtgatgtaatgaaaaattttagaaacaacttaaaactttttaaaaggtatcacattccattattagattgatgcatttactttcagtgtggctatttatatcccagcttcaacagaatttgccagtccagcaagaatgtattcatagaaatgagatatttttggttatgtaaacacagactattttatggcataataactcagaaagtcagttcagattctgtcctgagtttgtttgcttgttgtgtgtaaggcgtttctggaggtaaatctaattaccaattaaaagcattttgttgcataaattttacttctataatattaaagatgtgatccatatttattggggtgaagggataagaaagcagagaatatgaagctcatcccatggtagatgagatgaacaagcacacatgagataacttcttcagagtttctattgccagtgctgttaacaaagtaccagaaatactttgttataaatataatatagcaagttatctgtgttatatgtttatacttatggttgttctagtttataaagagcaaatgtatattcagcatagaacaaaagactctaaaatctggataatttttttttcacttcctttttgttcctatgaaagatagatgagctttttcaacttctgcgagcaaaaaccaaagtaaatctgggagtcaaaaaccaagttaaagtctaagaaactgtcaggtatcttgttcatgattttctaagtctgactagactttataccatctgatatccttgttagtatgggttctccaacttcaaatctgtatactgataattattttggaaacaagctttcctagattaggtaaaacactctcaaattaaattaaccagcatagatttaatttgtttgtatataactaaattactacttgaacatgtatagctccttctatagctccctgctcaatgtgcagtttactcataatttttagattggtctccagctgctcctgcctcagggtggcattgaggctacacattaaattttccacctacttccaatcttctaagctttatctatgctgtaagtttttaaacttttttacattaattattactctgagaaattaattaaagagatacaactgaaggaaagaagccaactgactttttgagaggaaatgtttttaaagcatctggagtactttaatagaattaaggaattcatgtcttcaggtttaattttacaattaaattcctctaggattccgtccatatactttcttctaagttaaaatgttgggcagttccttttcaccaaattcatgaatgcttcacatgaaaaatcaacaagacattatactttttttcttgttgtttttgagacaaagtctcactccgtcgcccaggctggagtgtagtggcgcatcttggctcactgcaacctctgcctcttgggttcaaacatttctcatgcctcagcctcccgagtagctggaattacaagcacacactaccatgcccagctaatgtttgtatttttagtagagacggggtttcaccatgttggccaggctggtctcaaattcctgacctcaagtgatccgcctgcctcggcctcccaaagtgctgggtttacaggcgtgagccactgcactcagcctgacttagtttattgaaatcaccagacctccaaagacatcttgttgcccttccctgcagtggttgaactcgtcactaaaatgagaattctctgcatatcacctgaaaaaaaaatagcctaagtaaatgagtaatttgacaaagttgaggatttttgtttagattttctacatgctgaaattactttcataagtgtccataaataaaatatgaattgcattttaaagctagttcactaatagatttttaaaaaatactacttgtgtttttgtagatagaacaatctgtgtccagtattgtaatgttttgtatatgaaatggagattattgtttctggatgaacttggtcagagggcttaagtgaaggttttggtaaatagtcataactaaaagatattctcaagtgaaaagtatataatttcaaagcataatatgtatttaagttcaaacattgacatgttaatgtaaagtcctaaaatgcagattgtccatctcacataaaataactcccattgtaaataaaaatcagagacatctcttgtcatctgaattactacttaatctgtattgatgaatattcacatatcttactgacttttgtgatctgaaacttcgtaacattgaagtacctacacgattattagcccgaagacctgcgaggcacatttctgctgcctaaaaccctatttcctcataagtttcctttcttttgtcaactctgcttaattcctctctctctctctgtacagtttgactcttcagtgtatcttcggatataactgatctattatatctttaaagaaacacatgggtaagggggagataaaagaaacctgtttttacatagggacaacttggttctagattccaagataaacagggacttgctcactccaacttttgtggacttgccaactttctggttcgaacttcaatatgtttctaaatttctgtttttcctcaaagagctttcaaagtagatattctagtttaaaatgagagtcattgcttttatgtagttttcttgttctttgttcctttcttgcctgcttctgtcctttcttaagaatagcatttttaccacctttagtctactcttggttttcagaatacttttatttaattttctatgaagatctgtatttttctgagaaatattttggttcaaaagaaaacacaatattgttaaaggctataatttagtagctaacataatattgacaaagaaaatgcttttccctagtgggaaaatatcccataaaggacagtaagactataaattatgccttttttcatataatatgtgtagtcaaaattatttcctgatgtttttttaaactatttttacag

SEQ ID NO: 160 - DNA, 11841 bp, Homo sapiens
  source 1..11841: mol_type = genomic DNA
gtataccaatctttatccattgtcaaatactaacctttgttcagatatcaattattgctttttgttatcatcactttggattctttggatttgaaattaggattcttcatgactcattgaggtctcacaagcttctggagcataaaatgaagaggggatggttatagtcaacaaaatgtcgtatcaacaaggggtgagttgtaaagcatttatagatcacactagggctcagggtggctgtaagccaggaaccagatttccagaatttagtcaactctgccttccctctctacagttacctagttcttcatttcatacacagaggaggaaggcaagtgtcaatgactggggaaaaaaatctggtagcctttggaggtccaggagtgtggcaggggtaaggaccccccaggcaatggttgcgccaggggacggcatctcctccatgtgcttacatgtggcacacacagctgggaagggggtacagtctgggtggagttgcagccatttctggaagcagcaggtaaagtctgagttcagaatgatgtctcctttcaggaaaagttctgggcctttaaaacatatggaaatgtttaacctcatagtctggttctacttaacacaattagatcacataaattaaatgaaagcttctccatgaaactaccgttcaatttaaaagaaattagtaggggtcttctgggcctttttttttttttttttcggcctttacaataatggtggaattggctcactaggcaagaaatatgcagagtgtttaaagtagatagaaaaatttatatctgaccaggaggagataattatgcacattcccccatatgattaaaaacgtataatttttcatcttcttaggtaataaaaattactcttacaggtatatgttattctcgtaaagagtgtattgtataaagcaatttcaactgtgctcaaactttcactggcacttaggtttaatgacaggaaaccaaaagcatttttgccagcacaataaagggattgtctttctccaaatgactaggaggtcctaaaaccttgctcataatgcctaatatatacttgtcaggatacactctggccataatgtttgtacatttgataagaaaatgaattccatacccctattcacaaaatattttattctctatactctctgagttcagacaaacattctttaggttgaaaaacctaaatatttttgacagtttattcaagaaataattagaaacagaaaaagtgggcttttatgatataaatggaactgctacaaatacaagatgtagacattgaactgttttacaatgtctgtgcaaacgaactaagtcttttttatgtgccattttaccaaaagcttaactaaaaaaaaagattatggcctcccttccctggaagcattctccctgtcctaaatgccttgtctaaatatctttttatgcccttaggagaataaaggcatgtacttttaacacatttcacattaaacaatggtctagatcttctgattaatctgtgctcgaaaactcctgagactgaggtattcactgatgttaggggagatgtactttaaaaaaaaaaaacgaagagaaaaatatttttcttcacttaaataagcaaagtagtatgtagtattcattccactataaagtaatatttttaaaatccagattcttcttccttaattttggcaatagatgaattataataggaaacataaaactgttgctgtaaattcatatattcctcctctcactggctgaccttgtcattttggattctcaagtaaaaacctttatatcaagatatactatatactaaaagtatttttagtaattcagagaatttaatttaaagcacacatttagaggtgaaaaactgaaaacatgtaataaaatattaatgataatacatgaaacatttatctatcatttaaaaagcaaggtataacagccttagaagtgctaaggactcagcatttttaaaaacctgttcctttcaggacctaccacacttttgcacataagtaaactaagtactacttcataaacattcttttttcctctatacaacacaaaacaagacttcctaataccttatttagtgatgctccgtgagtcaaagttctcattttacaacaccagaaaaggtaaaaattcaaacagaggtctgtctgacttcaagccaagtgtctgatatattaatggccctagttcaggaagaaaaagtaaaactatgttcaatatctgtataagacaaaacgtgatgtatttcagagagatatctagtagaacactttttaaaatttgttactcattcaggtgaaccaattttgatgtaattttatttatgtagaactccttaatgcccaagaatgttggataaagccttacacactaataactggacttctgcttctagaaaggtaagcattgccttagtttaccttctgtacactatggcaatgcctgacatttttagaaagtctaaagcagaaaggcagagactaggtccaaatctgtttattatagtaaaacttttctcattccgccttgctaatgtgcaatgtgggatcattttccatagtgtttatctttgtagcgtctaggaagaaaaaaattgccaaacaattttcctacattatcactttaaactttcttagcttctcagctttcatactatttctatgtccaccaaagaatccaagattctgtcagatcccaccagataaaaatctacgttaacacaagttttagaatagatttattacccctgactccaccctacaacatatcatttattattttcagttacaggctttgttctcagcaagccactccaaattctttatggaagcaggcaaaatagaaaataaagataattaattgacaggatagaagattactatttcaaaacaagctgggtgcctctcctatttttaggttgcgtgaatggtctctggtctaaggaagtcaatgctgtgtgatcagagcactgataattgccaagggctgagacctccccattgtcaatacattaatattttagcagacactgttggtcataatagtaactgacttggtcagcttatgatcttagaaaggcctttttggtctttggtgggatagtaaatgtagcagattattgatatgcattagtcatgttctgtagtttctgagatgatttcctaaaaggtatggtttttagacatcgaatactgtataaacacagtctgcagagaactagaaaaaaagcagggtgtagcataaagaggcatgggttttgggcactctgatgtgagcctaatcttagctctgccagttacctaagtggtcatagtaggtatattaatctcctagaagctgcaggctactcacccctttcaagtgagaatattaatttctattcaaagagatgccttaagaattcagtgaaatactgtagattattatctagcacatcaaagaggttcagtaaacattaacctcctatcctctgccctttatgttagacagtcttattaatttagattccaccattatggaattgtggtaatttgaccttagttattgtttacctctgcattgtccatgtataaaggatttattaaccaggttgagagtaaaggattataaggattacagtcaatgaatgaaatagttcataactatgtttacagcacatgtacaaattggcatatctgattataagctagtgttagctgttaatttcaagcaggagttccacttgaaagcgttttaaagcactcagtttgttgagtgaacttgaaagttcctctttcctcaatgtttctaaaaaaaaacaactcagactttcttcctctaccttcccacataactctctttcacacgtaaaacaatattaattagtggagatttttaacagcctgtgaaaagttgggatgaattgcctgtatgtattactttcctaagattgaagctatgtgacagcattggaggacattatgtgccttgtattataccactcaggaagtgctatctccttcctaatgtgttttttcccttggttaacaatttgtaataaagtacattctgggccgggcgcggtggctcacgcctgtaatcccagcactttgggaggccgaggcgggcagatcacgaggtcaggagatccagaccatcctggctgacacggtgaaaccccgtctctactaaaaaatacaaaagaattagccgggggtggtggcgggtgcctgtagtcccagctactgcggaggctgaggcaggaaaatgccgtgaacccgggaggtggagctcgcagttagccgagatcgcgccactgcactccagcctgggcgacagagcgaggctctgtctcaaataaaaaaaataaaataaataaaaaaaattgaagtacactctgggagatagttatacttgttctaaataactggtgcaagtttctttctgaaccatgaaccctttactgttcgtggctcagtgaccaggaataagacctcagtgctgtgctccagtgcatagccagaaccagacagattcacttccagatcttggcgtaatgttagggaattcttgggaagaaaatggctacctctgacattacacctctatgccttaatttgcaaacatttttaagcctatgcaacaatggaggaaatggttatctttatgtacctatttcaataactatttaaatttaaagaaaatgctcttgttttctaaaatatattttataattgtcatctgtcatctttaattttatgttaactagcttaaaagggttgcctctcaagcagtaataatcaaaaactaaaatttttatttttttctgcatagatcatttttactttttgagcatcctcccattggtcttcatatatcattgctcttacatttaatgtatattctgacccaagccaaatttaagaaataatttattactagactggcaccaaaaggtttcttttcaaagaaatgactgttcttggacagatacagagacacctgattaccaaaaaaaggtctacatctctgttctacactacctggttaaatgaagacattattttcaaagcataagtgggtagggtgttccctcttcaaaactgctctttgacttttttccatacagttatttctggcaagtagagataaaaacagctctctgaatagtcgttcaaaaccaacaaaacttatctttattaaaactcataaccaaatctattggggggcaatacattttctgtatgtcagttcagcatcacacacacatgtgttttgacagcatggagcataaccagagacaacttaccttgcattctgggggtgtgtaacttaagaagttgagccccaggaactaactttgggaggtgcgtcctcctgtgatgttcagacattttactttgaagaatgttctttctgtgtttatcagtgttagctgtttgtattctttggtactataattctctgttgagaatgttcttggtgtattcactttgccttatacattttcttaaccgctgttggaaatgaatccttttctctctaccatagcatccacaatacttgggttgcattttggttggtggtgtgacagaggcaatcaatgccctgtcagcaccagaatctccttgaaagggagcaaaatagtttttcaaaagtaataagaaagataaaatccaggccaataaagtcaattcctgatcagaatttgaaagataataaaaatgaagaactagcaaagaccaaaaatgtgaatataaagaaaaaaactaagctgagtaaaagaactgtaaactttactatagtgaactgtgaaatattgtgaacttttttcctgagccagattaaagaggactaggaggcctatcttcattcgcataggtaactgagcccaacacagactacatgagcttgttcatataatttcagataggaagcaggaaatagattctcaggtctgaggcaactacttgcttctgttacatgaacttttaaacattgtttccttagaaattacaagtttatctgaaacatttaattctatctatgtgttgtggattgatatgcaaattgtagtcacatttagaatggatttacccccgtcctgtaatgtacttccccagtgcttaaaaacactgctatccaaagtgaagaagaaaggaagcaccgaaaaaggcctcagataatgccactaaattgtgataaagagaatttggttagttcatttgaaaaaaattgggattcatttaaaggaatgattagtactctgccatgagaactattgtactattgttggaaaacaattaggttcatcctgtcacaggtgaatcaactttttactctaaattatttatcatttaatattaattcccagtctttaaaaaatattgaaatattgcacttaagttagcagaaattttttcagtttgaagatgttattttaaaaacatatatattatttttaatatttactatttaataaatgtttgataatgaacctaataaatgcctcatatttgctttctacttcagagctatatttcccagacttcagctaaagctgcatattacatatattattatttacttaaattttttctttaaatttatcacttaattgattcattcaataaatatttattaggcacaaatgtactaggcactattcaagccactttttagatttaaacaacttaagttttatcctaggatattgtatatgtaaaatcataatattacttgtatttttctaatgtaaacttatatgaataatataactattaaaaatatgcaaaggaggccaggcacagtggctcacacctatgatcccagtgctttgggagtctggggtcagaggatcacttgaggccaggagttcaagactagcatgggcaacataatgaaaccctatctctacaaaaaattgttaaaaattagcgagcatgatgctgtgcacctgtggtcccagctacttgggaggctaaggtaggatgatcacttgagcccatgaggtcaaggctgcagtgagcatgccaggcatggtggtgcacccctataattctagctacttggaagactgaggtgggaggatcacttgagttctggaattcaaggttacaatgagctatgatcacaccactgcactccagcctgggtgacagagtggagaccttgtctctaaaaaaaaaaaaaaaaactaaaaaagaatatttaaaggtttgtccatgttttacctaaataattttacataccaccagtggccctttgactgctttggtgttcataaagcaccttcatgttcgtggtcattttagatcctttcagtgacccacaaagatgtgcagaattatccccattttacagatgggagaactgaagctcagagaagtggcatcccaaagaatacaaatcacaggtagttaagccaggtcgcaaccctggtcttctattctatatgtagcactccttacattatgccattccccaacaacaggactttgtagaaatggaatggggaagtaaagactgaaaaggtgagcttgaggtcaactctgttataagatcgatgatgtggctagtgctccattattctttgacgtttgcacaacagctctgcttcagcaataaggagcaccaaagaattcacacagagaggtgttatcaagattaaagcctgcagaaaattttaacatcatctccggttaaccagctctatttaaaagtgatctaggatcattgatccaggttcttcgtttttgtttgtttggtttttgttttgtttttgagatggagtctctcggctcactgcaacctccagcctcccatgttcaaacaattctcctgcctcagcctcctgagtagctgggattacagatgcctgccaccatgcccagctattttttgtatttttagtaaagacagagttttaccatgttggccaggctggtctggaactcctgacctcatgatccacccgcctcgacctcccaaagtgctgggattacaggcgtgagccaccatccccagtcagatccaggttcttcaaatatgtattatacctctctttcgagggttggtttggctctctgaaaggttatgtcttcttttgtcagactttaagtttcttctgagatacatgaggtcccactgtgctgacaccaaatcaaaaacttagttaaattatcaaatgtgtaatatgggccttctgaacaaaataagcaaataagcaaccagagattcagccttgttcagaaaaactcttaatcatctaccacatagtaatgtctggctttatgaatatgtttctatccgcactgaacaaactataaaactatttatgttgaagaattattatatccaaacaatttgaatgaaagaagagtttttaatagtcaaaaagtattggtagggcacggtggctcatgcctttaatcctagcacttttggaggctacggcaagcagatcgcttgagcccaggagtttgagatcagcttgggcaatataatgagaaccctgtttctacaaaaaaataaaaaataaaaaaattagctgggcattgtggcacacagctgtggtcccagctactaaggagactgaggtgggaagattacttgaagcccaggaggtcgaggctgcagtgagccaaggtcacgccactgcattctagcctggccaacagagcaagaccctgttaaaaaaaattaacatttaacatatgtgtatatttatacatgaataagtaaactatgaatacatataaattccaggtagctttatgattcttaaatgacatgagtaaagagttacaccatgatggccagtactattagcatcattgctatcagcatgaaactgtgtgggtagatgatgagtaaagataaatgataaagccctctcctaaattctcactaagatagagttaaataattcatgaaactcctggcttgtgatcgtacaagaatacaagattataattatagataaaagtattatcttaaattagttgctcctttagtgtaagttttataaaaatatttgtgtgtgtttaacctttttaatgttacatttatgtatttgatttcctggtcctttttaaaatttacaagttagctaagtaatttacaagggagtgttcattaaacatgatttctatttaactagaaattgaatttattttgttgttctctgataccattttgggcgggggtatctttaaagtttcttgaatatttttcaaatgtatgaatatttccccagaaaaaacacacactcttcatatatatttcacaacacagtaaagtgctaaaatcctgaaacaaactaaactttcttctgaatatgtatgatcttgttatagcagaaatgcacagtgatatatatcttacttacatttagtttcaggactatatttgctttctttttcgaggtcatttaatcctttataaataatatagttcattataagagtatgttagaggcttagaggcagatttaaatgaagaaaccatggcagagtattagttcagaaaaaatatccctggaaaattattcaagcataaaaaaattgaatataaatttgggcaagttgtcatctaaattttgtagaaatataattttaaatagtttgacctaaatttttgagtgtgcctgtgtgtgtgtattttatatatgtgtgtgtaattttatatatataaatgctatatatatataaaatgactacatttcaatgtatattggagttggtatggtggagagaagttgagcactttggagtcagacctgagtttcagttctggtcacgttatttaaatgcaccgagtcccatctgtaataacataaaagtaatactagtttgcagtagtatcatattaaatgataaaacagtgccttttacataataaatgcacaagaaatgtttttactgtcccttagtccataattaattaaaaataaaaattgaagacttaaaaaaatagttcgacctaactttgttttttaaattaagaccaatggggtaagttttaattgctgtgtcttgctttgtttcactgtgactctgattctgtgacctgatcaaccccttctgaggtccctcgctacaccagtttaagtctaatagaagtttatgttatatagcacagctcctttcctgctgccaagaagcttatttaaatataagtggaatcatttattgattacaaaaatgaaatatgcaaagcatctttcatatccccttcatgtgagtgaatacaagatggaggctcatttctaacatgaaatatgaaagtgcttccaggcatctttttttttaaacaacacatggatacatttagctcactttagcttttccagtggtcccagtaacccaataggacacttttctttatgtgaagtgttattggaacaaagttgtctcttgtgctggcacacagtgagttgggtatgtatgagcttgtgtgtataagacatttgtttgggcaaaatacaaaaacatgaaaaggaaaacaaacatttccatatttgactgtttttctcattgaatattagaaatgcttgttttcagacttaataatgaaaacttcttgttaatcataactgtgttctagatttgaaggggtcatagagaagttatttctaaaggacattcatgagtcaatgttggggacacaaagacaaaagttgataatcatttccttgcttattagtgtttattttcttacccatgaggcattttgtttaactctgtatttttatgtaacagtggattggaggggagtagcaggggttggaggagaaatgggagtaaagtggctggcttttgccccaactgaatagctgagttacttgccttgaaactatgcttacataccaaacaacactatttttacttagattgtgtgtgtgtgtgtttacagaataaaaatagccatgtttttctaaaagtgcttttattcccaagtcacatacaagttttcctaattattgtttttattgtggggaggtggcttcaagaaccatgatagagattctcaggagtgtgcagcaaaggttgcaccctccacacacacacatatccccccaccacacttggtggctgacctctgttgacatagctgaccacacacagactggcagtgataaagcaagacaagacaaaggacacacccacaaggcatagcaacaccctcttctcacgttttatggcctctgcagagccaaatgtgtactaggtcatgatcattactgtatgctaggataagtgttcaacaagacttgtcacattttaattttcacagcagttctagcaggaaggtaggtattattgtcctcattttacagaggagactgaggctcagaaaatgtgttttactcctactaggaagtgaaaagtaggattcaaactttgatctgttggcccaaggcccacccacttcactaactacctctcttgtcttcccctgatacttatatcacagtagtctgatactacagatttgcagttgctaagaaagtgaaccaggatctctgatttttatgattttgtgaattgaaggttgtttaaattccagattttattcccaaaatattattttcaaaatgttgacaattttaaagccaaacagcttttcacttccactgatgctgcagcctggagccacagaatcaacctctaatgattgagtgaggacagaagatttgacaaggtagtgaaggttaaggctcccctccccgccagtgcagcacctgcttgtacggcaggaaagtaaaaaccgtgtttaacaattacaggtctgggtaatgtggtttggtcttcataccttcactcag

SEQ ID NO: 161 - DNA, 7550 bp, Homo sapiens; identical to SEQ ID NO: 94
  source 1..7550: mol_type = genomic DNA

SEQ ID NO: 162 - DNA, 4581 bp, Homo sapiens
  source 1..4581: mol_type = genomic DNA
gtactaaaaactgttggggggaatttcaaaagtatttactagtcacttacatttagaaaatgtagtaaaatgatgacagacattgagcaaattaatacatctcctggtaactggtatgtagccactgacttggcaaatgcctttctctccattcctgcccataaggcccaccagaagcaatttgccttcagctggcaaggccagcaatatacctttactgtcctactgcaggggtttattaactctctggctttgtcataatcttattcggagagaccttgatcacttttcacttctgcaagatatcacactggtccattaattgatgacattatactgattaaatccagtgagcaagaagtagcaaacatactggacttattggtgagacagttgcatgccagaggatgggaaataaatctgactaaaattcagggaccttctccctcagtaaggggtccagtggtgtgggacctgttgagatattccttctaaggataatcttagaaggataaattaatgaatttgtctcctactaaaaccaagaaagaggaacaatgcctagtgggcctatttggatttttggaagcaacacattcctcatttggaatgtgttactctgtgttactctggcctatttatcgagtgacccaaaagactgccagttttgagtggggtccagaataggagaaggctctgcaacaggtccaggctgctgtgcaagctactctgccacttgggccatatgacccagcagatccaatggtgcttgaggtgtcagtggcagatagcaatgatgtttggagcctttggcaggcccccataggtgagtcacagcagaggcctctaagattttggaggaagggcctgccatcttctgcagataactactctccttttgagagacagctcttggcctgttactggactttggtggaaactgaatgtttgactatgggtcatcaagtcaccatgcgaccagaactgcctatcatgaactgggtgctttctgacccatctaactataaagtgggtcttgcacagcagcattccatcatcaaatggaagtggtatatatgtggtccagcttgagcaggtcctgaaggcacaagtaagttacatgagaaagtagctcaaatgcccatggtctccactcctgccaccctgccttctctccctcagcctttatatatatatatgtaagggggagtttattaagtgttaactcacatgatcacaaggtcccacaataggtcttctgcaggctgaggagcaaggagagccagtccgagttcccaaactgaagtatttggagtccaatgttcaagggcaggaagcatccaccacgggagaaagatgtaggcttggaggttagatcagtctctctattcacatttttttgcctgcttatattctagccacgcctggcagctgattagatggtgcccacccagattaagggtgggtctagccctttcctagcccactgattcaaatgttaatctcctttgacaacaccctcacagacacactcagggtcaatactttgtatccttcaaccaagttgacatggagtattaaccataacacatatagtccaattaattatgatagaaataaaaataaaatataattaatctttcagacttttaaaagtgtcagttcagaactaaaactgattatgcctctggaactatgaagattactttcaaagatcttattgtactctttattgagatttgactaatattttgtgggaaagatagcccacatgggattggtgaaaagtgttttgaaaaagaaatcaaatagcaatataaactcaattcataagtaaggttattttcgtttatttttgttgtctttttttaactctctactaatatgttacttagtcacagaatattagacttagacaggaaaatagtttgcaggagataaattacactgacattttccatagaatgataatacaaaaaaatttgactagaaagtacattgtaataattttatatgaaaagccttctctactacatatgtattgatcatctaccagatgctaggctctgagttgagtaggatacaattttgtcctcgaggttacaatctcctaacaaagagagatttacttacttgtaattacatcgtatgaaatttactatgtaaattattactatttcgtacatagtatgaaaattactataactaaattactataactttatactatactataactatagtataaaattactataactaaaatatggacaaagagggcacctcacttgttacaagaaacccagaaacttatatttgttgatccttaaaacttatgtttgtttcagaagcacagtgccattcactttctagtaaaatcactctctgaagtggatggaggagagctgcaactagattcaagcagtacggtgaagaaaaacaatgagaaacaacgaagaccttaactagggcaatgtcagggtctcaagagaaaccaaatctcagctaggattttgaagaaaatttaatggagggactacttacagatatgtaggcaggattgctagaaccactaaggaataatgaggcctccaggaattaaatttttaagaatttcaaaagccagttgtttttcatggtgtgaaatggtgtctcatttgtttaagttccttgtagattctagagagtagaccttttactattgcctaaaaccaaaagtgataagtactaaaaacttatcactccctatatttatatattttattatctgctttttaggttatttccatctattttttctatatggtagtgatactgtataattgtgtggctattgtgtgtctttttttctgctttgcatttagtaatgtcatgttaatagggtgaaattggctatggttggaatattcacaacataaaaatcagcaaacactaaaaattagggattgagttattgttttcagaaaatttgatgaaaaatgtaaataatcagaacaaagttctctgagggaaataatgtaacgatgaatattaaatttaaaagtttctgatatctgtaggcattacattaggaagaccccccaacatttgaggaaacattcttttagtattcaaaaaaatattattttttgtttgtttttttaacttttattttaagttcaggggtacatgtgtagatttgttatataggtaaacttgtgttgttaagcctagtacccattagttgtttttctgacctccctcctcctgctcctctaccctctgataggccccagtgtgtgttgtttccctctttgccttgtttgtgtccatgtgttctcataatttagctcccaattataagaaagaacatgtggtatttggttttctgttcctgtattagtttgctaagggtaatggcttccagcttcatccatgttcctgcaaaggacacgatctcattctttttttctggctgcatagtattctttagtgtgtgtgtatcacattttctttatccagtctatcactgatgggcatttaggttgattccatgtctttgctgtggtgaatagtgctacaatgaacatacatgtgaatgtgtatttttttttttttttttgaaacagagtctcgctctttcatccatgctggagtgcagtggtatgatcttggctcactacaacctccacctcctgggttcaagtgagtcttctgcctcagccatatgagtatctggtactacaggcacgtgccaccatacctggccaatttttgtatttttagtagagatgggtttcaccatgttggccaggctggtctcgaactcatgacctcaagtgatccacccgcctctgcctcccaaagtgctagaattacaggcatgaaccaccacgcccagctgcaagcatgtttttataatagaaagatttctgttcatttgggtatatgtacggtaatgggattgctgggttgggaggtatttctgttttgaggtctgtgcggaatcaccacactgtcgtctacaatggttgaactaatttacactctcaccaacactgtataaacgttccattttctccacaaccttgctagcatctgttattttttgactttttaataatagccattctgactggtgtgaaatggtgtctcattggggtttttatttgcatttctctaacaatcagtgatttggagctttttaaaaatacgattgttggccacatgtatgtcttttttggaaagtgtctgttcatgtcttttgcctgctttttaatgtttttttgtaaatttgtttaagttttttatagatgcaggtattagacctttgtcagattcacagtttgcaaaagttttctcccattctgtaggttatctgtttactgtgttgatagtatccttttcagtgcagatgctttttagtttaattatatctcatttgtcaatttttgcttttgttgtaattgcttttggcatcttcatcatgaagtctttgcccattagtatgttctgaatggtattgcctagattgtcttccagggtttttatagtcattatctagtaataaacaatgatttatctttactttctgactgttta

SEQ ID NO: 163 - DNA, 1306 bp, Homo sapiens
  source 1..1306: mol_type = genomic DNA
gtcagtgccgccccgtcctaccctgctcacccgggagagggtgggcaccatgtctctcgggggccccttctggggaggaagcaagagtggggggctctaatatccgtcaaacaccgacttcgcatgaggctcccgcagcccctgctctcgctgcgtagtggcgtctgtcgcacggtgggttctgctgcgctctggttccagctctgtcccgggtctggctcgcgcccgctgtcacggccacgcagcccccgccgcctggtggctcctgctcacgctcgcttccgaagctccgtggcttctctctcgcgcggcttctcctcactccggcgggtgactccggctttgctgaggctcctcctggttcctgacgacgctggtttgtgttgcttctcggctcgtgctgcctcgtgctcccctctgctctggctcctaggccacggctcttgccggagtcctcctgtccctgctccctgttcctcctgccctctggctgcccaagcgcccttggctcctgtttgcagtggctggcactgccctgtagctccctctgctcctggctccttcctcctggtggctcaggccgcttcctggctcctgcggccacatagcccctcctcatccaggttcccactcactgtggcctttgagaccgcatgtccttgggcgccggcccctgccatcccatggcctgtgctgacttgggcctgcagccccactgcttctgccaaccagtggcccctgcctgctctgggcacttctagagactcaaaagtccctgcggagggagcaaagaggagtggtatacactgcgtggggactcatgcctgcaatcccagtactttgggagggtgaggcaggaggattgcttgagcccaggaatttgagtccagcctgggcagcatagtgagacccccatctctgtaaataataacaataataataagctgggcatggtggcacacagctgtagtcccagctatgtgggaggctgaggtgggaggattgcttgagcccaggagtttgaggctgtggtgagccatgattgcatcactgcactgcagcctgggcaacagagcaagaccctgtctctaaaaaattaaaaaaaaaaaatagagacagagtggtggtctcataggtgctaaacgcccactccacccccgacccttcccaccacacttgtgagtaaaggcccccacccacttgacagtgaggatatggcatgtcctgggattgccaccgatgaatccaggatgagtctgactgcacagcccacctttgaccttgaccccactcattgtccctgcag

SEQ ID NO: 164 - DNA, 3541 bp, Homo sapiens
  source 1..3541: mol_type = genomic DNA
gtatttgtgttatttaattttttttttactatatttaaaatgaaattattgttttatattctaaaatggataatgtagatcactgtcagaaatctcacagtgaagttcaagagcagaccctgcattgttgatatttgtatgtaaaatatcataatgtaggcctagtaattgaacatacagaaatgcttgtaattatctgaatgtgttcattcttggttcttaacatatctgattgcctctcctaatgttcttgcttctgcatactgtctggttgaccttcaaaccttctctttcccatgtgttttctgtttccttcctcattcagcggttttgttttagctggagtagtccagctcgggatggctagagaggactagttgagttgagagaggaaagcaggcacagccaggggcttcaggtaaatgatcgccttcatggactcctatttataaagtggctgccatgttaaaaagagcccatctgaagttaatgattcagtttgtaattcattttcaatgtgtttctctcacaatggcattttgggtgtgcatattacactaaaatttgattaaagcttttaataacttctgttaaagataagcacttaggtgtggcaaactcttcaaactgcttatttaacatggaagaatatttcatttgttttattaattttggatcaggaatttattcttcaaggtctgacatggaatggcacagggtttgtcttagaacactactaattggttctagttattgaggagtgtagaaaaaaaatgttaaaatttgtgaagttatgagtttaatgaatgacaaactatagtatgtagaacaaaaaatgtatacgagagaattaatttcttatatatttctacagagtattattgttatatttataataaaactctacatttgcctttcactatatgtactttaaatatttaaaataatgtaattaggaaaaagatttaagtgtctgaatgttatggtactgataatataagcctccccaaatttattttggattgaaatgggctctaaataactaaattgataaaatatttataagagctagtttttttttaagcttaaacataaatatagggaaaaacctcataatacatttttaggtaactgaataaaaagccttgaattttgttataagttatattcattattatgagtttctgattcagtgaacaatcttttttttatttgagtattcttctatttctgaatcgacatttgatagcagattggtttaaaaatagtatatttgcctatatgaaatggatgtcattcactattttcctactctaatattattgtagtattgctgataagagcatacttgaaattttagaaaatataaataaagacattcttacagtttttctttggattacataatcttttatgttgagccttgaaacttcttataattgcttatatttaatacaatgtatttttttacattaagccactgaaagtgatagctgaatgatactaataataaaatatttcacgtttttctctgagataccttgaaatgaaataggaatagattcctagttttaaatatagtagaatagctcattaaattaaaattgaagtatataaggcaataaacacaaaacaggctatcatttacagcaatacttcagttatccagcatccctggaaaccagaaattttctattggaaagtgcctttttcaggttattgaaacataaaccctttactgttagtgttttagaaaaagtcatcctttttgatggaaacataattctattataagaatatttgtatgttttcaaataaaaatacaaataaagcatgagttgcctgaggctttttactcttaagccttatggtccttggctgttctttgatagttgactttcttccctcttttctcagctgctaagagtttattttgatgcttctgttcttttgactttatctccattttttttttttttttttttttttttggagaatactgtgcttagtctgtggatgaaggagtctggactttgcgacagttattttctttccaaattagtcactttaatacttttcaggcatggtggttcagattgattacggttgtcagaactctgtcagtgagataagtgggatacaactgtatttctttaattcaatgacaaatccattccattttaataacttaagcttctcagtatatgtgatgtatactgtaatagtatcactcacaggagaatgaaatttggtgtcaggccgatgttggaatcatgactttgccattattagctccgtaacctcgggcaagttatttatttccttggattgtcatgttctatccttaattagattaaacataataactcctgtgaaaagctttgagcagtacctgacttatagatgacattcagtaaactatacttactaattatagctatgattaatacaatgttagtttaaaaattaacattagtcttttgtaagtagtttaataaatacctcagtataaaatccagatagaaaaattttacataattaacttattttgcagagtagtaaggcaaataaatgattttaatacactgaaccacaccacatcataatcaatgttataaaaacaagaaagcatagtaacttgtaatgttcattgtcaattttttttgagaaaattgtccaagcatttaaaaataactgaaatgtaaaatgttttaaaatgttaaagaggcagggtgcggtggctcatgcctgtaatcctagcactttgggaggctgaggcgtgtggatcacgaggtcaggagatcgagaccatcctggctaacatggtaaaaccctgtctctactaaaaatacaaaaaaatttgctgggcgtggtggtgggcgcctgtaatcccagctactcgggaggctgaggcaggagaatggcgtgaacccgggaggtggagcttgcagtgagcctagatcatgccactgcactctagcctgggcgacagagcaagactccgtctcaaaaaaagaaaaaaaaaaaagttacagaggatttctatagctaggcaggacaattttgtttacactaagtgttccataaaacaatcctaatatatactattagtgtatattttaaacatgtcttcattcctaatgtgtgtgacacaaactacagtttgccacattcaaagactgtgctattgatctcttattaaatgcatcctcactattttcatttacttccttcattgcctgtacattttttcctcattcattccatctgcaaatatgtgtgtatgtttttaatattgctaattttcagtcttttaattatacaacttctgtgtaagttattgttcttgcattacattagccattttgcatgatgctgtctgttaaagaatttgtgtaccaggaggttgttaaactggaatgtgttgtatttggatgttattgcatgttattttattccagtactggagagctaatattaactcatgacactgtgtactttggctttttgaaataataaactgatttcctttctttcacag

SEQ ID NO: 165 - DNA, 3818 bp, Homo sapiens
  source 1..3818: mol_type = genomic DNA
gtatgcttacagttagagattaccattattaatctaaagttaaattatgaagaatgctttatcaaagaaggatctagctgctgatggtgtgtggttaactataatactgagtcagtttggatgaataatacattgagaattgttggaattgtctttgaaaaaaacttaaatattacttaggcaacagtttgaagtaagagaatactttaaaatactaaattttacttgcattgggagcaagtttaaaatgcagtgaatccattgggtatgatggatgtggctgaaatgaacatattatggatttttgttgttgtcatctattaacctaaattatttacagggtgtttcacagttgaggcgggtctcctccttgctttttgcattgtgaattgcttgatcatctgtgattttggtttcttcattaatgtataattagtttgtgtcaggttttcccaggatagactgattgttctgtttactttatgtagcatatttcttaaaagagatactgcatcatcattcagaccaaattattagaccttctaacactagcactgcaagtaatgcgtctgaactcagaaaatagccatagtcatggccttcttttttagggaattcggtctatgttcttttatgtcttctactgtgtttttgaattgcacattgcagttttaggaattatttattccaagggaggtcctgcaaatgcatattagccttttggaaactgtgattctggaagaaacattagtgggtctggaatttgggataggggtggatataagggaaatacacagttatcaaaacccatgtctttgtgtctctctctttgcagagtcatcgcagccatttgcttttttagcacacggcttcagttgcttagagacgttaacagcatcattgaaatcaccattttaaaagctgtttgaggctgctctatgtgaattttttcaccattgctatttttaaagatgtatctgttctatctgtaaaaaagcttttcacggtatacatagatgataaaacatacttaaccttgtctctcttaatttatcatgacttttctgcctttacaaaaaggctcaaggaaacttaggaaaatcctgtatagttttttcaactagttaagtctgagtctaaagggtagtttagttataatatgaaacttaatacagtgaatatcttctcaagtttgggctgtattcaggtttctctttaaattttatttagtaattgttctattgatgaaactaggcagacaggaaatagcacatattaaaaatagtctgggtcagcttcttggttggcctagtagtaactggtttcagagagcaagtgggtttctaaaatgacagaggctttgactttagctggttaaaagtgaatggggactgactacatgattacatggtctaggagattgtagtagaatttcttcatgtggttgtcatcctaaaagaaaaatctttttgtatcatgagcaaagttggagaccgttttgagaccatgattctaataatgtaaaaggaacaggtcttagcacttatttagtacttaggaaatatttaatgaagaaataaatttcccatccctcccacctaagtaaacaagattcttgccagctttcacagctaagaaaggaggaaaatagtgaaaatagatttttaaacactatatgtggtgattattaaacagtatgttatgctttttagagcacttcacagtaaaatatcctatattattttaataacaaacctggtttattatgttaaaatttcacataaaattattatctttaaaaacatgaattaaaggtggtatcagtgcattgtttaagtattgggtaaaagcattgttgaagagcagagacagcatgctgtgttgttattaaataaggctttattttttaattagtaactggtaacagggaatgttacatttactgattagaaagaaagataggaaaaaagctttggtctcaagatagtattttattgagtctgcttcccaaacctagtttatttcttttggtttgctcttttgtttttattcatcttccctcttctggctttttcttgcccctttgcctttggcagtaacagaaaggtaccttcctgctcttctgtgttctgcctggagggatagtagtccctttgggacctactggggaaatgttgaaagggaagtgagtatattgctagctaataaacttccctggactttagctccttttttgagttcatatcttggcctttaagccttttcaaatcatgtgttaaccagctctattactttatataccttccttccttagttgactggattaaggttatttaagaatagccaactgtgaacatgtgtcagatttataattaaatcattttctcatgtgttgttttcacttctcctgatggttttaggataaagataaaatgattcccaaagtggatattctcgtatggtgagagaattctaagaactaatttatgattctaaataaatctcaccctttttcagtaaatctgcttctccaaactgaagtagtttacacacagttttaaggctataaatgatagttatataccactgttactaatacatttgtatatagtctaaagtttgaaacaaagctctgtgagctaaggggctgtgtcttgttgttttactgctatttcccaatgcctagaatggtatttgacctgtaggtacacagtaactctttggatggatgaatgggtgggtggatgaatggatgtctaactaacttaaagcccaagttatgggttatggtgttggatgtccagaattcccagaataagatgccatctatttgtggattaaataattctaacatggttttaaaaatatttttaaaataattattctgcctaggctagtccaatcaagagtcttttaattttgaaagaaatctttggtctagaaagagctctgagagatgaaaccaatatgtgcctggagttttgggggttttttaggtggctttttttttttttttttttaagatattttgataaatggtcaactgtaatatgtgaaaagttttaagcaggcctacagttttgttctgtaattttctctgcagtttcttcactttaataatattaatgcttcttactagttgagctgataaccttcttctcccaaatgttgcagagcttttaacctcctctgattagaaccatttcaggaagtagcctgcaaacattgaaaaatatgtgaaatgttaagagtaatcttttttagagagagaggtctttaattcagaatttctaaagtgaatttttatatttatccatataatttttatttctttattcagtaggatcataattaaatgccaggtgttggaaaaagaacttaaagtcaattgaaggatacacagagaagaattttacataccaagaaaaaattatgtagacacaaatgtttttagtgtgtgatctacttgtaatgaatattttatattacatttctcaaaagctaggaattaaccaaaatgtaaatatttaatatcctcaaattcacttggagagagtttttctgtgattcatagccagaaatagtagacatgattgggtctcaacatttcttgctgttttagtgcttggcttaaaaatgtaataaaaattaaaacccagaattaaaattcattcctcaaaattcagttgatttctaattttttgttgattccatttgtgttacattttatggtgtaattttatgtacaagccaacattgtttttgttgctgtatgtagtcggtgctgtgacttgtttgtgctcatctctgttctgtag

SEQ ID NO: 166 - DNA, 32638 bp, Homo sapiens
  source 1..32638: mol_type = genomic DNA
gtaaccggccggcagccccgactgctgcggtgacagtcgaggtggaagctcgagaggttctctttatatcatcttatgggtgtagctagagacgggcagaaccggaagggccaactaggcccaaaacctcatgttaaagatgattgctgctttttttcataggacttttgggttttggcatttcctgaaggttattttcattcattgttattggaagaagctggatgctcctgtgatagaaaattcaggatttcagtgtcaggcttaagttaggcttacgcttaaaagcttgaaagtttattctttcattaggtaatattgttatgtacccaggtattagaagttgcgtcttgtttattggaaagccaatacttgtttcccttttctaaagcttgcatattctgggaaaaaaaaccctttgaagaacgatataacatctcatacttactttccacatagtttccaacatgatgataacagctatcaattgttcagtattttcaaagtgctagacatttgcacatttaatcctcagaacaaacccatttatctagtaaatggcaaggtggggttttgaaccaagctcacagcccgtacagtactgcttctcaagtaatttaagttcttgctgctaaaagtgtggtttgtggaccagcagcattggcagcagtaagcaagggttggcatgctttttctgtacaggaccacatagtaaatattttcaactttgtagactagagaatctctgttggagttattcaactcttcaactctaccattgtaacacaaaagcagccttagataagatcagcttccagcatgacagcttaaggaacccattcctctgtaaaactggtgaaaattcttttttgttttgtttcgttttgagacagaatctcactctgtcaccgaggctggcatgcagtagtgtgatcatggcttactgcaaccctgaccaacctccctggctcaatcagtcctcctgcctcagcctctcgagtagctgggaccacaggcgtgtgccaccacacctggctaattttttttttttttttttttttgagacggagtctcgctctgtcacccagagtgcaccgggctagagtgcaatggcgcgatcttgtctcactgccacctccacttccaggttcaagtgattctcctgcttcagccttccaggtagctgggattacaggcgtgcgccacctcgtctggctaatttttctatttttagtagagacagggtttcaccatattgggcaggctgatctcgaactcctgacctcgtgaccagccgacctgggcctcccaaagtggtgggaaagtggtgcgattacagatgtgagccaccccgcccagcctcacctagctaatttttgtaaagacagggttttgccatgttgcccaggctgatcttgaactcctgagctcaagcaatccactcgccttggcctcccaaagtgatgggattacagatgcagccaccacgcctggcccaaaaattctttttttaaaatcaactatttaaaccctccggcaatggtcctgagggcaaacaacaaatgaaaaaacacctattcaagaaaatctacaaattcggtaagaaagatgagagggtatggtatttgaaccaagatcattccctccttactcactcctagcttagtgaggtggagcttctactccagactattgcaaactgtaataccgggcactgctcccccagctcccaatcaaatgctttcttcccaggaaaagcaggacatcagcatttctcatcctacctagagctacttgttgctgaggttaaaacctgtgtgagtgcaattgaaagttggagctctctttttttttcttttgagacggagttttgctcttgttgctcaaactggagtgcaatggtgtgatctcgcctcaccgcagcctctgcttcccgggttcaagcgattctcccacatcagcctcccaagtagctgggattgcaggcttgcgccaccatgtctggctaattttgtatttttagtagaggcagggtttctccatgttggtcaggctggtcttgaactccctacctcaggtgatccacctgcctcggcctcccaaagtgttgggattataggcgtgagccactgtgccctgcgaaaagttggagctcccttcttccacctagtccctacttgtggaacaggactgtaccttggacatgacatactgaaattactggtgccccaattgctcatcccccagttcttgcaggctgagcctcaggttattgcggtcccctgcctccttccaccaagtgctcagttcctagagtgagggtatttctcagagagaatctttccagggtccttccccacagctccagagccttggctccgggattttgcctcaggagagaagcaggccctaaaacagatagctcctaatctctttccaatggcagtgacttcatttgcaacacagtgtggagaaattcatgcctaagggcaatctggagatgtgaaggttttggtaagaggcaactgggagatctgcggatttaatggagatgcagcctagactgtaggcctcctggtttgctggaaagaattggggaataagacagctggaagaagccattctaggatcagaagaaggatcaaacattgaccgcagcatggtggctcacgcctgtaatcccagcactttgggaggctgaggcaggcagatcatctgaggtcgggagtttgagaccagcttgaccaatatggtgaaccccatctctactaaaaatacaaaaattagctgggcatgggggcatacacttgtaatcccagctacttgggaggctgaagcaggaaaatcacgtgaactgggaggtggaagttgcagtgagccaagatcacgccactgcactccagcctgggtgacagtgaagctctgtcctgtcacaaaacaaaacattgaccacagacctctgaggtggtggatgtccctcctgtcctggttgtatcattatacattgtatattaatgtatcgaaatactacaggtacccccaacatgtgtacaactattatgaatcaataaaaaacaatttgaaaagtaaggtatgtggcagaggtggaaaaaaatgctttcctccaaacagccacaatttgattgtatcagtttgtagagtaagagcaagttatgcctcagtgtgttgttgaaaataatagaacaatatgccacaattagtggagcttcatagctgggtgtggtcaaggagagaatagaagagaaccctaccaaaaccactgtcatcccagggtgactgtgagcatacccaaagctgcacctccctgaagagcaatatcataggccttaacacttttcaggggaaatggatttcactcaaataatccagccagtcgctaaacaaataaataacaattggccctggagagggggtaccaatccccagagttgctacagtatattatctaaaatgtccagtttccaacaagaaattgtgagacgtacaaagaaacaggaaaatatgacacatacactggaaaaaagctggcagcagcaactgcctgtgagacaaggggccaaattaatgaaaaaggcttcaaactggcctatatatatattcacagtactatatatattcacaatactaaaggaaaatatgatgacaaagaagtaaaggatggtatgacactgttgcatcaattaaagaatatccataaagatatagaaattataaaaaaagaatcaaatgaaaattctggagttgaaagtacaataacagctgggcgcggtggctcacacctgtaatcccagcactttgggaggctgaggcgggcggatcacctgaggtcgggagttcgagaccagcctgaccaacatggtaaaaccccgtctctgctaaaaatacaaaaattagccaggcgtggtggccggcacctgtagtcccagctacgcgggaggctgaggcaggagaattccttgaacctgggaggcggaggttgcagtgagccaagatcgagccactgcacaccagcctgggcaacagagcaagactctgtctcaaaaaaaaaaaaaaaaaaaaaaaaagtacaataacaaatttaaaaattaactagagggactcaggactcaataacagatttgaactgggtgaagaaagaattcgttaattttttttttctttttgagacagagtctcgctctgttgcctaggctggagtgcagtggggcaatctcggctcactgcaacctctgcctccctggttcaagcgattctcctgcctcagccaccgcacagtggctttgggagtactctgggaggctgaggtgggtggatcacctgaggtcaggagttcaagaccagcctggccaacatggtgaaaccccatctctacaaaaatacaaaaatttagttgggcatgatggcgggtgcctgtaaccccagctacttgggaggttgaggcgggagaattgcttgaacccgggaggcggaggttgtagtgagcagagatcgtgccactgccctccaacctgggtgacagagcgagactccatccctgccctgaaaaaaaaaaaaaagatgtgaaacacatacaaaaaaaagtaaaatggcagttgaatgccaagtaattagataacttcaataaaatggacaaactcctagaaagatataaaccaccaaaattgacccaagaagagacactatctgaatagacctataacaagtaaagatattaaattagtaattgaggggactcgtggggtaacttgcccttgggaaccagtagtatggcatcgggctgcaagattggcctgtccatcctcaatgctacctggccaatttaggggcccagtgcctctggatgctagactctggggtcgattatctccaccggaatgtaatggatgaacatgcatgtgatggtgtccaagccagaacagtgggtaaagccaatggctataagaggagccaatcagtacatctttcatctcgaggaaactgagaacccaggggctttgattaaagacattcaggagaatgggatgaaggttggccttgccataaaaccaggaacctcagttcagtatttggcaccatgggctaatcaactaggtatgaccttggttatgacagtggaaccagggtttggagggcataaattcatggaagatatgatgttaaaggttcactggttgaggatccagttcccatctttggctatagaggtcgctggtggaatagatcctgacactgtccataggtgtgcagaggcgaagctaacatgattgtgtctggcagtgctatggtgaggagtgaagaccctagatctgtgatcagcctgttaagaaacatttgctcagaagctgctcagaaagattctcttgattgatgaaaccttaaggagcccaatgtttgtttatgaaatctcctttttactggaaaacaggaatattgactaccaaatcatagtgtagttgaagccattctgcgtttttgagcagttattcgtttcagtgattataattgattgtgcagagtattctaagaagttagaaattggtgtgtataactacattttcagtgatgcaatttaatgattagtgagtgagatactgtttttattgagagccttgatttttataaagagtaaaaatatggctgcattaagggtacaaacagaaaagtgtcttaatgtctaaggagggcatattagctacactataaaaacaatttttttctgtatttctgaaaagaattttgttgtttctcagttgttttccaaaagcaaaggaagtcttaatgtttttttctatttcgtgttatgtgtgatttgtttatatgcttggtaatatgagtctaatggaatttaaaaatataagtttgggtaggatagtatacccttaaaaaataaataaataattagagagagagagagagagagagacctgggcacagtggctgttgcctgtaatctcagcactttgggaggtcaaggcaggaggatcctttgaggccaggagcttgagaccaacctgggcaacatagagagaccccaactctaaaatatacatactatatctaaactcagctaggcgtggtggtgtgagcctggagtcccagctactcaggaggttaaggtgtgaggatcacttgatcccaggaggttgaggaggcagtgagctatgattgtgccacagtgcttcagccagggtgacagagtgagaccctgtctcttaaaaaaaagaaaagaggctgggtgcagtggctcatgcctgtaatcccagcactttgggaagccaaggtgggcagatcacgaggtcaggagttcaagaccagcctgtctaatatggtgaaaccccatctctactaaaaatacaaaaattagccgagcatggtggagtgcgcctgtagtcccagctactcgagaggctgaggcaggagaatcgcttgaacccgggaagttggaggttgcagtgagctgagattgcgccactgcactccagcctgggtgacaaagtgagactccatctcaaaaaaaaaaaaaaagaagaaagaaaagcaaagcaaagcccaggcctgtacctactagaggtcctgataacttcaccactgaattctatcaaacatttcaagaaaaattaatacagttcttcacaaagtcttcaaaaatgaaaaagaggagaaaatacttacaaacgaattttatgagactggtattaccctgttgccaaaaaccaggaaaagacattacaagaaaagaaaaccatagacaaatatatcttacaaatgtggaagcaaaaatcctcaacaaaaatactagcaaactgaatccagtaacatataaaaataattatataccataaacaagcaggatttattccaggagtgcaaggttggtttaacatccaaaaatgaattagtgtaaataatgtaatgcattatatcaatagaataaaaaacaaaaatcaccttgtcatctcagtagacacagaaaaagcatttgacaaaattcagcatgtttttcatgataaaaacactaaataaactaagaagagaagagcagttcctcaacctgatacacagcagttatgaaaaacccacagctaacttcataatagtgagactgaggccaggcacagtggctcacgcctgtaatcctaacactttaggaggccaaggttggagggatcacttgaggtcaggagttcaagaacagcctggccaacatggtgaaaccctgtctctactacaaatacaaaaaaaaattagccaggtgtggtggtgcatacctataattgtagctacttgggaggctgaggtgggaggattgcttgaacctgggaggcagaggttgcagtgagctgagatagcactactgcacacaataggctgggcgacagagctcaaaacaaacaaacaaacaaacaaaatagtgaaagactgtatgcttatccttaagattaggaaaaagagagataagtctactttcactactgctattcagcattgtactggaggttctagccagggcaattaggcaagaaaatgcaataaaatacatctatgttggaagggaacaagtaagatcatctctgcagatgacatgatcttgcatatagaccctgaggaatccactaccaaagtattggaactaataaattattagtttagtaaggttataggatacaagatcattacacaaaacttagttgtaaatgtatccacttggaatgaacaatctgaaaaggaaattaagaaaattccatttacaataacctaaaaaataaaaatacttataacaaaagaggtatctttttttccatcctctgacagtttagtaaaagaaagtataaaacttatactctaaaagctgtaaaacatttttggttttgttttttaaattaattttttttgaaacggagtctcactctgtcgtccaggctggaatgcggtggcgcgatctcggctcactgcaacctctgcctcccaggttaaagcgattctcctgcctcagcctccggagtagctggagctacaggtgtgcaccaccatgcctggctaatttttgtatttttagtatagagggggtttcaccatgttggccaggctggtctcgaactcctgacctcaggtgatccacccgcctcagcctctgaaagtcctgggattacaggcgtgagctagtgcgcccagcctggccttttaaaatatttaattaattgatttttttttttctcggacttgcactgaagtgagaacaagtgcagtggtgcaatcatatctcagtgcagcctagaccttccaggcttaagtgatcctcctatatcagcctcccaagcagctcagaccacaggcatgcgcgatcatccctagctttttttttttgtttgtttgttttttaatttcttgtagagacagagtctccctgtgttacccaggctggtcttgaacctgacctcaagcaacctcccatgttggcccctcaaagtgctgggattacaggtgtgagccaccgtgcctggcctgtaaaacatttttaaaagaaagaagatataaataaataaataaatagaaaatagctcttgttcatggatcataagacataacgttgtcaaattggcagtattttggaaattgatctacacgtttgacataatccctgtcagaatcccagtttatttcattgtagaaattgacaagtctccaggcgtagtggctcatgcctgtaatcccagcactttgggaggccgaggcaggcggatcacctgaggtcaggagttcaagaccagcctggccaacatggagaaaccctgtctctactaaaactacaaaattagccgggtgtggtggcacatacctgtaatcccaggtactcgggaggctgaggcagggaatcgcttgaacctgggaggcggagcttgcggtgagctgagatcacgcgccactgcactccagcttgggcaacaagagcgaaactccatctcaaaaaaaaaaaagaaattgacaagtcaattcataaattcctatggaatcgcaagggacccacaatagctaaatcttgaaaaagaacaaagcagaaagactcacgctttgtgatttcaagacatactataaaacaactaatcaagacaacgtcaccaggcaccgtggcttatgcctataatcccaacactttgggaggccaaggcaggcagatcacttgaggacaggagttcgagaccagcctgggcaacatggcgaaatcttgtctctaccaaaaatacaaaaattaaccgggcgtgggggtgcacacttgtagtccaagctgcttgggagggctgaggcacaagaatcccttgaacccaggaggtggaggttgcagtgagtcgagatcgtgctattgcactccagcctgggggacagagcgagattccatttcaaaaaaataaaaataaaaagacagtgtggtactggtataaggataaatgtgtagatcagtggcatagaattgagagtccagaaataaacccagtggaatagagttgagagttcatggtcacctgattcttgacaagggtgcaaagaccattcagtgggggagaactgtcttgtcttgtcttttcttgctacatgccacagactgtgagaaggaatagtcctttcttttcttttttctttttttttttgagatggagtctcgctctgtcatctaggctggagtgcagtggtgcaatcttggctcactgcaacctccgcctcctgggttcaagtgattttcctgcctcagcctcctgagtacctggactacaggcgcctgtcacaacgcccggctaatttttgtatttttagtagagatagggttccactatgttggccaggctagtctcgaactcctgacctcgtgatccacctgcctcagcctcccaaagtgctgggattacaggtgtgagccaccgcacccggccggaatagtcctttcaacaaatggagctgagacaactggatagccacatgcaaaaaaaagaagaaattaaacccttacctcacactacatacaaaaattaactcatggctgggcacggtggctcacacctgtaatcccagcactttgggaggccaaggcaggtggatcatgaggtcaggagttcaagacgaggctggccaacatggtgaaaccccatctctactaaaaatacaaaaagtaggccgggtgcggtggctcaacacctgtaatcccagcacttcgggaggccgaggtgggtggctcacgaggtcaggagatcaagaccatcctggctaacatggtgaaaccctgtctgtactaaaaatacaaaaacaaaattagctgggcgtggtggcgggcgcctgtagtcccagctacttaggaggctgaggcaggagaatggcgtgaatccaggaggtggagcttgcagtaagccgagatcgcactactgcactccggcctgggcgacagagggagactccatctaaaaaaaaaaaaaaaaattagctgggcatggtggcgggcacctgtaatcacagctacttgggaggctgaggcaggagaatcgcttgaacccaggggtgagctgagatcacgccattgcactctagcctgggtgacagggtgagtctccatcccccacccaaaaaaaagcttaaaatggatcaaagggccagttgaggtggctcaccccagtaatctgagcactttaggatgttgaggtggatggatcacttgaggccaggagtttgagaccagtctggccaacatggtgaaaccctgtctatattaaaaatacagaaattaggctgggtgtggtggctcatgcctgtaatcctagcactttgggaggctgaggcaggtggactgcttgaggacaggagttcaagactaccttggccaacatagcaaaaccccatctctactaaaaatacaaaaattagccagccgtggtggcatgctcttgtagtgccatctactctggaggctgagacatgagaatcacttgaactcgggaggtggaggttgcagtgagctcagattgtgctactgcactccaacctgggcaacaaagcaagactctgtctggaaaaaacaaaaacaaaaacaaaaaacaaatgtggagaaatgtgaacccttttacactgctggtaagaccgtaaaatggtgcagccagtttgaaaagcaaactagttagccaggcatggtgggtcatacatgtaattcctgcactttgggagaccaaggtgggaggatcacttgaagccagaattttgagaccagcctgggcaacagagtgagaccttttctctacaaaaaatttaaaaattagccaggcgtggtggcttgcacctgtagtcttagttacttgggaggttgaggtgggaggatcacttgagcctgggagaggctatagtgaggcatgactgcaccactgcacctccagcctggtaatcaaagcgagaccctgtctcaaaaaaaggaagacaattagctgggtgtggtagcgttcctctgtagtcacagctacttgagaggccaaggtggtaggattccttgagcccagaattttgaggttgcagttagctgtgattgtggtgctatactccaggctgggcgacagagtgagacccagtctcaaaaaagataaaaagaaaaacatggtggcagttcctcaaacagttaaacacagagttaccatataaccccacaattcaacttacagatgtcttctcaagagaaatgaaaacatagctttacgagaaaaacttatatgtgaatgtttatagtagtattattcataatagccagaaggtagaaacagttcaaatatacatcagctgatgaatggataaacaaaatgtggtctatccttactatggaattacttggcaataaaatagaatgaagtaccagcacgtgcttcaacatggatggaccttgaaaacactatgctatgtgaaagaaaccagccgcaaaagaacacatatgattccattcatatgcaaatctaggataggcatatctacagagacaaagtagatcagtggttgttcagggctgggaaaaatgggtggggtagagggtgtgatagctgaaatatacaaggttttatttatgaagtgatgaaaatactctaaaactgactggtgatggttgtacacactgaatgtactaaaaactactgaattatacactttaaatgggtgaattttagggtatatgaattatatatcaagatgtttaaaaaaaaccttaggcaaaatgtaaacaatgggcatgactgtgttccaagaaaactttatggacacagaaatttgaatttcacataattttcacaagaaaataaacattaaaaaatgtaacatgctgggcactgtggctcacgcatgtaatcccagcacttcgggaggccgaggtggacggatgacgaggtcaggagtttcataccagcctggccaatatgtaaaaccctgcctctactgaaaatagaaaaattagctgggcgtgatggcacacgcctgtaatcccagctactcgggaggctgaggcaggagaatcacttgaacctggaaggcggaggttgtggtgagctgagatcacgccgttgcactccagcctgggcaacaagagtgaaactccgtctcaagaaaaaaaaaaaaaaaaagtaaaaatcattcttagttctcaggccacacaaaaataggtggtgggttggatttgtcctgtgggccatagtttgctgatctctgatctaagttactatttgatagatgttagatgttgtgagagggtaagagagactagcctataaggaaagggattttagttttttgggggtttttttttttgagacggagtctcgctctgtcgcccaggttggaaagcaatggtgtgatctcagctcactgcaacctctgtcacccaggctcaagcgattcttctgcctcagcctcccaagtagctgggattacaggcatgtgccaccatgcccggctaatttttgtatttttagtagagatgggctttcaccatgttggccaggctgatcttgaactcctgacttcaggtgatccgccctccttggtctcccaaagtgctgggattacaggtgtgaaccactgtgtccatccaggaaagggattttgtatgacatttttcagccgcaattttgccaggaaaagctcttttttcttcattaagtagattccagacccaaagatgttggacagtattatcagctagagcaaggtttttcaaccctggcactattgacattttggctggatgattctttgttgtggggagctgtcttgtatgttctaggatgtttagcaggatctctggcctctacctactagatgccagtagcattcccccaccccatcccagttgttgtgacaaccaaaaatgtcttcagacattgtcaagtgtccctggggtagggaggacaccctccaatctcctctttctccctacccaacctccatgaccacattgagaaccactgatctatagaaaaggataatagtagtgacattcagagaggcaggatggtatagtgcaaagcttgccaaactttaattttacataaatgacctggggaatcttggaaaaatgtaggttctgattcagtagttctgggatggaagtgagaattttgtattaataacaaactctcaggtgatgatacctgtgccaccggcccaaggaccacactttgaatagcagagcagtagtagaaagtgcatcggctttgaaagaagacagacctgggcttgaattctagctaaaatacttctactttggacaagttacatagctctctggaccttattttctcattggtaaaatgagactaataatgctgaccctgcagagttcttataaggattcatggaatgcatagtccctggcagaaaggaagatataggagggactataattggcctaaagtaggaggctctggttaccatgggcactgccctgttgtgatttatcaagccattacacctcactgaacctcagatttccagtggaaaaacctgtttgtaaaccatgttcacatattctgttgaaagtaatcatagtttgatttatgatgatagggctcaggtaagtgattagttttattctcctgcctgctttttatgttgtccattaatgagcaaggtgctgatgcaaggagatggcagatgcattttgaaaaaaaaggagagagagagtacttgtagaattcttgactttattgaggtcaaatgtaggtggcttttcaagaaggactcaatttcagaaccggtggcatttaacatatgagtcatgttaccttatgctaataagttcagactttttttctttttactgcagagatagggggaaaaatctcctgcactacttgctgcattgctcaattggctggatgctttggaagatttttccacttgaaagatttgttgtttgtcattttgagaaagtgggtgctgagtgtaatttgccaggaggctaaacggctatgttatttcttatctaggctggaattttactctaataattcaatctatcagtaagaaaagccaaataggaagttgtaagagatcctaatactatcttatattgaaaacaaagcctccttctcctgttgtttggcattctaaatgttttcacatacctaagtgagattatgattgtattaaataccaacattgcagatcattccagcatacaagtggacgtaagttgtccataacagaaggaactttctaaaggggaagacagatagaacaattctggcattttcagtaaaatcttaaatcctaggctccctaggaccaggcaaaccatccccttcaaggatgtaaactctggagggcagtgtagttgtacagggtaatagttctatactctatattagtgcaacaagaaacttctattcctgtttcagaagtaagactgttatctacctttttttttttgagatggagtttcactcttgttgcccagactggagtgcatgatctcagctcaccaaaacctctgcctcctgggttcaagtgattctccagcctcagcctcccgaatagctgggaatacaggcatgtgccaacacgccctgctaatttttagatttttagtaaagacagggtttctccatgttggtcatgctggtctcgaactcctgacctcaggtgatccacctgccttggcctcccaaagtgctgggattacaggcacgagccactacgcctggcctgttatctacctttttaccgctgtgctctcccatgggttttttttgtttgtttgtttgtttgtttgttttgagatggagtctcgctctgttgcccaggctggagtgcagtggcgtgatctcagctcacttcaacctctgtctcctgggttcaagcaattctcctgcctcaacctcctgagtagctggaattacaggtgcctgccatcatgccaggctaatttttgtatttttagtagagatggggtcttaccatgttggtcaggctggtcttgaactcctgacctcatgatctgcctggctcggcctcccaaagtgctgggattacaggcatgagccaccgtgcccgacctctcccatgggttttaagtagtgcctatggatggcatgggtgccactactcaggtctaggacaggcaggggtgagtgatgagtgcgtgcgtgctgatgaaggggtgcgaagaaacagatgctggctagtgctgccctccactggaccccattctgcctttgtgtgggacaaagggctagggactagcagttactttgtgctaggtaccatgctaaatgctttaaatgcacactacctcatttgatataacagggactcatttattcattcaagagatattataaaataggctaggcacagtggctgacacctgtaatcccagtgggaggccggggtggccagatcacttgaggccaggagttcgagaccagtttgggcacatggtgaaatcctgtctctactgaaaacacaaaaattagccaggcgtggtagtgggcgcctgtagtcccagctactccggaggttgaggcaggagaattgcttgaacctgggaggtgagggttgcagtgagctgagatcgcgtcactgcactccagcctgggcgacaagagcgagactctgtctcaaaaaaaagacaataattaggcgtggttgtgcgcacctgtagtcctaactacttggtaggctgagacaagaggatcacttgagcccaggagttcgaggctgcagtgagctatgttcgtaccactgcatgaagcctgggtgacagagtgagactctgtctcttttatttatttgttttttaaataatagagacagggttggccgggcatggtggctcattcctgtaatcccagcactttgggaggctgaggcaggtggatccctgaggtcaggagttcaagaccagcctggccaacatgggaaaaactcgtctctactaaaaatagaaaaattagccgggggcaatggcatgtgcctgtaattccagctacttgggaggctgaggcaggataattgcctgaggtggaggttgcctgagattgagccactgcactccagcctggatgacagggagagactccgactccaaaaaaaaaaatagagatgggggtctccctacgttggttgctcaggctggtctcaaactcctgtgctcaagggatcctcctgcctcagcctcccaaagtgctaggattataggtgtgaaccaccacacgcagctctgatttactgggtgcccacgttgaccaggcagggaacacctcctagcagtgatcaaggactactttggacctaggttctgtaactgacttcatctttaagtggggaaacagaggctcagacaggatacatagcatgcttaaaggcttagtgcagccactatctattctgaaagaggcagaataggacagggacaggtaggtagtgagagaatagggagaatagatgggcacaccctttaacttaatatcgaccagtaaagcctgcagttgcttatttgaacctcacattgaggctgacatgtaagttgagcaaatcttaactcaagcttcagtttccttgttggggccgctgaggcagcatagcctagagattacaagcatagacttcagagtttgattcctggctctgcctctaaccagctttgcaaccttaaagctccttaaccccctcacatgcctctgttccctaactgtaaaatggtgaatgtaattaattcttcctgcatagtgttacaagaattaaatttgagtaattactggtaaagtacgtagaatagtacctaacacaagataagtgctatatataatggttgttacctaaagaaataacagcctgggcaacatggcgaaaccctatctctacaaaaaatacaaaaattagccggttgtggtggtgtgcacctgtggtcctagcatctcgggaggctgaggtgggaggatcacatgagcctgggaggtcgaggttgccataagcttcctgattgcaccactgcactccagcctgggtgacagagtgagaccttgtctcaaaaaataaataaataaaataaattaaaaaaataaaaaggaaataagttcagtgcctgtcgttagcttgctccctttctcagcctctcctccacttcctcacgcaccctcttgctctgagcctattatcctggtccctccttcacactgccacatctttgcataggctgttctctttgcctggaatgccattctcatttgttgcttggcagaactgaactcattctccttctaggctctgctcaagggtttcctcttctttgtgtccaaagtcaccacatagcttctaagtgatgggactgagatttgaagccaggtcatctgtctttcaggccagccctctttccactaccctatgctacccaaataggaagcgtaaaagagaagtaggagagaaaaagttagaaacctggagagaacttaggtatttggtaaacaggaaaaagaaagtggaaagaagagatcatttgaaggacttcctcaacttaacaactatttgcctatggcattattttattgcatttggtgtatgatactatctcaaaagcattttgtaaacttgccagtggcttacatttttgccggatgaatgacatgactaacgatccgtgctacattacctcagtgtctagtttgtcattttgaatcaagtggacattttctgtaagtgaatcattttcacttgctcatgatataatgagaattccttacctttggcttaaaatgaggcttatgttataacagttaagcattgtctagttgcatatttaacatagtcagaatgctcctgcctgtattcagcctggtgtcttataatatttggtatgcccacctagatagcaattggtaacatctttattctgagactctttcatgtatggattttgaaaagttagttaactgttcagacgacattgtttctttgacttttacaatccgcttccctctcactgacagttcagttttggaagaccctgtatttttttttttttttttttttttttttgagacagagactcgctctgtcgcccaggctggagtgcagtggcgtgatctctgctcactgcaacctccacctcccgggttcaagcaattctcttgcctcagcctcctgagtagctgggattatgggtgtgcaccaccacacatggctaatttttgtatttttagtagagacgaagtttcaccatgttggccaggacggtctcgatctcctgaccttgtgatcagcctgcctcggcctcccaaagtgctgggattacaggcgtgaaccaccgtgcccggccttttttttttttttttttttttcgagatggggtctcactcagactggagtgcagtggtgctatcacagctcactacagacttgacctgctgggctcaagtgattctcctgcctaagcctcccaagtagctgggactacaggcacatgccaccaatacctggctaatttttttgaagaaatgggatcccgctatgttgcctaggctggtctggaacttctgggctcaagcgatccttccgcctcagcctctcaaagtgctgggattacaggcatgagccaacatgcccagctagagatgtgtgtgaattggtagcttcaagctagatattggaggctcatgaagcccaggttaaagaggcttgtattcatcagatgcgatgaagagctttgaagtttttactagaagtgtgatttaaagtggttggcatgcaaaatgatttggaacgtttggggtttggggtagggagagagaggttggaagtaggaaacaattagaaggcaaacgctttgggcaaggtatcacattgaaacctgaacagcagtgggacttgctgggggttgggacaaaactaggcagatgtaagcatctagtgaatctagagattagggtgttctgtgaccaagaatgagcagaagacctgctaggctcaagattcaggagattctcaggtccaaagccagtcctcagtctccgaagtcagtcaggcagaagggaagttggatcaagctggccagagttgagctcaggaagtcagtgcactttctcttgtctggttcctgcatcgttttacttgtgtaaaatcatcaagatccctaaaccgatgtctgaacaccaggcttctaggcagagctccaccgtgtgaccttgggcgcatcacttatttcccccaggcctcagttcttctgaaagatgaggggaagaactcacattcaaaggccctcagctttagcgtcttattttaggtgatctgggcagaagagtctcactgtgctcctctccctttcatatttcctgctttggtaggaagtcatctcaagacttgagtgtataggcatgaggaagtctgctagaggacaggaagaatattgcttaaagaataagagctacagccctgatggaaggggtaaattggcctgggaaaagccctgcctctgctacctgcttcccaagtgaccttgaacttaactctttaaacctcagttgctgcatctataaaatgagaataatagtatcttttttatagggttttttttgttttgtttgtttgtttttagacggaatctccctctgttgcccaggctggagtgcagtggcacgatctcggctcactgcaacctttgcctcccgggttcaagcgattctcgtgcctcagcctcctgagtagctgggattataggagtgcaccaccacgcctagctaatttttgtatttttagtagagatggggttttgccatgttggctaggctggcctggaactcctaacctcaagtgattctcctgccttgacctccctaagtgctaggattacaggtgtgagccaacgtgcctggccagggttgttttgagacatgaatgaggtggacctttacaggcacttggttcagggcctgacccgtagtgagcatttgataaatgttacctatctatgttgtcatgggctgggagtgtgggaacaggaagtgtctcatgccagaagcactgtgaattttctcctttaatcattgccttcattttctttgaaccttattcagattgtccatgcctttgtaattgtagaccctctaaactataattagtccaaataaaatggactcaccttatgccatgttcttgttgaagggtcctctttctttctttctttctttctttctttctttctttctttctttctttctttctttctttctttctttctctttctctcctctttctgtctctctcttctttctctctctctctctctctctttctttctttctttctttctttttctttctttctcttttcttgctctattgccaggctggagtgcagtggtgagatctcggctcactgcaacctccgcctctgcctcccaggtttaagcgattctcctttctcagccttccgagaagctgggactacaggcgtgcgccactaatttttgtatttttaggagagacggggtttcaccatgttggccaggatggtctcgatctcttgacctcgtgatccacgctcctcggcctcccaaagtgttgggattacaggcacgagccattgcacccggccagatcttcttttttgtaacatgctaagtaatacaatctctatttagcttgatgtccacggtgatagcaggattcttttcggatttctgccatagttaattattctgcattcttttgtccctagtgtgtcatattgaaatttttcttttttctttgtttttgatgacttctccagttattcatgctagttttgcattcctgtccaagaacatttttgctgcttgtttatttttaatttcataaactaaagcgtttgaggttttaaaaacccagaattgagttttctcagagctgctaatctttctagccagctggtgacgaggcttctcaattcttgttacaggatgatgtgttctgtcctcctgtctgtgctttgtctaatttagattctaaatccacatgtttaggacatttttagcgtgtcaaaatttattaccaaagtagtgctgacttcagggaaaaatttttaatggaatctttagtcactcatgttgacacaaggtgcttgtcctagtgcaggaatctgtgtggcaccactaggtggtgccagactgcatcatttttaaagacagccttttctcttccaactcttttgccactgttctcttttttgcttctttgccaaatttggaccgagctttgaaaacttcatataaactttctcttagtgagttatgttgcttatagcttttccctccaccttgcctgttttagtcttcttgtttcaatagttttgatagtttgacattcagataaaacttaaaactgaagcccaaagtaattactaaatgtatctcgactgatctgtggttttaaattcaccaacagtgcatctccctacttgcttaatcatattgattttgagattaaatcagtctcataaatatgttagtcttcagcccacggtagttctcatccatctgcagactttttttttttttttttttgagatggagtctaactctgtcaccaggctggagtacagtggcgccatctcagctcatggcaatctctgcctcctgggttcaagcgattctcttgcctcagcctcccgagtagctgggactacaggtgcttgctaccacgcccagctaatttttgtatttttagtagagacagggtttcaccatgttggccaggatggtctcgatctcttgatctcgtgatccacccgcttcggtctcccaaagtgctgggattacatgtgcgagccaccacgcccagccccatctgcagatatttttaccagtcctatccactcatgcctgtaccttctaatgttattaaagtcagttttattatcattgatgaccatgagacttaatcaaaaggtcaagctagaaacagagaatattcaaaatttctttccaggcaaacatctgggttcaatagaagctagttcacatgaatggatcatgctctagctctgttgtgctggagcttttttgaaggaatgcattgttacatactaaccacaatttttacattgtccagggcaggagtaaccagttggttgatacttagtcaggggttgtgtttcgtaatctgctagttgtacttgatgtttaggcatttgaaatttaaccttgtgccttatttgtgctgaatttactattgtttcctatttgtagtgctctgcaaaattattctcagtatatcacacatttgtaatcattgccaatcactgaatatcaataacatgctaggtgataagaacttctatttttcagcagcattatcattcccaattttactacatcagagagttcatcattatacagtcaactcatgattattaggagtaaggaacgtaatagcagaccctgaatgagggaaaagaatgtgaaaccacacataaactaaaggtgaagtcatttacatccctgaaaatgattttaagatacagaatgagatgttaaaggatcaaaagaaaattatcgtagcaatgaaaaatgctacatggtttatacaaagtcatgtcaagctcatagactcagagagtggtgttaatcctgaagaccacttgatgattatggaagccgagacccaaagaggttaagtgacttacccagcacagcgggtttgggtgttttatagctgtttgactatatgagctatgattgctctcatgttgtgagctaaattccaaagatattgtcgtgtttgcttttgtggggactgtattgctttcatagcatgatggttgtattgtttctttttgctttgtcatctgtcagtcaactttgaagtgaatcttctttgtttacagcatagtaaaatatggtgattgcatggctcataagagatttacaaatgaagaaactgaggcccggttgagctgcatggcacacccaagtcatagacttgtgtgtggttgaggcagagaatctaggatacagacctccctgctgggttcctcccgctcccataactgctctgcacttcagcgggaaagatgccagaaactgcaagcataaggcctttttttcccctaaaaaactgtaattcatttggttttgaaagacttaccagagtttaaaagctccattttgtggcttcccaaggtgctgtgatttgtttcttactagtctcctttgttctgtggaaaattttcttctttggttgtttgagatttagatttccttgccaaggtatttttagagagaggaaatcagtatgtttcaccaaaggggtaaaatatataccttaaggcctaattatgcaattacatttttaataacgagtgtcataaattcttgcttcattgcaatcattaattggaagactgttctgctcagaagcctcatctagttatcatgattatcatcaacatcgtcaaccaaccacaagcatcaagcatttatggagtatccacagattatgcagcacttgccagggttctgggagacttaatctgtgtgtgtgtgtgtgtgtgtgtgtgtgtgtgtgtgtgtgtgtgtacacccttgccttcaaggagtttgtgatctgcagaactggaggaaagacagaaaacttggggaaagacaagtacctcatttttcaatatgtgtaaagcccatactgattcatgtatgtggcattgggggacatggacagcagggagacaaagggatagatcttagaaaggtctagttacaaataaatggaagcacataagtttgctgacatgggaggacataggctgggttgtaataaggtagggtaattggttgaaggagggaggaagaaattggtgaagagttgaaggcagtaattaaatagatttggcataataacagagatgattggagaactgggagaagaaaattacttgctgtagttgattatggcagaaactgacagggcaagagattacagttgggattttttgcaaagaggagctttcaagtttgtgacatctttttttttttttttttttttttgagatagtcttgctctgtcaccctagctggagtgcagtggcgtgatcttggtttactgcaacctctgcctcccaagttcaagcgattctcctgcctcagcttcccaagtagctgggactacaggtatgcgccaccacgcccaactagtttttgtatttttagtagagacggggtttcaccatgttggccaggctggtctcgaactcctgacctcaggtgatccacctgtctcggcctcccaaagtgctggagttacaggcatgagccactgcgcctggcctccaagtttgtgagatcttgcccagatttaaatgaaggatgtggggttcaggattggtacagcagaggaaaaaagtctctctctctccccactcccctctttttgctgtgatctattttttttcccacacttttcacaggtgttgtcctgtgatctatttctatttggtggatctcttttcccctcatgttgagaataatggctgaggtgtggtgtatcctttaattttgaaaggaaacggcatgatggttttgcggtttaatcatgagacacaagaacagcttttgttgtgtggtgataccataccctgaattgagattatcagtgtcagacatatattactgcacttttttatcttcttcgcttaatcaaaatagattttaatggaatttattattcacttactgtacagtaaaattacttttataactttccattgtgtttttcttgtaaattgaggtatttggcctctatttttcaaaacagacaaaagttgtattcaggttaggtttggatctggtatattagcatcttaaattctcaagtctcctataaacctgttctcttaggccagctatggctgcagaagtcagttatagataaacattgagaggggagatcacatcatcctttgttttccatttctgaaataacggcagacacgtggcacatgtcctgagcctggggtggtgccgttccttttgttgctctatctgtatgggagctaaccttttgacaatttttatggcaaatgctagggcagcttgtgagctaattagaagaaactgataagtgaatgctgagtttgtcgattctctttcattttctgcagaggagacagccgttgaaacggcattcttcgtgtggctgataatttagcccaccagacccctatgaaagggaatattgcttctctcttagctttttccacattttagtattctctttaaagccaacatttctccataggttctaatacctaggcatttcatatatagtagccaaattcagttcactttcttcaagaaagttgtccttttcaaactgtggccttttcctgtcatgggtctggtttcttactcaccccgcactgttgtatcagcaggtactaggatttgattgctgatgactgtatgtcccaaagaaaacagtgggagaaatgcagctgtcaaagcaaaaaacaaatagcagttttaaggttgagtctcaacctggccagttgcaagatggctgttcagtagatgttattcctaatgcttccctggttaatagaactcaatcagtcctgcaggttattggtgctggttgcttcctataacagaaaagtactgcattccagctacgttcctgctgtggaacataagtgcttagtgctatttacttaaaacattctaggttgataaattacaagcccttcactctgggtaaagctcataaatccagctcctacaaaaaaaatagcaagctgatagcacttagtcctgtttataaagttcatacacatctatccatgatataggcacaagtatatatctatgaaatagcactgcagcctgttaaagtaatgggtgagcacagccacaaaggcgagaagcatccgacttccagactcctcctattagtctctatgcctgaagggcaccttgaggaggaggtctgtggaagggagcttccaggcattggagtccacatttgtgctcctttctctctttcttcttcccgcaagtcacctttctcacgccctccacctctctctttccttctgcaaaatgagcatctgcctcttagcctccctcttcgtcactaggctgagatgaggcagggaaccgtggtggatccagagcagtttgaacactttggctgcgtggaaagcgatggggttaaatgagcatttaatcagaaccaggagctgttcttttggcaacctgttgaggaaaaatgataaaccctaacaaaaaggccctcaagtggcacgagtgcagggcctgaaagcgttacgtgccatcagttatccaaaaagaacattttttaaccagaaaataaacatgagactcatcccactagtcctaggttcttggagccccacaggtattgttgcaggatgcatcattgcttcgaatcagtgactgaacaacccagttcctaatcagcgtggagagtcagaattgtcacacgcactgggctgaagctgcatattcagtactgcattgaacattcagtactgcagataggataattatgctgtttgtcagatactagaaaagtgcaaagaacattccttcactttgcaacagcttggacccaagtggcagacctgctgttccctcaggctggcgtgacctccctattgtcagccccttcaccacagctcaactacccccctggctttcaagatacagctcaaacagcatctctcctcaggaaagaccttactcccggagacccaggcccgagttgtgttgccactgtaccctgttctgttagcacttaccaggttgcatttttgtgatccatttacctgtcttccctgtcagacatgaacagggacagtgtcttgtcctcaattcatcatttttctcctgttttgagcacaatgaccaggacgtagtggatgctcaataaaggtttgtcaaatgactgatagtatggttagctcagtgagaattgatggtgccctttgtgatctgtcatccatcatccttggtgtgaagcagggctgggaggctttaaacagtgccacttgagaatctaaggagaggtggcagagttacaattaacaataactaccccttactgagtatttatttgctatgggccaagcactctcttagggtttttaaatgaatcaatgcacttaatccttagatcaatctgctaagacgagttctgtttattatcccctttgcaaagcacaaggaagttcagtcacttgcccaaggtcacacagtgacagtgcagagattcataccaatggagacaaccatcacttatctatattccttttagactagttcctggaaagattaagccctcatgtcctgaggcatccatcttaggtaacaatttaacttctctcttgtttctagaatggtattagtgtgttccctacttgggagaatggagaaaatggtcaccagataactttctgtgttttttggttcagatgagataggtagagttagttgacaaagaattgattttatgtatttatttttattttgttttttttgttcttgattttagatggtagtttcggtccttttggaaacatagcattatcctccagccagactgaactatcctactcccatttcctgtaaggacgactgacctcttttttgcctctagacttgtgcatatgctattccctctgcctggaacatacttacctgcttgctcctctttccccaagcccagtcttcacttggttcctcttttctaccatgagccagtttagatgtcatttccctacctgcccaggataggaggttcccacagccgctgggtgtcctgttgtggcactcacaagtgttatagtgctgaaagcccactcctggggtttttatgtgtgcgatgaaggaggtgattatcttttcccagctagttcatatcctagtcctctgagtgtagagacttgtttctttttccccatttgtcccctgcaccttgggcggtgcttggacacaatgtgtgtgttcactaactatttgtggaagaggtgggtgagcgggagttaactggctttaagtctttgagttttgggtttttgaagtagtcaagtccgtccacagtccgtcctgtggacagccattgtttgccatgtcttgtatgtacacacttgcctgggcactgtggggagcagaaagaggactaatactgcccttgtgctgaggcacctacagtctcgggagatgttcagaggacagtgagtcacttcacagcatcagcatggtatagtggatgagtgatgacactgaagatgagcttggtcatattctggcaagttggctgacacctggaagtcccgtccacaccccaagacctcttttcccagggtgtcctgagaaccacccagagcaactgtgaccaatggcgcttgtttttaaagaagtagaaacccaaattaggaagactgagcaaacctcatgcatttggggaagggcttgttggaaagtggaacctgatgtaggtagcaacatgttgaggttagatttaaccaaacagaaagacttcttaattgcttaaagacaaaattttattttataagtggaattagggctttaaatcaaatatgtttgaacgtctttacttggtttcctcaggcaccttcactcatcttgtctaaaacttaattgctggtctatccctgccagatttgctgcttctccttgattccatctctcctttagtggaaccacctggtactcaagccagacacacaggtgtccctcttaattctgtctcctctggtcctgttcaggcacctgttctgtgactctgcctcttttccgtttctcaggctgccttctctcccttctactgccttccttatgtcaggggttggcctactttctggccttcttgatccagggcttcttttgttcaactcatactccaccctgttgtcagagcccatccagattgcagattggagcctatgactcgtctgctcaagggtcttcaaagactttgcagcttttggctgaagttgagccacctggtcccaaatggagccccattcccgccatgccacctcctgtctgtttaagctttacaagatgacttgcagtttcctgtagaaagcatgacttttaaaaaaagacttatttccttctctcctgcatctaactctcacttgctctttaaagccttctctgacctaggtcttgcctgtttctcctgcagaacactgcttccaccattttgtagcatcagtgtctaacattggttggcatgtagggtgtgctctataatccttgttgaaagaataagtgggaggtaacagaggcttaattcacattgagctgtaaacgagcaatatctgactcttctgagaatggattttgtttcaaacactggttacttactggaaaaggtgtctggggagtgctggacagcaagaacaaagggaccccacagaacaggaaaagaggcactctagggtctgcggtttgcctatgttagatcaccgtgaaaaaggccagtgtatgctttggcagctggcaaagaatcctgtgactcagtttccttatttgcacaaaaagggtatgagtctacattaggtaattactcatgctcatttccaactcttgacagtctacgatcctttgtgtcaaagttaaaaatctaagtagggcattctgaattggtgtcagagttgatgcacttctcactgtattgcaagtgccaaggggacaaatacattgtctttttgcattcaacaaagacagttttgcattttaaaaacaaagtagaagggaatacaggaaaactgcattaatacaattttatgctggagaatttaaactcccatgtcaggaaattcactcatcattcccttggcagcttttgtttctctgcactgcacaccccacttacagacagccccttcttgccaaagcccagcccagccatgaccatgagttatggcagattgggaatcgttaccttgatcttctcaacccttgggtgtttaccttttccaagttaatgcctgttctttaatgttacattatcttgtagcaaggtagtcatttataatttatatactagagctgccttaaaatagagacaagaggataatcagcatcctgaaacttctagttttccaaaataacatttcttcagtgaagtctgcctgtaggaattaaaacttttggtgaattaaaaagctttttgtcctattgtcagactgggaaatggatgtgcccattactcagccttaaaaacgaggaaggagatcatctgttaaaaataaaactcatcattttcttttattcttctcaaaataatccctaaagacctcaatctttatagtgttccagtggccccactatagtcagagaggagacagggcagaagttgaaggacagataggagaaacggccctgctaaaagataaaagccagtatgcatctcagctacttgtctgctgtggtcctgatattcttccatctaggttgctgctttgcttgactttgactgcaaacacagagaagggatgggctttcctgttgagtaccttgtagagaacccactgttcattcatatgtgttaaaaatgaaaagcctacttgaaaactcccctgtagaatcaggttttagcaaaaaccaatcaggtatcagaggtctaacttatttttcccttcttggttttatagcaagtctctaaaccctaagattttttgtttgtttgtttgagatggagtcttgctttgtcgccaggctggagtgcagtggcatgatctcggctcactgcaacctccgcctcccggtttcgagtgattcccctgcctcagcctcccgagtagctgggactacaggcatgcgctaccacacctggctaattttttagtattttactagagacagggtttcaccatgttggccaggatggtctcgatctcctgacctcatgattcgcctgcctcagcctcccaaagtgctgggattacaggtgtgaaccaccacgcccggctgcctaagaatttttttcattccttttcattatatacatcttcagtgtgccaagactttgagtggagatttctaatgagggcaggaagggacggatgcttctgcaattgagtggtctcatttttcccatgtctgtcgaaagattactctttcatgaccaccatttctatgatgcatctcatatgatcctaatgcactcgagtttgtatttgaatgtccatctgatatttaggggtggttggggcaaggagggggcaagcagcaactaaggggttgtatgggaacatcctggtggtttaacttgaaagccactaggtggcaacatttactaagttgccagccattctcttcccttaagacattgaacttgcttttccacatagcagatggaatagctgagaaaagagattgccattgcttcaggttcttttgaaagtgaggctataggataaacacactacagtatattgatatctattcgtcacctgggtttagataccaggagtttgaatttgctctgggtgactgggtgagtagcttcccctttggcctcagttaggcatccttgacaggacagacctgtgattggactgtctggtctctcatggttctttttctccatgatttatgactttgattatgatttctttatattaaaaaaaaacttgtagtaaaaccagtcttatttaaaggaatactagccttttatcaaagggcaaagtaatgatttaaaaaaaaaatcaacaacaaaatttcaagggaatgaatgtccctagaagctagccatctccccgagttaacttaagaggctagactctcctaaatgaggatgcttatttaccagctttcctaaattagcagctttggagatgttaaaatccgtaaggaactgtccaagggatgtattgtgtatgctttgcagtgattaagccattaagctctaattggtattttcccactcatgggtttgtaaaggaagctttaaaattatttaggaattcagtcctcatcagctgtcttagtgtcatccccacgttttggaacctgagagtggagagtgcagagaaaaggttttattaatgatttttgctcacagtgtccttccccattggtttgttattgcag

SEQ ID NO: 167 - DNA, 2302 bp, Homo sapiens; identical to SEQ ID NO: 98
  source 1..2302: mol_type = genomic DNA

SEQ ID NO: 168 - DNA, 12172 bp, Homo sapiens
  source 1..12172: mol_type = genomic DNA
gtaagttgtcaagttcatttgaatatcaataagaacaaactacgatttggaaatacatgaggaaatgcctagatgatgagtccagcccagggtcaagaacatgtttttgttccttccaagtactcaatcaatgttagctactctgcaaggttagaggtagatcggaccttggattcatgggacttaatggtcttcatttttatagatgaggactgcaaaagctttgtgaattgctcaaggccgcgaggctagataattaacagagcagggagtagaaagcgattcctcctctaaggctaattccaatattattatagcaggtactaaactatgaaatcatgattcttatggcttaatatgacacctattaaaggctgagtttacttaggttatagctgggcagatttccttttgcagttcctccggtgctgggggatctatggcacagtgtcaggattagtcatttaagcaggattgaggacaaattgtactaagcagttttcagtagatctgtaactagatgataccataaaatgatatattgctccactttatgcatttatgaaaaacatctcattataaagagtttcaactgcaaacattaacaaagatttaaccaaggcaatattttgggtgggacagggagcctttctgccagtgttaaaataattcccttctgcataatagccctgctggcagcctgggatgctcccagttttcaccctccgttaatatatgggccatgatataccataatagtgaaaatgcaaacactagaagttcctcaaagttcaatgtatgaaggcatgaccgcttatttggttgctgatattcctaggacctgttaattaataatttgttctgttacctattagtcattagcactttagtgtgtaatagttgattaggccatttccaaaaaggggtcattatttgtaataattatttacatgtgtacctgcctccatacagtacaaatgcatttaagggcagtgaccatatttcattaatattttattatccagtgcatatttagtaggcacttgataaataagagtccagtaataaataatagaagggaaaagaaaaagaggtttatggaaaaaacagatgttgatccgtaactcttagagagaccaaaggcggcagtaattatttattaaatgccagttctcccaagtacttgctgcatcttatttcttccagttggcttatcttcatcctgtagatgcagtcaagggcagtgggaggccctgcctccatgtctagccacttgaccatttgcttctggcctgcctgcccttccgtggttcctcagaacagagtcaatgtatagacatcttaatgattttttcttctagcaatcagaactcacagaataattaggactattggcacataccacagataaagaaaaattgcactcaagattttttttcaaacagaaacttccatttcctgctgtaaaattttatgattgtaggttgagatctctgagcttaggcttcatcattactaaaccaatctattcagctccaatttgcatacagagagaaaattgtagggttttccttacaagctagcccaattttcagccagcacagaagatttcagggtgatttcagcagccataaggtgaaaaagatgccagtaaattcagaaaaagccacgaagatgccgtcaggttagaagcatctaaagatgattgctaaggaagcactgtgccttctgcttttatggtgtggttctctcctctctctcttttgctggaccacattcttattccatttcctaacactgcatttaaggtttctgagaatatatagcacaagctgcatgagctgcaatgcagagctgtaattctttgctggagcagtttcctcaactctttatctggtcccctcttctggtaaactaatctgaccatgtgtgaccattaggactccttttccttttctccactaagctgtagagccacgtctaagcattattttcaaatctctttcccctaggccctcagtctcacttcacttaacacatctgagctaggctgggcatagtggctcacacctgtaattccagcactttgggaggctgagggaggtggatcacgaggtcaggagatcaagatcatcctggccaacatggttaaaccctgtctctactaaaaatacaaaaattagcttggtgtggtggtgcatgcctataatcccagctactcaagagaactgaggcaggagaatcgcttgaaccagggcagaggttgcagtgagtcgagatcgcgccactgcactccagcctggtgacagagtgaggctccaactcaagaaaaacaaacaaaaaaaaaacatacctgagctaaaggtatgccaaaggggaggacgaagaaaattttgattcctttattcctcttcctcatcttcttgtgtgtcatgatgacattgatggcttctatggccccttcatgtgcgtagggtggaaggcaccagggaaaagactggcccatgaatgagtagcccacaggcctaactcagtactcctgagtctaagctacgccaggggttcagaagggttaatccatgggttcaactgcccagaaagctggactcttttccagtggttaactgtgtattgaaaacagcagtcatgttgttataataaaggcaaacaaggttaatggaatagtctatggatagctgtcacttcttctcttcaaatatcggacactgacaatacgctgggccttggaataaagcagagaataggacaggcaagatcctagtagaaagcaaactcacaataaacttgtaagtaaatcaataaacaaaataatattatttttataccttatttggacctacagatgcccaaggtagtgatacatgctatgaaggcaacaaaatagggtgatgccctatagcctggagtgatgggctgctctaagtggtatagtcaggaaaggcccctgaggagtccacaattgagcacagcctgaaagacaagaagccagagagaacattccgggaggagacaataacaagtgcaacggcccaaagtctggaatggactcagaaggaccttgtcttctactcatttttatttaggggtggacaactgctttcccattaaccagctgtgcagccttgaacagctcactcaagttcagttggtaaaagtagattatcaggctgggaattctaggacatttactcaaattaaacatttgagtccacaaaaatgctactgttgtccacgtcaggaagtggtgacttaatggtactcacttggtacacggctcaacaagtccttttaaggtggtcctgggcatggtccccttcactgcaggttattataaaggtcataattcaatgacaactttaaggcatttagaaggtgacctgaagacaaatacagacaagcactcactactgggtcctggagacaataatgaccttttcagtgataacttgcagcttcttctagaggtgaccatgggccccttactcttcaaaggctttgcttaaggtgaaggggaaatttcttcacccctgtaatgtttattccaaaaagcagagcccaaatgaggacttgtgtgaaggcagtttatgtgagacatgatgagggagtggaggcgagggagtgggcgatgcaacagggaaggagggaaaaccaaagaggtcagttgtcaagatccctggtgtgggggaggccagcttgatgccactgggagcagcacagagaactgtcagcagaggggtcagggactggagcatatattaatattaactgcccctcggctcccgttggttgagcgtcaccccagggggcattaattccccgcacttctggactgtttttgagctcaggccaagctgtctcctgtgggattagagaagttctgggcagaaagcataggaacgtgcggcatgctcttgaaatgacaggtggtcagcctgcagtcatcatctgagctcgtgtatgatcagctgccacaggtatggccgagatcagagacgggctgaagggatgtgacagctccaccagaaaaagaagaaaagaaacttggacagaatggaatcagagagatgggggttggaatcacctccctgaagtcctttaatttattctgttgccagacatccctgacaaatccagacggaaatctagcccgtcggtaactgaatccacgtagaggcctgggggtggaaggacacagttaccacacagagattcgtctcctttcctctgggagatcctgcaagccaggaagcttggtcaaagattaatttagtggattaaaaaaggcgtctctgatgaatgaataaggcaaagttttatgcaattagtgcataataaaaagtaataatgacaaagtccacagctccccaccatctgacatagtgaataaaacaggagatggtatattaactaaagtctatatttacttttagcaaattatgtttttaaaactcaaaaattacaaaaatttagagactaaagagacaaagcattccaacaataagagaagaagcaagagaaaatacagtcttatcctcccacacccaatgttcctgggcacagtgattcctgattcacttagcacagtgacactgggaatggaaataaggaataaaatagcgggaaatgaaatctcagaggcaagtgagattctctgaacttcagtttttacccacataaaatgaggataataatgtcacacttcacaggttgttgggaggaaggaatgggctgtgtgggaaagcgctctgtaagctgcaaggcatcctaaaatgttacaattaatccagagtttgaaatgtagttgtcatattttaaattgttgaaatgataaacaccattccactcattaaaagaaggaagtactgtttatctcaacattgtggagtgcaaagaactttcaaggggccagagagaatcaacaatacgtaaataaggctgggcgcgggggctcatgcctgtaatcccagcacattggaaggccaaggcaggcggatcaccagaggtcaggagtttgagaccagactggctaacgtggtgaaacctcgtctctactaaatatacaaaattagctgggcgtggtggcacgtgcctgtaatcccagctactcgggaggctgaggcaggagaatcgcttgaacccaggaggcggaggttacaatgagatgggcgacagagtgagcctcagtctccaaaaaaaaaaccaaacaaacaaaacaagaaaaaaacaccaaaaaacaaaaacaaacaatatgtaaataaatttctggttacctcacctttgcattattacattgctaacaacagctttggaatccacgtcttgtattgcttttattattgtatctaacagtctttccggagccccattctgattgaggcctagcaagtgtcaggaggtagatcctatacaatcccattcacttatctttcatttcctttggctatttctcattgccttatgcttcacttagctgtgtatgcccattttcttagggtgcgctttatttctttatttttatttttatagagaaagggccttgctctgtcacccaggctggagtgcagtggcacaatcagagctcactgcagccttgaactactgggcccaagcaatcctccctcctcagcctcttcatgctttatttgtatcagaatacactcactttgaaatctgcttcttccctatgacttatgcttaaattgaacgaatcttccagatgttacagagtcagtcagatgttttaaaatgcaattaaaggttttgagatgcagtttgtagaatatttctgacatttgatttcaggtatttttccatctcactgagttcaactcaagtgaacgtagttctgacttcttgggtgaattaaagttcaaagtttccaaaagatagagagataccattgtctcagataaaatgaagctttgtttcagcatacttgaaatattttgtcactgctatttcttctccacagctcttccatagctgtaagcagtctctaaggcatttaatttactgttactttggttttttctttctcaaggaatctcagttctggttctcttgatagtggagtaaagaaatgggagaaggaaagaaatattgaatgagcctcttcttattacaaaatagattactgattctttcagcaggggcttgcagagtttggaaaaggtgtgcaatgagtcagagagttggccagctggtaggcgattccactgcagtctaggccttagctctcaaccctgcaggctaagaaacagattcttagggatgccaagttaaaaaagattgactataaaatcatattgcaaatatattaacttacaacaataaaaataattgtaatgataacagctagtatttcttgagtgctttatagaaattaatgtgtcagatatcaagctaagtacattttagatttgttaacagatttcctgggttggttccaatctctgccatctactaccctgtggtcttggacaaattccttaactttgcacaagttacttgccttatttaaataaggtgataagaagaatgcctggcacatcacaagtactctatttgccactaaaattcactctcacaacacacctataaggtaggtaccattactgttccccttttatggtgagaaaaggaatatttagtgatgttaaataatctgctaaacattccataattagtaagtaggcaactgaaatataatcaggacaaggaaacaaaatccaatgtttaagtctccaggcttagagaatacttctattaaccttgtcaactgggaaggtctttcaataagattatctacctttaaagtctgctgaccatgtctgttctgaaggatagttctcagaaaaaaaacattgccaacatttactctaggacctcccttttttcatgccttcatagctgatgccccactcagcgtgagaggtacaacattcacagtgctcccaaatactctgccgaacagtgccatcagatagaactttctgtgacgaaggaaatgttctagctctacttcgtccaatacagtagccactattcgcatgtggttattgaacacttaaaatgtgactggtgtgactgaggaactgactctaatttaatttaaatcaatttaatttaaatagcctgatatggttgggctctgtgtccccacccaaatctcatctcaaattataatccccacatgttgagggagagacttggtgacaggtgattggatcatgggggtggtttccccatgctgttctcatgatagtgagtgagttctcatgagatcttgttgtttgataagtatctggtgcttctcccttcctactctctctcctgctgccttttgaggacatgctttgctgccctttcaccttctaccacgattataagtttcctgagacttccccagccatgcagaactgtgagtcaattaaaccttttttcttcataaattgcccagtcttggatagttcttcatagcagtgtgaaaagagactaataaatagccatacatagctagtggctactgttttagacagcagagatattcaggaaaaaatatttttttagggaaaaaataatatgagacagttgatcatctctaagagaaattcaaagggatccaatcagtcttgttatgagaacattctgtgtgaatttcactcagcaacaagggtttcctgggtcagctaaataatcctgctcatttcttatctagtatagatgtttctgagggcaaccgacaggtccatttattttggccagtgaaaaacttagtggagaattcttgaaatggaaaattctgaatcattcgtctagcttcatatcctttgggtagctttttcacctatgaccctctcagggaaaggatagctctgggattgtgaggaagggagaacgaggtcagaagtaaactgaggactgaaaatggctttgcagatggtgaccccgatcaagcaattcaaactgaaatatacccatagaccaccactcttttcctctttcttggcaattagggcaagtgtaccttagtttttccaccacgggattttgagtcagaagacctgggttaaagtcccagcttcattccttactaatgggatgactatagacaaatcactgaaactcactgagtttaaaaataggcttaaagatagtggaagttagaaataatacctccctccaagggtgcaagtgaagatctgatgagataatgcatatggaaccgctttggaaacttgtgaaggctatagaaatgtcttagcaatgattattccacttgtatagctcacctttgcctttcaaaattgctttcatatttactatctcattttatcttcagaacaggcctaaatagggcatgaattattatctatgttttaccatctattgatgtggacaaatggggcccacagaagctgagagactcatctaaggttacacagtgcatctcgctacattatgcctgggctccaccctggatcaactgagtccccttctaaagccctcatttctaaaaaacaaccaatagacttaagcttgatgtacaaaagttatgctgaaggataaaatatagaattattcctattcaataagcaacccaaggtacaacatgagtccaaagctgagcaatcataacatcaatgtagtgatgatgggtagccacctgttgtgctaagcattttataaatactattttagttaataatcacgtataattctttgaggttgtatagttatcaaccccattttacaaccaaggaaataaaggcagaaaatggttcaggaatttgtccattgtccacagagctaataagtgccaagacagcctggatgtattagtttgctgggtctgctgtaacaaagtaacatagactgggtagcttaaaccacagaaattatcccatagttctggaggctggaagtccaaaatcaaggtgtcagcagggttagctcttcctgaaggctgtgggtggaggatgtgctccagggctctctccttggcccacagatggccatctccgtctcctctctgtgtgttcacatcaacttccctctctgtgtttctgtctctgtaaccaaatttccagtttttataaggatacaagtcatattggatcttcattttaatttgattttctctgtaatgaccctatcaacaattaaggtcacattctgaggtactggggtttaaggcttcaacatatatacatcctcatcttacaatggttcaacctactatgtttagactttacaatggtgtgaaatagacacttttagcatagttttcaataaattgcatgagatattcagttctttattacaaaaaaggctttgtgctagatgattttgtcttacatggtggtaggcatgtcttacatggtggtagggaagacagaatgagagccaagcaaaaggggaaaccccttataaaaccatcagatcttgtgagacttactcactaccacgagaacagtgtgggggaaaccaaccccatgattcaattatctcctacaggatccgtcccacaacacgtggggattatgggagctacaattcaagatgagatttgggttgggacacagccaaaccatatcaagcattatgctttaaattcttccattttaaatcataccattccattttaaatcataccattctgccaccttttgatggggacaaatgtcaggacccggagcatggcacttgacctccaagtccagttttagagccagtgaacagaaacccaccctctaaaagttcttaaactggaaaagtactcccccaaaatgtttatctaagagactggtttccagcttactaggcaatttggcattaagaactttcctcataaacatttacaaatattctgctccgtaatgaagttaatcagtaaaccacacaacctctgtcctctctcactccttacctagtctcattttcagtggctgtgaataagctaagaatggtaatgcagtttcaggggttagaaaatccaattcaaattagtcctcactgcagctgtacgccgtcaggatttttcatggaaatgatgagtatgaagcccgcgaaaggtaggacactgttcacaggtgctttcaggtcgagctcttgcaactggactgaggaaatctggggactttggttggagatgacagtaacagatgtctgtcaaagatagtggctcagtcagacccagaagactggaatgagagtttgggttggggtgatttttatagggttctaaacagacgaatatcttatggggatgaaatccaaggatgtttcccctaatattcttcatagactcttatgtcaaattatcactattcttccaaaccaaacattagacaattctaatattaatatcaatggacacttgaaaaaacattttaacagacattatttaatgcagtgctcctaaaatggcaagtctcagttcccaggggatcacaaaatttatttagtgtctcgtgaccagcattaaaaactggattagaatataatagaatagaaatattagtgtccctcaaggagtaaagacaagtggtatttcatgaaattttgtttcagttacatgtgtataagtatgtacgagggatatgagataaaatgtatctaaaaccgtaggttgtggtaaaaaaaaaaatgaaaagagtttgggaaacacgaattaatgaagtagtttcacagcaggtttctcccaatagtccatgaaaaatcagataagcacagagttgagctttaggcccaggctcttggttttctctgaattaaaacatcgattataattaaaacacagtataatgtaaatcatattttaatattttttaaaacagaaattcatcttttaaatttccagcaagaaaaaactcgagtcatttttataataatgataattgtgaacatgtttttggtcatagacttggtagcataccattttgtttaaatgcgatgtttaaaagtgaccgacactgtatttagaaatggaaatgagttggaaggccggggaagcaaattttctatttacttcaatttaaccaacatttaataaacatttactatgtgtcagccattgagttagatgccaggaatataaagaaaagaatatagtctaatattttccctcaaagagttcacagactaatcacaacaatcacaaaagtatacatgtgtatgtggtgtcaggcactatgcagtttccattctttgtcttagttcatctttattacagcctctcatgcaggcactacattctttcagctttgtaaaggaaggaacagaagcttaaagaagttccatgtctttcccaggttcatatacctaacaagttgtgggtgaaatgaatccagatttgtctgctcagagggcactcttaggtagtatctcataccatctcaagttcagcgtggaagataagcctgtaaacaaaagaaatgattgtatgtgcttccaataagtgccataatagaagtgtgtacagaggtaggagaggtgaattccacctgggggaactggggcagacctcccagagtaggtgaccagaagtaggtgatcagctgacaaggcagggagaggcactgacatcacaaaggcctgatgccaggaacagcaaacaactttgcagtaaagccctgccatttagtgaagaaaccatggattaagaaataaaggaaggcaaaaaaaaaaagtgacttttctaggcactgcaattcaacagacattcattaaacatttactatggtcagcattgtgccaggaatgaaaaactggatataaactggaccctttcttaggagcatcagaaactcactgtgagattatgggggagtgccattgtttttatgcaaacctgatttcccatttgggggtacagtggttctggtcccaaactccttagagctgcactggctaatatgccacatgtggctattcaactttaacttagaattaaataaaatttaacagtcagactctaagtatcactagccacattccaagggttcaatatccctatgtggttagtggctaccatattggtaggtacagaacccttctatcacctcagaaagctccctcagatggcactcctttagagaaggtgttgaaacctggagactgtctaaccagaagaattttactttcttttcag

SEQ ID NO: 169 - DNA, 55853 bp, Homo sapiens
  source 1..55853: mol_type = genomic DNA
gtaagcagtttttggtacaacttaaatatatacatatatgtatatatacaggccacttaaagggaaacttgtaacaaatttgtttttggttgcttatcagttcacagctgaaatcctattgctaatcataagctttgggcaaaattttactttgatttttaaatttatctctgttgtatgaatttggttgttttaagctttttccaaataactcttcattgagagtaggctaatgcttttaaaggcatttgattgagttcaggtttaatttctcaagttggaggtatacatatatgattaaaaaaaaaaaaaaaagatgggttttggcctgccagcaccatgagtgcaggtgaaccaatttagtacttggagtcctgttgctatatgtggcagattatttttttacttgatgacttgactcttacttcaggttgaagggcattttgaacacagattaaagtggctaagatgaagttttcttggacattgtcaaaatctaaattaggctagtttttctgaactacctgttttgaaggtatagcatcctgtgcttttgataactgccaccattagctcttttttttttttttgaggtggagtctcactctgttgccaggctggagtgcagtggttgatcactgcaacctctgcctcttgggttcaagcaattctcctgcctcaccctcccgagtagctgggattactggtacccatcaccacgcccggctaatttttgtatcaccattagctcttgaagtttttctagttttgttttgttttattttattttattttaacagaaccctaactaagacaaagttttatatttatttattgtttagagactggccttgtcatgttgcccaggctggcgtcgggactcctgggctcattcgatcctcctgcatcagctagaactacagtagtttcagattttgaagtgtgtatgtgtatgtgtgatatgtatatattccgtgtgtatagaaatggagagtatcttatttgagttgttgttttcagtaatgctgtcaagtattgttagagggtgataaatgataacatttgtttttatttgagcttatgaagaatttcttgactttctagctaaatgatcagttcacttctcttagcctcaattttattgcgtctaaattccagaagttcttgattgctataagattccttcagctttaaatattaatatttgatattgattttgtttctgcccaaacacattgtttggtcaccgccggtaatgttagcaaagagaattttttttggccaacaaatgtctcataccacattcagtttttataagaaaaacttttatggtatgttgttattctgagttcattaaacattcgctttaccttatatccctgctgttctttaaagttacagagggagaatgtgggtgtgtcacttttgtttctgttgatttgtatcttaattatgccttggtactccttggtttcttggcaattgcagatttaaaaaaatttgctttagtggttatcttgagtctgaattgtcctacacattagggtgggtaggctgttttgaaaacctattggcagctcagacaaatcctttttcttgggttcacgttgaaatttattttatatatatatcgtgtctttgtttttgcacataaatttaaatctgagaatggagatagatgtttctctagaagcatacaaatagaattgtaaacctgtttctcgtcaaagagatgttagtggagtattggttctattaaaaaaaaaatgaaggctgagtgtggtggctcacacctgtagtcccagcactttgggaggctgaggtggacagatcacctgaggtcaggagtttgagaccagtctggccaacatggtgaaactccgtctctacaaaaattagccgggcgtgatggtgggcaactgtaatcccagctactcgagaggctgaggcaggagaatcgcttgaacccaggaggcagaggttgcagtgagccaagattgcgccattgcactccatactgggaaataagagtgaaactctgtctcaaaaaaaaaaacaacaaaaaaacaaacaaacaaacaaacaaaaaactgaaaatattggagcctttagatagtaggttacatgtctaaaatgggagttagcaaatgtataaatgtagaagtttttttttcagggagaaattgaaattgctcaaagactttatcaccttgaagaagcaagtatgtagtttatttatttttttgagacacagtcatgctgtcacccaggctggagtgtagtggcgcgatctcagctcacttcaaccacctcctcctgggttcaagcgattctcccacctcagcctcccgagtagctgggactacaggtgtgcaccaccatgcctgactactttttgtatttttattagagacgaggtttcaccatgtgggccaggctggtcttgaactcctgacctcaggtgatccgcccaccttggcctcccaaagtgctgggattacaggcgtgagccaccgtacccatcccctaatttattattttaggaatttggttcaaagttgtgattgaaatctattgcctttatttttgcctttgatatttttaaactgaagacatttttttttttgagacgaagtttcactcttgttgcccaggctggagtgcaatggcatgatctcggctcactgcaatctccgccttctgggttcaagcagttctcctgcctcagccttctgagtagctgggattacaggtgcgcaccaccaccccagctaatttttgtatttttagtagagatggggttttaccatgttggcccagctggtctcgaactcctgacctcaggtgatccacccgcctcagcctcccaaagtgctgggattacaggtgtgagccacggagcccggcctcagactgaggacttaaaaagtgaggtcagggtgggcatggtggctcacgcctgtaatcccagcactttgggaggctgaggcgggtggatcacctgagatgaggatttcaagaccagcctggccaacatggcaaaaccccgtctctactaaaaatacaaaaaattagctaggcatggtggcaggagcctgtaatctcagctatttgggaggctgaggcaggagaatcacttgaacccgggaggctgaggttgcagtgagctgagatcgccccattgcactctagcctgggcaacaagagcgaaactccctctcaagaaaaaaaaaaaccatcctggccgacatggtgaaaccccgtctctactaaaaatacaaaaattagctgggcgtggtggcaggctcgggaggttgaggcaggagaatcacttgaacccgggaggcggaggttgcagtgagccgagattgtgccactgcactccagccttgagacagagggagactccatctcaaaaaaaaaaaaaaaaagcggtcaatcttagaatgcaaagttaggtaagcaatacagcttgagaaaagtgtaattaaaaataacttttctatgtagtcatgtgatattaatgtattcaacttgttcacagttgatttaagttattgatatagtaggtattgttactatgctgggaattttagaaaatccttagcaaattgctatttgtctctttttgtctgtaattttggctgggcttggtggctaacacctgtaattctagcaagttgggaagccgagacaaaaggattgcttggggcccagagtttgaaactagactgggcaacatagtgagatcctgtctctacactcagttggttgtggtggtatgcctgtagtcccagctactcaggaggctgaggcagtagtaggatcacttgaggccagaagtttgagactgcagtgagccatgatcatgccactgcattccagcctaggcaacagagcaagatcctgtcaaaaaaaaaaaaaaaggagaaaattctcttggcagtgggtaagagtagttattagggttgtagatttcctgtctggaattagagaaagaagggtcatattttctgttattttgtgtatctacctctaagtggactgtttgcctcttgtcacgaattagtagcctcttcagtttaccatcatgtgctcttattttctctgcatacagtgaagtgattgtcattacaatttataatcctgacctggtacttttatatttaattgggctgatattttctaattcttcccagtgtacaaaggttttatgctttgttgttgttgttgagacaggctaggtgctttggatgtggagaattaaatgagcatggcattttcagaggatacttgttggagattgcttgggtaggatggatgtagtcaggtaatggggcctagaaattcagactgaagcatttggtattgatgtgatgggaactggcagcccttgagagattttagctgagaagtgatgtaaaatctgtttggaagactttgagtagaggagattagaggcaaggttaggatgtagggtatgttgcaatagtaattaagacttaagaatcggcccagtggcatgtacctgtagtcctagctactctggaggccgaggcaggaggatcacttgaggctgcaattagctgtgattgtgcctgtgaatagccactgcactccaacctaggcaatataatgagattctgtctcttaaaaaaaaaatgagcacagtgagtactctaaagaaagggggtaaatctaaaagattatttcaaagggagaaaattggcagctttttgggggctacctgatctggaggcagattggagtctggatttgaggaatggagagagatgaggcagatgatgtctaaggcttatagttttgctgcctgagacaaaaatgattcctcagaggttccttcctcttctctacccatcatcccacaattttctactccctccttagctatcttggaagaaaattgatctcttcacacctgaggttctgctctctctccgattccctcctggctgggtgaccttttttgtttgtttttgtttttgttttgagacagagtctcactctgtcacccaggctggagtgcagtggggcgatctcggctcactgcaacctctgcctcccaggttcaagcaattctctgcctcagcctctggagtagctgggattacaggcgcccgccaccgcaaccagctaatttttatatttttagtagagacggggtttcaccatcttggccaggctggtcttgaactcctgacctcgtgatccacccgccttggcctcccaaagtgctgggattacaggcgtgagccaccgcgcgcagcctttttttttttttttttttttttttttttaagatgaattcttgctctgttgcccaggctggagtgcagtggtgtgaccttagcccacggcaacctccatctcctgggttcaagagattcttgtgcctcagcctcccaagtagctgggattgcaggcgccctccaccatgcttggctaatttttgtatttttagcagagagaggtttcaccatgttggccaggctggtctcgaacccctaacctcaagtgatccacctgcttcagtctttcaaagtgctggaattacaggtgtgagccaccacgacctgcataccacttctcaaacagtccttttttgcgtccttgttctctttttcttcctctttctctgcagtctcattcactttcattgattctgctgctactccactctatgaaactctcttctgaactgacttcaaaccaacaaattctacttgtcaactaagctgctcctctaccttgtgttatattcacctaaaatgtaatattatttccttttttatttttcctttggacagggtctttctctgtcacccaggctgtagtgcagtggtgccatctcggctcactgcaacctctgccttctgggttcaagtgattctcctgcctcagcctcctaagtagctgggactacaggcgcccaccaccatgcctggctaatttttgtatttttagtagagacagggttttgccatgttggccatgctggtctcaaactcctgacctcaagtgatacgcctgcctctgcttcccaaagtgctgggattacaggcatgagccactgcgcccagcctattattttcattttgaacccatctcttttattgccaaacacgcatttacttctgtgttcatgatgacatcattatcctattcatctcaaagctggaaaccttgcagtcaatcatttaaatgattaaaatacatttgagtacctcttgagccaggcactgccagtataataaaaaataaaaaaattaaaaaaaggaaagagatagtttgcttttaaggaacttcactgtgtggcaaaaactagtgtaaacaatgacaatacagaatactaagtggtctggtaggtgttatgtatgcagtactttgggagtgtggaggaaggcatgcctagaataatcagggaggacttcacagagtggttatttatagtttaagcagagacataccagtaagagggaatagcatatgcaagtggccagaaatccttggctagctatctgggaggagtggggttgtcaggagataaaggtataaagataggcttatatgccgtgctgtatagttgaatgtttttactattacaaaattttacagatgccctcagtttctccctttattcatttttctatgacatctttattgttggtcttcatttagtctttccttccagtctatcctgtgtaaaattacttcctacttccaaaatgagaaatactgggtctctacttaaatttgtaacctaaatgcctcacacctcattttctgaacaaataaagcccaaattcagtgtcctttttgataggatcctgtcctgacctttccaaatctgatgctagagccttgtgtaccctgagttcagccaaactgaactcttaatggtcccttgctccatactctccccttgctcatgcctttattctcctggtctgattcatctttgcatcttaacagtgtatagcatggtgccttctttttactggggacatatcgagttaatgaatgaatgatgctattacagaggtacagtttgggaaggggagtgagtacattttagaaaggtgataagtggattgtcagccttcatcattttcaatggaccaaattactaaaactttacaggttggttggttttttttcttttttcatttcctcatgtactcaatttctaaggctttttgaatttgagcttcctaatatctcatgcattaatttttttctccattctcaactttcactcttttaattaaggataataatttttttttttgagatggagtcttgctctgttgcacaggttcgagggcagtggtgcgatcttggctcactgcaatctccgtctgccgtgttcaagcaattctcctgcctcagcctcctgagtagctgggattacaggtgcatgccaccacgcctggctaatttttgtatttttagaagagatggggtttcaccacgttggttaagctggtcttgaactcctgaccttatggtccgcctgcctcagcctcccaaagtgctgggattacaggcatgagccactgagcctggccaaggataataaattataatggttttaggttggacatctctgactgcatactgcactgtgtttactggaagaagtcccttaatgtctctaaggcccatttcctcagttctaaattacggctagtaccttcattggagggttgttaagtctatgatacaagataactttttttttttttttttttttgagacagagtctctatcgcccaggctggagtgcaaaatggcacgatcttggctcactgcaacctccacctcatgggttcaagttgattctcctgcctcagcctcccaagtagcttggattataggcatgcgccaccatgcccgactaattttgtgtttttagtagagatggggttcaccacgttggccaggctggtcgaactcctgacctcaggtgatcgacccacctcggcctcccaaagttgctaggattacaggtgtgagccatctctcctggccatgatacaagataatttatatgaagtaatacactgctggttctgaagtaggtgtgcagtaagtgatgcctactgctgcatgccaagagtcaaatgtatatttgaaagagttgtgaatttcaagaaagatatttttgagtttttttttttttctttctgagacagggtcttgtactgtttcccaggctagagtgcagtggcctgatcttggctcctggctgggcccaagtgatccaccgccctcagccttccaacgtattgggattacgggaatgagccactgcatttggctaagtttttgtttttttttttctctatttttccaaacttatttgattagtaagataaagacattaactgctgttgacagtttccatttttaattagtaatcaggagcatttgttgtatttttgtttgataatcagaataatttaatttgtgcaataggatcaatagctttctgtattccaactgttaagtggtgtaagtttattacattgttgctttttgcaggttgtcctttgttctagatagaaatgtttaatttattcttcctggttttcaggggagcccattgaaaggagatccagtctctgaaatttagtggtaggataataacaattgaacagttacttttgaatctaatttaaataatctcaattgtagccttttaaagcaattcctatgaacctttttgaatttagaaaagtaatacttggccgggcgcggtggttcacatctataatcccagcactttgggaggctgagggggtggattatctgaggtcaggagttcaagaccagcctggccaacgtagtgaaaccctgtctctactgaaaatacaaaaaaaaattagctgggtgtggtggcacgtgcctgtagtcccagctactcaggaggctgatgcaggaggatcgcttgaacccaggaggcagaggttgcagtaagctgggattgtgccactgcactccagcctgggtgacagagtgagactttgtctcaaaaaaaaaaaaaaaaaagtcaaacttaaaaatggaatataaaaatctcttgatttttgtcagttttcatatactccctcatttacactcttaatattctattagaaattgtctcttctctctacacacccctttttttcccttttggttaatatgttaagacatcttttcatatgagcatgtaacatgtaacaagattttttttttttttttggacagtgtctcgctctgttgctcaggctggagtctagtagtatgatcacaactcactgcagtttagacctcctgtgttaaagtgattctcctactttagcctcatgagtagttgggactacaggcccatgccaccacgcctggctaattaaagaaaaaattatttggtagagacagggtcttgctatgttgcccaggctggtcttgaatttctggcttcaggcaattctcctactctgcatgagccacctcagccgcgaatattttcttattatgaaatttttgtttagataaatgttgattcacatgcagttgtaacaaattccatggccaggctgggcgtggtggctcacgcctgtaatcccagcactttgggaggctgaggtggatcacctgaggttgggagtccaagaccagcctgaccaacatggagaaaccccgtctctactaaaaatacaaaattagccaggcgtgatggtgcgtgcttgtaatcccagctacttgggaggctgaggcagaagaatcacttgaacccgggaggcggaggttgtagtgagccaagatcgtgccattgcactccagcctgggctagaagagcgaaactccatctcaaaaaaaaaaaaaaaaaatcaggaaattccatgggctaggcacagtgacttatgcctgtaatcccagcgttttggaaggctgaggttggaggattgcttgagcccaggagtttgaggctacagtgaacactgactgtgccactgcactccagcctgggtgaccctgtctcttaaaaaaaaaaaagaatacagagaggtcccttgtatattttgcctggttttgcaatggtaatattttgcaaaaaatatctaataccacacaaccagaatattgatgttgatgtacttcaccaatcgttttttttttttttttttgagtcggagtctccatctgatgcccaggctagagtgcagtggctcaatctcggctcactgcaacctccacctcctgggttcaagcaattctcctgcctcagcctcctgagtagctgggactacaggcgtgtgctatgacgcccagctagtttttgtatttttagtagagacggtgtttcaccgtgttatccagggtggtctcaatctcccgaccttgtgatccgcccgcctcagcctcccaaagtgttgggattacaggcttgagccaccgcgtccagccagtcttacttaggcattgacgttcatgtaatttatccatcttattcagatgtccttaaattttatctttttccttaaaagaaatctgtatttctatcaggacattctggatgtccccagttttactggtagtctttcattgtgtgtatattaagttctttgtttttatcacctgtataggttagtatatccatgactcccgtcaactttctaaatgttcgctgggtgcagtggctcatgcctgtaatcccagcactttgggaggctgaggcggctggatcacctgaggtcagtagttcgagaccagtctggccaacatggtgaaaccccgtgtctactaaaaataaaaaaaaaattagctggatatggtgggtcatgcctgtaatcctagctactcgggaggctgaggttggagaatcgcttgaacccaggaggcggaagttgcagtgagctgagatcgcgccgctgcactctagcctgggtgacagagtatgtctctgtctcaaaaaaaaaaaaaaaagttgctaaacatttctaataccataaggatccctgctgttgccagccgttttaaaactacatccatcgtcttcttggcaaccttccatctctttttcgtatgtgacagcgtcttgctctgccgcccaggctggagtgcagtagttgcatctcagctcactgcaccctctgtgtcccaggcttaagcgatcctcccacctcagcctcctgattagctgcgactacaggcacttgccaccatgccccactaatttttgtatgtttttgtagagatggggttttaccatgttgctcaagctcgtcttgaactcgtgagctcaagcaatccgcctgccttggcctcccaaatggctgggattacaggcaggagccaccatgcctggcctagcccctccatctctagcctttgtcagttactaaactttttttcctgaagttttgtcatttcacaaatgttagataaacatgagtcatacagtatgcagccttttgggattgtctttttttcccttagcataatttccaggggattcatctaagttgttgactaaatcaatagttgttttttttgtttgttttttttttgagacggagtttcactcttgtggaccaggctggagtgcaatggcatgatcttggctcactgcaacctccgcctcccaggttcaagcgattctcctgcctcagcctcctgagcagttgggattataggcccctgccaccacacccagctaatttttgtatttttagtagagatggggtttcaccatgttggtcagggtagtcttgaactcctggcctcaagtgatctacctgcattggcctcccaaagtgctgggattacaggtgtgagccactgcgcacggccctagttttttcctttttatcactaagtaatattccatgatacaaatataccatggtttgcttgaccgttcacctgttgaaggacatctggggcaatgctagcttttggtaattaaggtaaaagtactatttatgttcatttatggggttttgtgtgactgtaagttttcacttctctgggataaataccagtagaacaattgcagtattatatggtaatggcatgttaagttttttttttttcctgagagggagtttcgatcttgttgcccaggctggagtgcaattgcgcgatcttggctcgctgcaacctctgcctcctgggttcaagcgattgtcctttctcagcctcgcatgtagctgggattataggtgtcaaccaccacacccagctcatttttgtatttttagtagagatggggtttcactgtgtttgccaggctggtcccaaactcttgaccccaggtgatccaccctcctcagcctcccaaagtgctgggattacaggcgtgagccacggcgccccgccaatgttcagttgtttttttgtttttttgagacaatctctctctgtcacccaggctggagggcagtggcgcgatcctggctcactgcaacctctgcctcccggattcaagcgattatcccgcctcaggctcctgagtagctgggaccacaggtgcacaccaccacaccaggctaatttttttatttttagtagagacggggtttcaccatgttgggtcaggctggtctcgaactcctgacctcaggtgatccacccacctcggcctcccgaagtgctgggattacaggtgtgagccaccacgcctggcccaatgttcagttttataagaaactaccaagctgttttccctagtgtctgtaccatttacattctcactagcagtatatgagtgatccagtttcttttattttttgttttttgagacggagtctcgccctgttgcccaggctgaagtgcagtggcacgatctcggctcactgcaacctctgcttcccggcttcaagtgattctcctgcatcagcctcccaagtagctgggattacaggcatgtgcaccatgcctggctaattttttgtatttttagtagagatagggtttcaccatgttggccaggctggtctcgaactcctgacctcaggtaatccacccatcttggcttcccaaagtcctgggatttcaggcatgagccattgcacctggccgagtgcttcagtttctatgcatcctcaccagcatttggtgtggtcactattttaattttagccattcgtgtagatatgtagtaatgtctcatctcattatgttttgtttttttttttgagacggaatgttgctcttgttgcccagactggagtgcagtgatgccatctcggttcactgcaacctccacctgctgagttcaagcaattctcgtgcgtcagcctctggagtagctgggattataggtgtgcatcaccacgcctggctaatttttgtattttttagtagacatggggtttcaccacgttggccaggctgttcttgaactcctgacctcaggtgagctgcccacctcggcctcccaaagtgctgggattacagttttgtatggtggattccatgcagagagagttttttctgtagtctagattagcagtccccagcctttttggcaccagggaccaaattcctgggaaacagtttttccacaggtgggagtgggatggtttggggatgaaacttttccaccttagattatcacgcattagttagaatctcataagaagcgcgcaacctagatcccttgcatttgcagttcacaatagggttcatgatcctctgagaatctaatgccacccctgatgtgacaggagtgggagctcaggcgataatgctcccttgtctgctgttcacctcctgctatgcagcccggttcctaacaggctgagaggaccagtaccattctgtggcctgggcgttggggacccctgttctagatgatccacattcttttaaatgcctatatacaaaccatactttctttatttcttttctttttttgagacagtcttactctgtcacccaggctagagtgcaattgcgtgatcttggcacactgcaacctctgcctcccaagttcaagtgattctcctgcctcagcctcccgagtagttaggactacaggtgtgtcccaccatgcctggctaattttttatatttgtattttttaatttttatttatttatttatttttttgagatggagtctcgctctgtcacgcaagctggaatgcaatggcacgatctcggctcactgcaacctccgcctcccgagctcaagcgattctcctgcctcagcctcctgtgtagctgggattacaggcacccgccacgacgcctggcttttttgtatttttgtagagacaggttttcactgtgttgtccgttctggtctcaaactcctgagttcagggaatccaccgccttggcctcccaaagtgctgggattacagtcgtgagccaccgcgccctgccacaaaccatactttgaaaacgttgcttccatttttagataatttgttaggaaaccaataaaatcatacatacttgtgattttcccttagtaaaacacaaattttagtgttttttgctgttattattaatacttctaaagttcctttcacattgctagtgaccttatataaaataccataatgctcttctagcaattgctggaaagataaaatctattttagagaatgaacaattatattttcacattagattaaattaaaagtaattactggttatgtgatattccctcacataccagagtgagtctgaaggtagtctttctttgtaaattatgaggctatatttcctgtgttatctctgatttctcttgatgctgtaattggagttgttgggtctccctggtgaaagtaggtgatgtgcaagttgtgtctatacccagtgaaaataacagacattaatgctacactaatttgtcattggaattttacattcaaaagcatttctttttaaaaatatgattgtaaattggtaatttatagttgtatataccaaaggcatttctttaacgttatagttggttcaactgaaaatacgttaagtctgtttttataattagtatattgaggaacagcacttccatcgtgtcacaatatattaagaattgccagcagggcacggtggctcacgcctataatcccagcactttgggaggcctaggcgggaggatcacctgaagccaggagtcgagaccagcctggctaacgtggccaaacccctatctactaaaaatacaaaaattagccaggtgtgatggcgggtgcctgtagtcccagctactcgggaggctgaggcaggagaatccagaattgaattgaacccaggagacggaggttgcagtgagccaagattgtgccattgcactccagcctggacaacacagcgagactcagtcttttttatttttatttttatttttgagacggagtttcgctcttgttgcccaggctggagtgcaatggcacagtctcggctccctgcaacttctgcctcccgggttcaagcgattcacctacctcagcctcccgactagctgggattacaggcatgtgccaccacgcccggctaatttttgtatttttagtagagatgggatttctccatgttggtcagacttgtctcggactcccaacctctggtgatctgcccgcctcggcttcccaaagtgctgggattacaggcatgagccaccgtgcgtgtccttttttttttttttatcttttgagacagggtctcactctgttggctaggctggagtgcagtgatgcagtcacaactcactgcagcctcaacctcccagtctcaagcaatacccccacctctgcccctttgagtaggctgggactacaggtgtgtgccttcatacctagctaattttttttgttttgttttttgagacagtcttgccccatcgcccaggctggagtgcagtggtgccatctcggctcactgaaagctccgcctcccgggttcacgccattctcctgcctcagcctcccgagtaactgggaccacaggtgcccgccaccacacccggctaattttttgtatttttagtagagacggggtttcaccatgttagccaggatagtctcgttctcctgacctcatgatccgcctgccttggcctcccaaagtgctgggattacaggtgtgagccactgcacctggccatgcccagctaatttttgtatttttttgtagggatgggatggcactatgttccctaggctagtctttaattcttgggttcaagtggtcctcctgcctcggcctcccaaagtgttgggattacaggtgtgagccactgtgccgagccaggttgtgtgtgtgtgtatgtatgtatgtatgtatgtatgtatgtatgtatgtatgtttgtatatatttatatttatttttttggaactgcatctcactttcatccaggcccgaatgcagtgacatgatctcagctcactgcaacttctgcctcctgggttcaagcgattctttttttttttttttttttttgagacggagtctccctctgtcgccaggttcactgcaagctctggctcccgggttcacgccattctcctgcctcagcctcccaagtagctgggactacagatgcccaccagcatgcctggctaattttttgtatttttagtagagatggggtttcactggggtttcaccatgttagccaggatggtcttgatctcctgaccttgtgatccgcccgcctctgcttcccaaagtgctgggattacaggcgtgagccactgcgcctggccatttcttttttttttttggcaagtgattcttgtgcctcagcctcccgagtagctgaaattataggcgtgtgccctcaacgcctgggtaatttttgtatttttagtagagacagggtttcaccatgttggacaggctggtctcaaactcctggcctcaagtgatccaccctcctcagcctcccaaagtgctgggataacagctgtgagccaccgtgcccttcccaggttttatatttattcttttttccttttaaattatgtttttatttaggtattgtacgtaaagtgcttttctaacagagctttggggcagaagtgttagggcaggtcattaaaccactgaaattagttctttggaggagaagataattgttagagttgtaagtgaagtcttgatagataccttatcaatttcatagtaatgtctgtggaatttctttttctgttttttttttttttaattatttcttgaggattaactgctgatagtggaatatcatatatatagttggctcttgatgtacttatttctggatggctttccaaaaggattttaccattttacacacagttctaaatagtatatgaatttagcatttgtcccacacttagatagcactgatttttttttttattaagtgggtgcaaaatgctactacaagattgctttaattactacagttttattgatgaaaatgatttctacttgtttactgtttgtatttttttctaggagttttgtgtctatattctttgctgatgtatctttttggatttaatgttttatacatattaaatttctgtctcattggatataaatattttcccaatctggttttcattttagttaatgattttctgtagttgtatagtcaaagtttcatttattatatagctagatctgtgttttcgagtgatttattgattcaaagcttattgtgcttctagatatttgataaactgactttagactcttgtaaaaatttgaagaactcatatctactacagtcttactgatttaataggggttttaatatccagtactatgctaataatttttatagtgtttttacgacaattttttgagaacataagtttttagagctgtggatggaatgttttctgctctatcagttatcccttctgcgtaacagacccctaagtgtagcagcttagaggagtaaatatttattatctcacattttgtaaggaatcatggagtggcttagctggatggtgctggctcagtctctctaatgaatttacagtcaagatgtctgccagggctgcggtctctgaaggctgtaggatccctgtccaagacggctcactcatatggatgctagctctttgtatgaggcctgttctttcccacttgcacttctccataggcctgcttactgtatggtagctggcttttcccggagtgagtgatccaagagacagggacagaccaagcaggaagatgcagtaactttttatgatgtgtattctattggctggccacacataccaagcagatagggaagggattacacaaaggcatgaataccatcaggctgggataattgggggccagcttggaatctggctaccatatccaaccaaataagaaattaatagttttaattaaaggaaaaggattatattaaatagacattcgttagtttttacttttaagctgacccaatcatttttcagattgaagttttgaatagatatatgattaaaaaatacatgaaaagttaaccagtgaagtgacctctgtgccatgtttgctcaggtaacgcacctccaattcttgtgctttcccggagaccaccttttttaagagaaaggtagtggactgtgcacacttggtcttcctttttcacataatggtgtatgttgaaatctttccattttagagcatagctttccctttttaattttattattattattatttttgagacagagtctccctctgtcgccccagctggaatgcaatggtgcgatctcggctcactgcaacctccagctcctgggttcaagtgattctcctgcctcagccacctgagtagctgggattacagtcgcctgccaccatgctcggctaatttttgtatttttagtagcgacggggtttcaccatgttggccaggctggtctcgaactcctgacctcaggttatccacctacctcagcctcccaaagtgctgggattacaggcgtgaggcaccgtgcccggcaattttttttttttgagtcagagtcttgttctgttgcccaagttggagtgcagtggtttgatctcggctcactgcaacctgtacctcctgggttcaagtgattctcctgcctcagcctcccgagtagctgggactacaggcatgccccaccatgcttggctaattttgtattttagtagagactaggtttctccatgttggtcaggctcgtgtcaaactccctacctcaggggatccgcccaccttggcctcccaaagtgctgggattatagacgttagccaccgcgcctggcctaatttttgtattttcagtagaaatttttgtatttcactgtattggtcaggctggtctggaactcctgagctcaggtgatccacccgcctcggcctcccaaagtgctgggataacaggagtgagccactaggtgtgacctaatttttgtatttttagtagagatgggatttcaccatgtcggctaagctggtctcgaactcctgacctcaggtgatctgcctgccttggcctcccaatgtgctgggattataggcataagccaccgcactggctttttttttttttttttttttaaacctggatggttttattttgcatgaatgtatagatatttcctgttcatacattctgaaagtgaacaactgtatatatgcaatttatttttattcttatttatttatttgtttattttttgagaccagagtctcactctgtcgcccaggctagagtgcaatgacacaatctcggttcactgcaacctctgcctcctgggttaagcaattcttctgcctcagcttccccagtagctgggattacaggtgtccgctaatttttgtatttttacaaaatacacccaggtaattttttgtaattttggtagagacaggtttcaccatgtcggccaggctggtctcgaactcctgacctcaggtgatatgcccgactcagcctcccaaagtgctgggattacaggtgtgagccactgcgtctggcctgcatggggattcttaatgaagattaattattgtagttgagggggaaaaggaataataaatatttattggaccctaaataccttcgaatatggaataccctaggtattctagggcatttagggaccaataaatatttattcctccgtactcttccctcgctcttttcagatttttttttttttttttttttttttgagatggagtcttgctctgtctccaggctggagtgcagtggcgcgatcttggctcactgcaacctctgcctcctgggttgaagtgattctcttgcctcagcctcctgagtggctgggactacaggtgcataccactatgcccagctaatttttgtattttttgtagagacaggctttcaccatgttggccaggatggtctcgttctttagacctcgtgatctgtcttcctcagcctcccaaagtgttggaattacaggcgtaagcctccgccgggccttttttagatttttaagagaatttttgttaaagcatgaacttaaaaaatcagacttggcttggagcggtggctcatggcctctagtcccaggactttgggtggctgaggcaagtggattgcttgagcccaggagttcaagacctgccttggcaataatatcaagaccccctcttcatgaaaaacaatcaagctaatacttgatactattttacataagaattttttatagtatgtcatgttttaatgtatattggttatatagttgcaaatttaaaggcatggtggtggctcatacctgtaatcccagcactttgggaggctggggcgggcagatcttctgaggtcaggagttcaagaccagcctggccaacatggtggaaccccgtcttaggctgaggcaggagaatagcttgtgcccaggaggcagaggttgctttgagctgagatcgcaccacggcattccagcctggaggacagagcgagactctgtctctaaataaataaataaataaataaatgtatactaactgcattagcaagactccgtctctaaataaataagtgaataaataaatgtatactaattgcattttaaaaatcaaagtataggccgggtacggtggctcacaactgtaatcctagcacttttggaggctgaggtggatggatcacctgaggtcaggagtttgagaccagcctgaccaacatggtgaaactttgtctctactaaaaatacaaaattagctggtgtggtggcgcatggctgtaatcccagctactcgggaggctgaggtaggagaattgcttgaacctgagaggtggaggttgtggtgagcggagatcgtgctgttgcactccagcctgggcaacaagagcgaaacttcgtctccaagaaaaaaaaaatatataattcacataagataaaattcaccctctttggccaggcgcagtggctcatgcctgtaatcccagcactttgggaggtagaggtgggcagatcacttgaggtcagggagtttgagaccagcctggccaacatggtgaaaccccatctctactaaaaatacaaaaattagcccggtgtggtggcatacacctgtaatccacctactcaggacgctgagtctgcactcagtccctgggctacagggtgaaactgtatctcaaaaataaagaataaaatgcagctacttaaagggtgtagagttgaacaactgttaccactgtctaattccagaacctttcatcaccccaaaagaaaacccattcccagcagtcatttcccattaagtctcctctagcccctcacaaccactaatctaattcatgtttctatgtatttgcctattctaggcgtttcatacaaatacagtcatataatttgtggcctttcgtgtctgacttgtttaacttagcataatgttttaaggcccatttatgttgttgtatgtatgcatacttcattccattttactgctgaatattgctttgtactgatgccactttttgtttgtcttttcatcacttgacggacattttgtttcttccactttgtggctgttacaggcagtgctactgtgaaaatttgtattaaagttttagcgtgaatatatgttttcagttctcttgggaaaatacctagaagtggtattgtcggatcatagggtcattctatgtttagcattttgaggaacagccagactgttttacatagtggttgcaccgttttacagtcctactttagcctatatgggttctaatttctttctttctttctttctttctttctttctttctttctttctttctttctttctttctttcttttctttcttttctttcttttctttcttttctttctttctttctttctttttttagaacagagtctccctctgtagcccaggctggagtgcagtggcatggtcttggctcactgcagcctccgcctctcgggttcaagcaattctctgcctcagcctcccaagtagcttggactacaggcgcccgccaccacgcctggctaatgtttgtatttttggtagtgacagggtttcaccacattggccaggttggtcttgaactcctgacctcaggtgattcacccacctcggcctcccaaagtgccgagattacaggcatgagccactgcatccgggcgtgggttctaaattcttaatattctcatcaacatttattgctgtctttttaattttagcctgtaatcccagctactagggcgactgaggtggtagcatcgcttgagcccaggaagctgaggctgcagtgagccaagattgcaccactgcactccaggctaggtgatgaagtgagacttcatctcaaaaaaaaaaaaaaggaagtaatggcaaaaactggaattattttgcaccaacttaaatatttagatctttaatacctttggaaagttttttatatatagtttgtgtgtgtgtgtgtgtatatatacacacatatatatatacacacacatatatacacacatatatatgaatgattttatatatatatatatatatatatatatgaatgatatatatatatatatatgaatgaatgaatgagatggagtctcactctgtcacccaggcaggagtgcagtggtgccattttggcttatggcagcctccgcctccggggttcaagtgattcttgtacctcagcctcccgagttgctgggattacaggcactcgccaccatgcccggattttttgtcttaattcatgaaggatgaattaagtctgcagttgttctttttccctttttctttccagtttttttttttgtttgtttgtttgtttttgagacacagtctcactcggttgtccaggctggagtgcggtggcagtatcttggctccctgtaacccatctccctggttcaagcgattccggtgcctcagcttcccaagtagctaggattacaggtgtgtgacaccacacctggttaatttttgtatttttagtagagacgaggtttcaccgcattggttaggttggtctcaaaactcctgacctcaggtgaaccgcccacctaagccttccaaagtgctgagattacatgcatgagccaccaagtctggcctaagtctgaatttttttttttttttttttgagacggagtttcgctcttgttgcccaggctggagtgcaatggtgcgatcttggctaaccgcaacctccgcctcccacgttcaagcaattctgcctcagcctcccgagtagctgggattgcaggcatataccaccacgcctggctaattttgtatttttgttagagatggggtttctccgtgttgagactggtctcgaactcctgacctcaggtgatccgcctgcctcggcctcccaaagtgctgggattacaggtgtgaaccactgcacccggccgaatatatttttttttttttaaatggagtctcgctctgtggcccaggctggaatgcagcggtgtgatcttagctcactgcaacctctgcctccctggctcaagcgattctcctgcttcagcctcctgagtacctgggaccacaggtgtgcaccaccatgcctgaataatttttttgtgtttttgtagagatggagtttcaccatgttggccaggctgatcttgaactactgacctcaggtgatgtgcctgcctccgccttcccaagtgctgggattacaggcatgagctactgtacccggctaagtgtacagtgttcttgtgatgtctttgtctggtgttggtatcagggtaatactgtcttcaagattacccttgaatgagctttacttcattttttaatgtgtttttttttcttttcttttgttttttgtttttgagacagagtttcactctgtcgcacaggctggaatccacactctaggctcgctgcagcctccacctcccaggttcaagagattctcctgtgtcagcctcttgagtagctggggttacaggcacgtgccacgacgcccggctgatttttttgtatttttagtagtgacgggctttcaccatgttggccaggctggtctcgaactcctgacatcaagtgacctgccttcctcagcctcccaaagtgttgggattacaggagtgagccactgtgccccgcctgcaattacttcttaagttctcaattaaaagagagtttatcaaggactttttttggtaattttgcattttgaaaattgctaacattaactgggacagcccttttatttatttatttgtcactcagttgtttttttgagttgcctactatgtcccaggcactggtaagataggagtatcattgtacctgaggcagggcaacatgtgcttgcttgagaggagcatgatctaggattataaggactgcaacctccccttcccaggttgaagcagttctcatgcctcagcctcccaagtagctgggactacagccatgagccaccacgcccagctaatttttgtgtttttagtagagatgaggtttccccatgttggccaggctagtctcaacttctggacctcaggtgatctgcccacttcagcctcccaaagtgctgaaattacaggagtaattttattctcccaaagctgctgctttgggagaataaaaagttgagtatgggccaggcatgggggctgatgcctgtgatcgcagcactttaggagactgaggtgggagtctagcttgagcccagtagtttgagacaagcctggggaacatagggagatccggcctctacaaaaaaaataaattagctgggtggagtggcatgtgcctgtggtcccagctacttgggtggttgaggtgggaagatatctgagctcaggagttccaggctgcagtgagctctgattatgcactccagcctgggtgacagagtgagatgctgtctcaaaaaaaaaaattcagtgtggcgtgattaggctgggagggtggggcaggaagggatgacattggaggggtaggcaaggtgtagatagacctttccctatattctcctatttttaaaaaatttttttctaaatagagatagggtcttactattttgcccaggctgggtctcaaactcctgggctcaagtaatccttccatctaggcctctattttttgtgcaaacgattgaaattatattttttttacctgaatttttcctgtgaacattgggttatttataaacctgttttctgtttctttctttctttttttttttttttgtttttgttttttgagatagagtccagcctggagtgctgtggcatgatcttggcacacttgcaacctctgcctcctgggttcaggtgattctcctcctctagcctcctccacgcctggctaatatttgtatttttagtagagatggggtttcaccatgttggccgggctgttcttgaactcctggtttcaacagatccacctgcctcagcctgccaaagtgctgagattacaggtgtgagccactgttctaggcacttgtttctgtttcttaattttggctgctactcagtgggaaaaagcacagattgaatctaattgaggccgggcgctgtggctcactcctgtaatttcagcactttgggaggctgaggtgggcagatcacctgagatccagagttcgagactagcctggccaacatggggaaacctcatctctactaaaaacacaaaaattagttgggcgtggtggctcatggctgtagtcccagctactcgggaggctgaggcatgagaattgcttcaacccgggaggtggaggttgcagtgagctgagatcaggacactgccctccaggttgggcaagagagtgagactcggtcttaaaaaaaaaaaaaaatctagttgaaaaatgtcatcgggtctttccaaatttttactaggaatttgttaaaattaaccaggctggaagtcattatagtttgtttgtttgtttgtttgagatgggggtctcactctgtcacgcaggctggagttcagtggtaggatctcggctcactgcaacctctgcatcccagattcaagcgatcctctcacctctgcctcatgagtagttggaaccacaggcatgtgtcaccatgcttttgtagagacagggtttctttcgccctattggctaggctggtctcaaacttgtgagctcaagcgatccgcccaccttggcctcccaaagtgctgggattacaggcatgagttaccttgccttgcccattatagcttttttgaggctgggtcttactctctgtcatgcaggctggactgcagtggtgtgatctaagctcactgcctcctgggctcaagcagtcctcccacctcagcctcctgagtagctggcacaggcgctacctcacccatctaattttttattttttttagagatggggttttgccatgtttgcccaggctggtctagaattcatgagctcaagtgatctacctgcctcggcctcccaatgtgctgggattacagacatgagccactatgttcagccatacctggctaatttttaaaaaatgttttcaagagacagggtctccctgtgttgcccaggttggtctcaagttcctgggattactgctggccttcaaaagtaaatgtgaaataattagttaatttctccctcagttgacaaataatgccaaaagtgataaagattaatgaaatgtctcttttttttttttttttttgagacggagtctcgttctgttgccaagtctggaatgcagtggcacgatctcggctcactgcaacgtccacctactgggttcaagtgattctcctgcctcagcctcccgagtagctgggactacaggcacgcatcaccatgcccggctaatttttgtatttttagtagagacggggtttcactatgttggccaggctggtcttgaactcctgacctcatgatccacccaccttggcctcccaaagtgctgggattacaggcatgagccaccgcgcccagccatgaaatttcttacgtagaaaggcagcttgggattgtagaaagaatgtaggctttggagttggacaggcctccatttgagaccatacttgagtcccgtgcttgccttagacaaagaacctctcaaccttagtttttaatctataaggtgttttgaaaattaattcctagttcagtacatggcacatggtaggtacctgctgctatccataattctcttagttaatatattcggtgccacatgccaggcagccaggatctgtactaagcacctaataagtattatctcatttaatcctcaaaagaaccccacctgagttgctagacagccattatttcagggttacacattaggaaattgaagcttagagagatttaagtggttagccaagtgatggtgctggtattccaactaaggtcatctgctttcagagcatttactttctgttaggctgcctctcctgttgcaaagtactaagaacacaactacataatgtatttttagtggattcttgtctttttgtaaatagaaggttaaaatgagaggaattttttttttgtttgggagacgtggtctcgctctgatgagagctagaaatttgattacttgtatttctggtctgcataaaaatttggcctaaaaacatcaatagaaaggcaagtgtcatctgcaaatctgtcccatcctgttcttcacaggaaaatgtaaccttttttttttttttttctttttttgagatggagtctagctctgttgcccaagctggagtgcaatggcatggtttcccgctcactgcaacctctgccttctgggttctagcagttctcctgcctcagcctcctgagtagctgggattacaggcgcctgccaccatgcctggctaatttttgtatttttagtagagacagggtttcaccatgttggccaggctggtctttaactcctgacctcaggtgatccgcctgcctcggcctcccaaagtgctgggatcacaggtgtgagccactgcgcccgggctcaaaatgtaacgtctgtctagtatgaggatttatttccttgtctgacttctgagttgtaatcgtttattaacaatcacattgtaagtttatctatgaagtaataaaatgttctttctgtatattatactggaaatgaatgcttcattcaaaaaatagttttatcttgggaaggtagccactttttaaaaattgaggtaaaacggccaggcacggtggctcacgcccataattccagcactttgggaggccaaggtgggtggagatcacctgaggtcagaagttcaagaccagcctggccaatatggtgaaactccatctctactaaaatacaaaaattagaccggcatggtggcaggtgcctgtaatcccagctactcaggaagctgaggcaggagaatcgcttgaacccaggaggtggaggttacagtgagccgagatcctgccgctgcattgaagcctgggtgagaagagcgaaactctgtctcattaaaaaaaaaaaaaaagaggtaaaatttaaataacttaaggctgattgtattggcttacacttgtaattccagcattttgggagaccaaggcaggaggatcacttgaactcagaagtttgagaccagcctggtcaacatagggaaacctcatctccacaaaaaataaaaaataaaatataaaaacttcaaaattaaataagttacagttcaccattgtaaccattttattttatcctatttattttgagacagtcttgttttgtcacccaggctggagtacagtggtgggatcacagctcactacagcctccaccttccaggttcaagtgattcttctgcctcagcctctgtaactgggattacaggtgcttgccaccacaccctgctaatttttgtattttgattagagacagggtttcaccatgttggcccgattggtctcgaactcctgagctcaagtgatctgcctgtcttggcctcccaaaatgagccaccgtgcctgtccccttagtctactttaaaattcaatttgccttttttttaaattgtaagaattccttatatattttggatattaaatccttaactagggatatgattcgcaaatttttttcccccattctgtttctgtaggctctttgacattctttttctttctctttttgagacaaggtcttactctgttgcccaggctagagtacagtggtgtgatcatagcttactacagcctcgacttccctgggctgaagcaatccttacctcccacctcagcctcccaggtaaccaggactacaggtgtacaccaccatgcctggcaaatcactgttgttgttgttgttgttgttatagccataggctcccactgtgttgcccaggctgggctcaagcaatcttctagccttctagccttggcctcccgaagtggtgggattatgcgcatgatcgctgctcccagcccacaatctttttttttttttttttgagatggagtctcgctctgtcacccaggctggagtgcggtggcgcaatctcggctcattgcaacctccgcctcccgggttcaagcgattctcctgcctcagcctcccgagtggctgggattacaggcacgtgctgccacgcccagctaatttttgtattttttttttagaagagatggggtttcaccatattggccaggatggtctcgaactcctgacctcatgatatgcccaccttggcctcccaaagtgccgggattacaggcatgagccaccgcgcctggcctcccagcccacattcttgataattttctttgcttctaaaagttttgcttttagggttgggcaaggtggcttatgcctataatcctagcactttgggaggctgaggtgggcggatctcttgagctcaggagttcaagaacaccctgagcaacatggaaaaaccgtgtctctacaaaaaatgcaaaaattagccaagtgtggtggcatgcacctgtagtctgagctactggggaggctgtgacaggaggatcacttgaattggactggaggctgcagtgagtgaaaatggtaccactgcactccagcctgggtaatagagtgagatgctgtctgaaaaaaaaaaaaagttttagtttttttgggtggggggattttaacttcacctattttttttgttgttgctcagttttgttgttcaatctatgaatcctttgccagatctgaaattatgaacccttatccctaaattttcttataaaagttttgtagttttagctcttatatttaggcccttgataacattttgagttactttttttttttttttttccctgagatggagtctcgttctgtcgcccaggctgtagtggcgcgatctcggctcactgacatggctgcttcctgggttcaagcaattctcttgcctcagcctcctgagtagctggggttacagtcacgtgccaccatgcccagctaattgttttgtgtaattttagtagagatggggtttcagcattttggccagggtggtcttgaacacctgacctcaagtgatctgcccacctcggcctcccaaagtgctgggattacaggtgtgagctactgggcaaggctgtgccagaccttgagttactttttatatattgaatgaggcataagccaaagtttattaggtgatccagttttctcagtaccatgtgttgaagagactattattctttttccattgaattcaaaagagactaattttttaacattcctttgaaatgctattctttttccattgactattgttttctccgtgtcaaaaatttattgaatatggccgggtgtggtggctcacacctgtaatcccagcactttgggaggccgaggtgggtggatcacctgaggtcaggagtttgagaccagtctgtccaacatggtgaaacccatttctactaaaaatacaaaattagccaggcttggtggcgcatgcctgtaatcccagctacttgggaggctgaggcaggagaatcgcttgaacctgggaggcagaggttgcggtgagccgagatcgcgccattgcactccagcctgggcaacaagagcaaaactctatctcaaaaaaaaaaaaatatatttgtgaggctttatttctgaagttttaattttattccattggtctatatttctactcgtaggctactagtacacactgtttttgattactgtagctgaattctgcttctgcgagttcttcagtcttattttattttccagtacagatggtctcagatatacgatggttttacttagagtttttgaacttcatggtgggcttatctggacgtaagcacatagtaagtcgagcatctgcagttaacaatggttcaacttaacgatattttcgacttatgatgggttaatcaggatgtaaccccattgtgagttgaggagcatctgtattgttttggctgtttaggcttcctacagttgcatatgatttttactttttggcggaggtgtccggtattgaatgaacctagggcctcatgcatagagttccatatgaatttgaggttagctttttcatttctctaaataggccattggaattttcatcgggattccactgaatctgtaaatgattttagggagtattgccattttaacaacacagtattaaaaattccaagtaatgaacttgggatgtcttcccatttctttaggtctttaatttcctttcaataatgttttgtaattttcactgtataagacttttcacagcctaggttaaatttattcataggtacaaacagttgttaattcccacagttttacttaatgattttttaactttatgatagggtttactggaggattgaatgcattttcaacttatgatatttttgacttatgatgggtttgttgggacttagccctgttgtaatttgagaagcatctatctgtgtgtctttcttttggatcctgttaagtgggattttttgctcagtttcctttttggattgttcattgctttttttttttttttttcttttttccggagacagagtctcactttgtcgcccaggctggagtgcaatggcgtgatcttggctcactgcagcctctgcctcccgggttcaagtgatttctcctgccccaccctcccaagtagctgggattacaggtgcccaccaccacgcccagctcatttttgtatttttagtagagatggagcttcaccatgttggtcaggctggtctcgaactcctgatctcaggtgatccacctgccttggcctcccaaagtgctgggattgctggcatgagccaccatgcccgaccagtgtgtttatacctgtagcgtaaaaatccatgcttcaggatttgatgagtcttggaaagcattttctgcatcctgctggttgtggaagcgtttttcctgcaaaaaagtagttgagatgcttgaagaagtggtagtcagttgcagagaggtcaggtcaatatggaggatgaggcaaaacttcgtagcctaatttgttcaacttttgaagcattgtttgtgcaacgtgtagttgggcattgtcatgaataattgggcccttttagttgaccaatgccggctgcaggcactgcagttttccttgcatctcattgatttgctgagaatacttctcagctgcagtggtattcagaaagctgtagtggatcaaccagcagcagaccaccaagcagtgaccatgacctttttttggtgcaagtttggtttgggaagtgctttggagctgctgcttaagtctatccactgagctggtcattgctggttgtcagataaaatccacttttcattgcatgccacagtccgattgagaaatggtaaacgacgactttttttttagtttttgctcagctgatgaggcacccacttattgagctttttcacttttccaatttgcttcaaatgctgaacgaccgtagaatggtcgacgttgagctcttcgacaacttcttgggtaagttgtaataggatcagcttcgatgattgctctcaattggtcgttgtcaacttcccatggccggctactactcctcatcttcaagggtctcgcctgcttcgcaaaacttcttgaaccaccactgcactgtacgtttgtttgaagttcctggggcaaacgtgttgttgatgttgtgaattgtctccactgctttatgacccattttgaacctgagtaagaaaattgctcaaatttgctttttgtctagcatcatttccatagtgtgaaataaacataaaataaacaagtaataagtctttagcaaaaataacataaagcaagaaagtgcccattaaaatgatatataacataaccacatttatttaagaatgtattccaatatcaaattgcaaattccaacagtgcaaaaactgcaattacttctgtaccaacctaatagtttgcttagtgtttttatcatgaaaaggtattagatttttaaaatgttttttctgtctgttgaggttatcatgtgttattttgctttgttgtattattgtggtgtataattttttttgagacggggtcttgctctgtcgcccaggctggagtgcagtggcgcgatctctgctcactgcaagctccacatctcgggttcacgccattctcctgcctcagcctcccgagtagctgggactacaggcgcccgccaccacgcccggctaatttttttttgtatttttagtagagatggggtttcaccgtgttagccaggatggtcttgatctcctgacctcgtgatctgcccgcctccgcctcccaaagtgctgggattacaggtgtgagccaccgcgcccagctgtggtgtataatttatttttttttctttttttggtgggagtcagtaccctttttgtttttgtaaagtatgcatgattttatttaatttttttttttagagacggagtctcgctctgtcgcccaggctggagtgcagtggcgtgatctcggctcactgcaacctccgcctcccgggttcaagcaattctcctgcctcagcctcctgagtagctgggactacaggcgcatgccaccatgcccggctaattttttttgtattttagtagagacggggtttcaccatgttgcccaggctggtctccaactcctgagctcaggcaatccgcctgcctcagcttcctgaagtgctaggattacaggcgtgagccactgcgcctggccaacttcattttttatttttttggaaagtgtacgtgacttcctattcatccatttggaagtgtacaattcagtgcattacatgtattcacagtgttatataatcattttctataccaaagtttttcaatatccccaacataaactatccattaaatagtaattcctaatagttccctattcctactccttggtaacctaaattctttctctccctttgaatttgcctgttttattttagataatataagtagtatcatataatatttatctgtttatatctggcttattaacataaagtggagccaattttagcacatttttgtcacttcaaaatgaaaccttcttgcttgataatttaccatgttaaaaaaaaaaaaaaaggaaaccgggcggggcgtggtggctcaggcctgtaatcccaggactttgggaggccgaggtggacagatcacaaggtcaagagattgagaccgtcctggccaacgtggtgaaaccgtctctaataaaaatacaaaaattagtagtgcgcctgtagtcccagctactcaggaggctgaggaaggagaatcgcttgaaccaggggggcagagattgcagtgagccaagatcacgccgctgcactccagcctggcgacagagcgagactccgtctccaaaaaaaaaaaaggaaaccttgtacgctttagttaccatcctcctacaccttaacttccctgcccctaagtaaccattatactattgcctgtctctacatccctctatttgagactcatatgaatgaaattatataatatgtagacttttgttactgtttttttctattagcatgatgttttgcaggtttatccttatttagcatgtatcagcggccacataatacttcattgtatggatatttcacattttgttatccattcatcagttgatggtcatcatcccaaacaagaactctgtacttattgaatgattctcctttcctccctttgtctattttggccattttgtagtaactctatttgcctatcctaggtattttatttaagtggagtcatacagtatttgtctatttgtgtctggtgtatttcacttagcataatgctgtcaaggtttttgcatgttgtagtgtgtatcaggacttctttttcatggttgaatgatcttccatcttgtaaataataacacattgtattatccatttgtgatggacatttgagttgatttcaccttttcgacaatgtaaataatgtcgctatgaacatgggtgtgcaaatatctgtttgagtctctgccttcagttctttttggtatatgcttagcagcagaatagctgggtcacatggtaattccatacttaactcttagaggaagtccgccccttcctttcttaagtctttgctgtatacctttgaagggtttccctagtttatataattgcttgtgatagtttttcccctatttattgactgttttgggggagatactggcccttgaagttcatgacgactccatttcctctgatgtcactataaacacttttgactgtggcagcctttgctaaaaatatttttggatcctggatgtggtagttcatgcctattataatcctagcactttgggaggccaaggtgggagaatttcttgagttgggagttagagacacttttggagtttgtttttttataattgtcttttttttttccatctcagtcttaaagttatttcttcaaagacataattgtgcttaggctttgatgctttcatcaggtaaaatgaaataaagactgaatctgatgaataaataaaactagtagataacagcttctaagtgtgactttgaagtaacatgaatggtttttatcatatgatacatagaaatgacttcttagtggtaatatatggcaggatttggcaaactagcctgcagtccaaatatggctaaaagctgtttttgtacaaccagtgagccaacaatagtttttacatttgtgaatcgctgaggcaaaatccaaaggaaaatattttgaggccgggtatggtggttcacgtatataatcccagcattttgagaggttgaggtgggaggatggcttgggcccaggacttggagaccagcctaggcaacatagtgagatcctgtctctaaaaattttttttaaaaactagctgggcatggtggtacataccttgtagtccctgctagttgggaggctgaggtgggaggatcacttgagtctggtatgttgaggctgtagtgagctgagatcctgccactgtactctagcctgggtaacagagcgagaccctgtctcaaaaaaaaaaaaaaaaaaaaagaatattttgtatcatgttagaattaaattaagccgggcgcggtggctcacgtgtaatcccatcactttgggaggcctaggtgggcagatcacgaggtcaggagatcgaaaccatcctggctaacacagtaaaacctgtctctactaaaaatacaaaaaattagccgggcgtggtggcaggtgcctgtagtcccagctactcgggaggctgaggcaggagaatggcgtgaacccgggaggcggagcttacagtgagccgagatagcgccactgcactccagccttggcgaaagagctagactctgtctcaaaaaaaaaaaaaaaaaaaagaattatatgaaattaaaacttcagtaactacaagaagtctattggaatgttgccactaatatgttgtctggctgcttttgtgctgtgatgggaggattgagtaatttcgagtgtatgtcttacattgcagaatctaaaatatttactatctggcttttttttttttttttttttttttgcgacggagtttcactcttgttgccgaggctggagtgcaatggcacgatctcggctcaccgcaacctctgccttctgggttcaagcaattctcctgcctcagcctcctgagtagctggggttacaggcacgtgccaccacacccagctaattttgtatttttagtagagacgggatttccccatgttggtcaggctggtctcgaacttttgacctaacatatctgcccgcctgggcctcccaaagtgccgggattacaggcatgagccactgcacctggcctactatctggctcttatacagaaaaaagtttatcgacgtgtgtgattgtcacaggttattattgattggtcttctgagaacaatagtcattcatatgtgttctaatgcgactgccaaaatattatttcataagcacatttaatatgttaacttttaatggatgaagcagtaatttggtagttaaatgaacattaattcaacttgctttggttagtgggaaggatattttagtgttattttcatattcacattatcctgctggtcagcattcctttttattctcctccttggtcgtcagaaaagaggttaaaaaggccgggcgcggtggctcacgcctgtaatcccagcactttgggagtccgaggcgggtggatcacgaggtcaagagatcgagaccatcctggccaacatggtgaaaccccgtctttattaaaaatacaaaaattagcagggcgtggtggtgccccagctacttgggatgctgaggcaagagaatcacttaaacgcgggaggcggaggttgcagtgagccgagatcgcgccactgcactctggcctgggcaacaagagcgagacagattacaggcgcacgccaccttgccaagctaatttttgtggttttagtagagacagggcttcgccatgttggccaggctggtctcgaactcccaacctcagatgatcgcctcccaccttggcctccccaagtgctgggattacaagcgtgagccactgcacccggccagaagttattatataatcaatgcaccattgcccaaaatacttatctgaattttttttttttgacacggagtcttgctcttgtcacccaggctggagtgcaatggcgtgatcttggctcactgcaacccctgcctcctgggttcaagcaattcttctgcctcagcctcctgagtagctgggattacaggtgcccactacaacgcccggctaatttttctttgtatttttggtagagatggagtttcaccatgttggccaggctggtatgaaactcctgagctcaggtgatctgcccacctcggcctcccaaagtgctgggattacaggtatgagccaccgtgcctggccttatctgacttttttttttttttttttttgggacagtctcgctctgtcacccaggctggagtgcagtggcgctatcttggcccactgcaagctctgcctcctgggttcacgccattctcctgcctcagcctcccgagtagctaggactacaggcacccgccaccacgcccggctaattttttgtatttttagtagagacggggtttcaccgtgttagtcaagatggtctcgatctcctgacctcgtgatccactcgcctcagcctcccaaagtgctgggattataggcgtgagccactacacccggcctgacttttaagccattgtatttattatatcattgatttagttttgggcaaatgtggtcacagaagatttggacaaatgttgtcacaaaaggttatgcttaattttccgtaatttatttcggcagtgagtaggaagaaaatttgaatgcgtatatgttacagacagtctttttgaggctggggacgtggctcacacctgtaatctcagcactctgtgaggccagtgcaggaggatcgcttgaacccttgagtttgaaaccagcctcggcaacatggcaaaacctcatctctaaaaaaaaaaattttaaatttagccaggctggtggcatgtgtcattagtcccagcgacttggtggggctgaggtgggaggatcacttgagctcaataggtataattttcagtgagctgtgattaggccacagcacattagcctgagtgacagagtgagaatctgccttaaaaaaaataaagtatttgaaagccttcttcagaggttattcttggaaaagcaaataatattatagccttgagtataatagtgtcatatcatttaagccatatggaaaataatactttgtatgaaaatagtaacatctagagtagttttattaataaaatactctccagatggcaagtgatagatacatcctgtttcgattttacaacaaagcatgtttgtgatataaacattattcgattgcaaaaattcttttttttttttttgaaatggagtcttgccctgtcacccatgttggagtgcagtggcgccatctcggctcactgcaacctctgcctcctgggttcaagtgattctcctgcctcagtttcctgagtagctgggattataggcacatgccaacatgcccagctaatttttgtagttttagtagagacagggttttaccatgttgaccaggctggtctcgaactcctgacctgaagtgatctacctgcctcggcctcccaaagtgctgggattgcaggccttagccactgcgcccggcccgattgcaaaaatcgtaacatttcagtgacttcagtgttttgaaattgagggattaaaatctaagatctaaatattcgattcttcttccttttttttttttgagatggagtttcacgctttttgcctaggctggagtgcaatggcacgatctcggctcactgcaacatccacctcccaggttcaagcaatttttgaatcccatagtgctgtgttgggattacaggtgtgatccaccatgcctggctattcttttttttttttttcttctttttaaagagacagtatcttgctctgtggcccaggctagagtgccgtggcagtcatggcttactgcagtcctgaactcctgtgcttaagcaatcctctcacttcagccttctgagtagctagtaccacaggcacacaccaccacacccgaccccattattgttctattgatgtttataactgtataattagtatataatctgcatttaccagaaatctgtaaaatctggttatgtcattacttttcctgattattggtacagttaaaacctagaaaggctcattcatataagggatacattgtgttggaagagcttataacaactttgttttatattttgccaaaaagcctttggattctttagctcgagggtgtagtccagattccaggtccaacttctagagttctggaggagtggcagatatccatttcttggggatcagtcagaagtgagctcattaattaattggaaactttttgttttggatgtttcagtggtaaatgaaaacaataccccctactagaattattgtgaggattctgttacattatgtgtgaaagaactgattacaggtgtcacaaattactttcttactcattaatttattaattatgtgctatgcactgttttgttttgtttttgagacagggtctctgttgtccaggctggagtatagctgtgcagtgtttttaagtgctgggaatactgtgatgagcagaatagacattgtgtctgccctcatggatccttcagtaaagtgagaaaggcaaacatcaaacaaggattgggcctggcacagtggctaatgcctgtaatcccagcactttgggaggctgaggtgggtgggtcacttgaggtcaggagttcaagaccagccttgccaacctggtgaaaccccctctctactaaaaatacaaaaattagccaggtgtggtggtgcatgtctcccagctgctcgggaggctgaggcaggagaatcgcttgaacccaggaggcagaggttgcagtgagccgagattgtgccactccactccagtctgggtgacagagcaagactctttctcccaaaaacaacaaaaaacaaaacaaaacaaaaaaacagcaacaacaacaaggattgcttgagcctgggaggttgaggctggagtgagcgatgaccatgccactgcactccagcctgggtgacagattcattcataccctgtctttcaaagaaaaaaatatcagtattagattgtatgttcacaattatatgtgtgagaacctatatgtatgggaactctttgtgccaaccagtgcccagagttttctctctgctctgattactctctcaactctctcaaattgccttttaaagaaatctttatttctgttaagattttagagctatttgtttttggtttttgcttaattttttgcatattctgttaatgcaaaaaattgcattaaattattattattatttttgagatagaatcttgctctgtcgcccaggctggtgtgcagtggagcagttttggctcactgcaacctccaccttccgggttcaagtgattctcatactacaacctcctgagtagctggaactacaggcatgcgctgccacgcctggctaatttttttgtatttttagtagagacagtttcatcatgttggccaggctggcctcaaactcttgggcctcaagtgatctgcccaccttggcctgctaaagtgcttgaattatagatgtgagccccactcctggctgcattaaaatattttaatagacatttgattgattgattgattgatttatgagatggagttttgctgttgttgcctaggctggagtgcaatggcgggatctcggctcaccacaacctccgcctcccgggttcaagtgattctcctgcctcagcctcctgagtagctgggattacaggcatgcaccaccaagcctggctaattttgtatttttagtagagatggggtttctccatgttggtcgggctggtcttgaactcccgaccttaggtgatccacctgcctcggcctgccaaagtgttgggattacaggcgtaagccaccgcacccggcctttaatagacatgttttaaatttataaggattaagaaaaacccctaaaaataaaaaacaaatttataatgattttatagttaaaaggttttgttgttgagacagggtcttaccctgtcactgaagctagagtgcagtggagtgatcacagctcactgcatcctcgacctcctcggcttaagtgatccttgtttaatgtttgtttttaagaacattaaaaagtgctttgttgaaagtgtttggtttagcacatttttattgattactgagtaggtgctggagtttaaaacatgaataagacaaaaaaaatgaatagaaaataagattattgcctctgctgttgagactcttagagtgtggtattaatatcaatgtaatgtgtcaagtgcagtaaaaagaggtatgcacaaggggatccagagccttaagtaggggtaaagtagacccaagagatgtttctttgagctgagttatgaagtataagtagctattagccagataggaaaatgaagcgtgccttagattgtaaagtatgatcaagtgcatggaggtgtgatagcataagatttatgtgaactacaaagtgtaaatcgtgtgatggaacttggtcatagtttttcctagggtaggagtcagattaggaagggctttatttttcatcctaggaccttggatttaagtgttttttttgtttgttttgttttttttgagacagagtttcactcttattgcccaggctgaagtacaatggcaggatctcagctcaccataacctccgcctcctgggttcaagcaattctcctgcctcagcctccctagtagcagggattataggcatgcgccaccacgcccagctgattttgtgtttttagtagaaacaagggttctccatgttggtcagactggtctcgaactcctgacctctggtgatccgcccacttcagcctcccaaagtgctgggattataggcgtgagccactgtgcccagctagttttgttttttaaatttttatgtttccaaataaatcatacacagagcacaagtataaaacatagaaaaaaagatggagctgctttgacttggaatgtggagcagccagctttcttatcaccctcttgggtagcctacaaggggctctcatgagcactatctcagaggaacacaatttgaaaactacctctgtgatggaatttcaacagaaggattttgagaagtccagaggaattgattaactaatgattaattgtaaaatgcattcttagagttggaaataagttggtgtgatatgtgggagatggggaagggggccaatcaggtatgtctgggctattaagaaaattgttacttctattctttagtctattaagatataattaatatttttattttttatttttttgagacttgccctgtcgctcaggctggggtgcagtggtgtggtctgggctgactgcaatctccacctccaggtttcaagcgattctcctgccttagcctcctgggtagctgggattacaggcacctgccaacacgcctggctaatttttgtttttttattttttattttatttatttatttttttttttgagacagagtctcgctgtgttgcccaggctggagtgcagtggcacgatcttggctcactgcaacctccgcctcctggattcaagtgattctcctgcctcagcctcccaagtagctgcgattacaggcacatgccaccacgcctagctaatttttttgtatttttagtaaagacagggtttcagcatgttcatcatgtttgccaggctggtctcaaactcctgacctcaagtgagccgcccaccttggcctcccaaagtgctgggattacaggcatgagccactgcacctggcctactcaccgtttcaatgaatgtcataccttggtatctcgagggtcttgctatgttagtcaggctggtcttgaattccttggctcaagtgatccacctgcctcggcctcccagagttttgggattacaggcatgagccactgcctgtaaacttgtagtgactttgccctttgcttagtctgttaattactgagagaggtttttcccaccctgtgattataattttgttatgtgtcctggtatctcttgtttttctttttattatttatttatttattttatttatttgtttattttgagatggagtctcgctctgttgcccaggctagagtgcagtgacatgatctcagctcactgcatcctccgcctcccgggttcaagcgattctcctgcctcagcctcccaagtagctgggattacaggcgcatgccaccatgcctggctaatttttgcatttttagtacagacagggttttgccttgttatccaggctggtcttgaactcctgacctcatgatccacccgcctcggcctcccaaagtgctgggattacaggcgtgagccaccgtgcccggctgatgatgatattttaacagatgaagagttgcattttgtagatgagcaaaaaaatgtggtttcttttttttttttttgagatggagtctccctttgtagctcaggctggagtgcagtggtgtgatctcagctcactgcaaactccgcctcccaggttctcctgcctcagcctccctaatagctgggactacaggcacctgccaccaaagtacgagaatcacttgaattcgggaaggaagtttgcagtgagccgagattgtgccactgcactccatcctcggtgacagtgacagagcaagactgtctccagaaaacacccaaaaagagagaaagaagctctactgtgcataaaatactatcaaatggcattgaatgctacagagaaatcaggaaaggaagagtcaatcgtcaatccatgtgggaaacttcattatgggtttttttttggttttttttttttttttttggcaggttctcaccttgtcacccaggctggagcgcattggcacaatctcatctcactgcaacctccaactcgcgggttcaagtgattctcctgcctcagcctcctgaatagctgggattacaggtgcctgccagtatgcctggctaattttttgtagtttttgtagagatgaggttttgccatgttgtctaagctgttttgaactcctgacctcaagtgatctgccctccttggcctcccaaagtgctgggattacaggtgtgagccactgtgcttggctgcattgtggtcttactttaagaaattgctgtggtgggttctgtgctatttcctgtaatcccagcaccttgagaggccaaggcaggtggatcacttgagcccaggagtttgaggccatccggggaaacataaaaatttaaaaaattagccaggcgcagtggctcacgcctgtaatcccagcactttgggaggcccaggtgggcggatcacgaggtcaggagatcgagaccatcctggctaacacggtgaaaccctgtctctactaaaaatacaaaaaattagccaggcatggtggcgggcgtctgtagtcctagctactcgggaggccgaggtaggagaatggtgtgaacccgggaggtggagcttgcagtgagtggagatcgcgccaccgcactccagcctgggtgacagagtgagactccgtctcaaaaaaaaaaaaaaaattagctggtcatagtggtatgcacttttagtcccagttacttgggaggccaatgctagaggaccgctggaacccaggaggcagaggctacagtgagttgtttttgtcccactgcattccagcttgggcaacagttgagtgagactctgtctcagcaaaaacaaacaaacaaaaaacagaaattgccacagccattctgaccttcagcaagcagccatgaacactgaggcaagaccctccatcagcataaagcttgcagctcagatgatcattttttagagacagggttttgctctctttcccaggctcaagtacagtgataaaaccgtagcttgctgtaacctgaaaatcctggactcaagtgattgttttgcctagaactacaaggttgtgccagcacccccaactaagtctggctttgttttttcctcccctcccttcccctcccctccccgctttttaaaatttttattttatttttattttttcaaatgggatctcgctctgtcacctaggctggagtgcaatggcgcaatctcagctcactgtaaccttccatctcccgggttcgagtgattctcctgcctcagcctactgagtaactgggattacaggcgcctgccattacgcctggctaatttttgtatttttagtagagacagggtttcaccacgttagtcaggctggtctcgaactcctgacctcaggtgatccgcccacctcggcctcccaaagtgctggcattacaggcgtgagccaccgtgcctggcctctttttttgtttttttaagtaaagatgaggtctcacttatattgccaagtatggtcctgaagtcctaggcccgagcagtcttcctgccttggcttccgaaagtgctgggattacaggtgtgaacccccacaaccagcctcagttaaggggtaaaatttttttgtttgtttttttagtgatgagttcttgttatattgcccaggctggatattcttttcttttagcactatatattttttcccccaaatttatacattgaatacaacaaagcattcttaatttgttatttttaatatataatgctattgtacacagactattgtgtagtgtaaatctaacttttatatatgtattgtgaaattgaagcattctcgtgactcactttatcgcaatatttgcattgttgtggtagtcttgaaaccgaacctgtagtatctccaaggtatgcttttgcaagtttttgtatggacatgtgttttcattattcttgggtattgtatacctaggagtagagttactgcatcatatggtcattctgtgtttaagaaaaaattttattttcaatgtttgtgtatatatatttatgatatacatgagatattttggtacagacatgcaatatgtaataattacattagggtaaatggagttaccatcccctcaaggatttatcctttgtgttacaatctaattataccctttttcttattttaaaatatacagttaaattattatcaacctgttgtgctatcaaattctagttcttattcattatttctaacttttttttggacttactgaatcatctgttcttttgttttctttaaccgtcctcacttccatctttctacttcccttcctagcttctagtaaccatttttctgttgtctatcagcatgagttctattgttttaatttttagttcccactaataagtgagaacacatgaagttggtctttctgtgcctgacttatttcatctaacataatgatctccagttccatctatgttgttgcaaatgataggatctcattctttttcatggctgaataacactccattatgtatatgtaccacatttgctttatttattcatctgttgaacacttaggttatttccaaatcttggctattgtgaacagtgctgcaataaacatgggagggcaaatgtctatttgaaatactgatttccttttctgtatatagctagtcgtgggattgctggatcaaatggtagctctatttttagttttttgaggaacctccaaactgttgtctagatttgtactaatttacattcctaccaacaacgtatgagggttcccttttctccacatccttttattcttttcttttggataaaagccattttatctgtttgagatggtatctcattgtagttttgatttgcatttctctgatgatcagtgatactgagcaccttgtcatattcttgtttgccattcgtatgtctttttgagtaatttctattcagattttttgtccatttttaggaaaactttaatttgattgttatatttttcttttagatttgtttgatatcctcacatagtctagttacttgttttgggtttttttttctcttggagacagggtctcactctgtcacttaggctggtgtgcagtggggcagtcatggctcagtgcagccttgacctcccaagctcacgcatccctcccagtttaccctcccaagttgctgaaactacaggtgtgtgctaccatgtctgcctggtgtgggtgtgtgtgggtgtgtgtgtgcacgcaaggatgggatctcgccaaagttgatcttgaaatcctggcctcgagcgatcacccaccttggcctcccaaagtgctaggattgtgcaggcctgagccaccacgcctggccttttcttgtttataaatgagattatgtatttatacttgggttgatttgatgacgttattcttaaatatgggtagtttaagctgtggaaaagttttagtaggctttggatatcatataaatcaagcatctaaacggatgtgtttttgtcttatatattgctgtcgtctctttataacaacttaatattatgggagtttttggtaactaaaacaataactgagtccttagagttgcgataatttctatgataattgttatgtaaagcattagtacttcccccacttcccctcgtctttacctcaagttgtgtatcactatagattctcagcaagtttttctaaaaaactgtggctgggtgcagtggctcatgcctgtaatcccagtactttaggagggcgatttgggtggattgattgagctcaggagtttgggaccagcctgggcatcatggtgaaaccctgtctctacaaaaaatataaatgccaggtgctgtggctcacgtctgtaatcccagcacttgggaggcggaggctggtggatcacctgaggtcaggagttcgagaccagcctggccaacatggtgaaaccctgtctctcctaaaaatacaaaaattagccgggcatggtggcaggcgcctgtaatcccagctactcgggaggctgaggcaggagaatcgcttgaacccaggaggcggaggttgcattgagttgagattgtgccattgcactccagcctgggggatgagagcgagactgtctcaaaaaaacaaaaccaaatatatatttgcttttttgtttgtttttttgagacagagaccaaatatatattatatatatatataatatatatttgttttttattataatatatatacattatatattatatattatatatattttatatattatatataatatattttatatatttatatattatatatgtatattatatatatatatatataaatttatatatataatatataagttttatatatttaaatatatattatatattatatatttatataattaatatatataatatatttatatattttatataattatatatatttatatatataaataaatatatataatatagttatatatttatatataactatattatatattatatattttatattatataatttatattatatattatatattatatattttttatatatataatatataatataacatataatatatgttatatataatatattatatataacatatattatattatatgtatatttatatataatatatatatgtaaatcagcccagtgtggtggtgtgcgtttgtagtcccaactacctgggagcctgagggggaaggattgcttgagcccaggaggtggaagctgcaatgggctgtgatcacaccattgcactctagcctgcattacatagggagaccctgtctcagaaacgaaaaagaaaaaattgttgcactatggctattttttaatatttagctcaactgtaatttttggatatgtctgggaagagattgatagccaatgactatattcaatttacattaaaatagcatatcccatatgaccaggaacatagttgaaccggtttaggtttttttaaaaaatcctcagaagtgcaacataggtttgatttttaactgttgctagaaaaattcattagtgaaagtaaagatctcgtccaaaattcctttaaacagaacttttggctcaagagccacttcttagttagagttgtagagatgtcttaagcctttagtgattttcgaagatggtagtgacgagcttttctgggttagtttaatataaagtgatacgtcactgtcagtgaaataaggaatataaggtggccgtggtggctcaggcctataatgccagcactttgggaagacaaggtaggaggattgcttgagaccaagagttcgaaagcagcctggggaacacagggagacctgtgttctgggtgtggtggtgtgtgcctttagtcccagctattcgagtggctgaaatcaacgcgccactgcaccccagcctgggtgacagactgaggctgtgtctcaaaaaacaaaccaacaatcaaaaagaaaatgggaggttttaaatctagttagcttttaggttggatttaaacactttgcaaacaaattctagccatatttatttctaatgcaaaaaacatggtctttagagttattcagatatggatttaaattctaatcgttacaattgtgacttaacttttttttttttttttttttttgagctggaatctcactccgttgcccaggctggaatgcagtggtaagatcttggctcactgcaacctccgcctcccaggttcaagcgattcttctgcctcaacctcccaagtagctgggattacaggcacacaccaccatgctcggctaatctttgtatttttagtagagatggggtttcaccatgtttgccaggctggtcttgaactcctgacctccagtgattctcccaccttggcctcccaaagtgctgggattacaggcatgagccaccgcacccagcctgtgacttaacctttttgagcctcagtttctttatctgcaaaatcgagataatgctgtcttgtaaggttgtgaggggtaagcaaaataatgtatgtgtattagttttggggggctgttgtaatgcaataccacaaactagctggcttaaacagcagaaattctctctcagttcgggaagctagaagtacaaactcaagttgtcagcacattgttttgaggactgtgagtgtgtatctgtccctgtccctctcctaatgtctgacctcaggctttccttggttaatagattgtgttctgtctgtgttttcacgttgtcttccctctatttgtgcctgtctttgtttccaaatttctccattttattaggaaacagttgcactgaattaaggcccacccttgtgacttcatctggatcaactgcaaagaccctactttcaaataagatcacattcacagctactgggttagggaggagtatatcttgtgtgtgtgtagagtggcagtgtacacagaattcggcccaataccatatataaaaaaggcttagtaccagtatattatttccaactggacctatagacattagaaaaagccattctgaaatctgccagtcctgccagtctaagcctggaagatgccacttctttacttacattttctctgatctcttttcccaagtgtcttgggatctggaattgtgacttattcgtctttgtgtgtcttgttgagctttgtacataggtgtttactaagtttgtgtgtagttgaattatgggcttaaatggatttattttagtgtctgtctctgcaagataaaatttttaagctggtcttaaagtcgtcttgcttttttacacccttgttcttattttcatgtttagaagcttttctgtggtctggaattcttgcctgtttctaagtttatttattaagatcagttggatttggtccttattgtctatgaacgaaagtattaatgtgtatttatatagatttatttttccagtgggtttgcatatgttattttatttggtcatgtaaatttttcaagatagaagaaagtaaataggggtttgttaaagtctttactcattgtaccatcaattaatgaaactttaaaatttgtgtttctcaatggccttgttatttaaaagtttttttaaggtcatcattattgcttcagcctagtttataatggatcatacagtgtatgtatagctctgttatctttaagatatgacatcttagcatatttcatagagttgtaatagcataattttttttggttatatagatgagaggtttctgtgttggccaggctggccttgaacgcccagcctcgcctccttatgcaccaggacaacaggcctgagccaccacggctcctagcataatttttttaaacagatctcttggtggatattaacttttgtcattttaaaaaaaaaatgctttaacagcttgggcaacgtggttatattccatctctacaaaaaatacagaaattttccaggcatgttggtgagcattggaacactgagatgggaggatgggttgagctcaggaggcgaagattgcagtgagtgaagattgcaccattgcactccagcctgggaggcagagtgagaacctgtctcaaaaaaaacacacaaaaaaccaaccaaacaaaaacctgctttaaatatcttaccctagaattaggaattataggaaattactttgaattatttttggggcttaaaatactgggagctgaattactagttactcattttgatggtgtattatagagtaggtgttactttcccaattttgtggcttaggaaactgagaccaaattaacagactttttgaaggtgacacagtttgtgatggagtcagaagagaggatttattactactttctctggttctgtggttctggctattgtctttacctgataccactgacattctttctcctctgtctattgaatgcatgtattttatgattatacttccaaaaatacaatgtaatctttttgtagtagttctctgaggagaagacagaaccaacaacatgtgctagattggttatagttaaatttgtcataaagcatataataataatgaggttttgttgttattggataacaggagagtggtttaagaatttaggctctggagttgtatctccccaggtttgaatccttggttctgtcacttaataactatgtaaccacaggcatgtagtaaaataatgggtaataatgtgtttacttgaagaacagtgccttgcatgtagcaaacatcatgttacttaatgtatttgaagtcatttaggacttgaataaataagcaagttccatatttagcagtgccaaataaatcatatttaaataatcaaaaatcaaattatataataaatttattggaacctactcagattgcagttttcagtacagataaaatatttgtctttcccatcgattcttggtatctcttaaagtttcaaagtcaattaactttgaagtcgtattctttttgagaatttacttgataaccatcaatatggtcccttagatttttttaaagacagatctcactctgtagcacaggctggagtgcagtgggcatgaacatggtccactgtagcctcgaattcttgggctcaagcagtcctcctacctgtctcccaagcagctgggagtacaggcatgcaccaccatgcccagctaattttttaaattttttgtagagactgggtctgacatgttgtccaggctgatctcagactcctaggctggagtgatcctgtcacctcagcctcccaaagtgctggaatttataggcaagagccacagcatctggcccccttagggctttttattttattttattctttttacttttgaggcagagtctaactctgttgcccaggccggcgtgcagtggcgcaatcttggctcactgcaacctctgcctccctggttcaagcaattctcttgcctcagcctcccgagtagctgggattaccggcatgcgccgccatgccctgccaatttttgtatttttttctctttttagcagagacagggtttcgctgtgttggccaggctgatctcaaactcctggcctcaagttatctgcctacctcggcctcccagagtactgggattacagatgtgagccactgtgcctggccccttagagctttttaaaagaaagtaagatgtagttcttgtttcattttctagtagctctatatacaggaggaactaatcccaggttttttttttttccgagacggagtcttgctctgtctcccaggctggagtgcagtggcgccatctcggctcactgcaagctccgcctcctgggttcacgccattctcctgcctcagcctcccgagtagctgggactacaggcgcccgccaccatgcccagctaattttttatttttagtagagacggggtttcaccgtgttagccaggatggtctcgatttcctgacctcgtgatctgcccgcctcggcctcccaaagtgctgggattacaggcatgagccactgcacccagccttttttttttttttcttttttttttttgaagagtctctctgtcgccgaggctaaagtacggtggctcttggctcgctgcaacctccgcctccagggttcaagcgattctcctgtctcagcctcccaagtaactgggtaggattacaggtgcccgctaacacccccggctaatttttgtatttttagtagaacaaggtttcaccatgttggccaggccggtcacgaactcctgacctcaggtgatccacctgcctcggcctcccaaagtgctgggattacaggcatgagccactgtgcccagccaatcccagtatttttaatgagatttaacttctgtgagtatttagaagaattctttgctgttttctctggggcttatgtctgaaagtaaagtgttagctgggactacaggcatgtgccaccactcctggctattactattgttaatacgctaatagaaatattggtttgaaaagcatgtagaatatcacatgcagaagggtctgaagtctcttgatattattaaaaattcttcctataattttttctccattttttttttccctttgtgttttgatccaaggactagatcaagggtgtcttttccttcggatgattttctttattgtgtgtgtttttagttctttaaaaataaagccagcttaattttattttcaaaatacggatagattcattatataaaacaattataagttgagaactatgtataaagggctatgttatgaacaattaagatggaataatttagttgtacttattttgtaattctttttaggctagagtgttttcattctcaatttttcatacattgctttttcagaaggctaataggaatgacaataatgtttcaaaatattttgattcttattgatgccccatgttttgtctgtctaaag

SEQ ID NO: 170 - DNA, 12100 bp, Homo sapiens
  source 1..12100: mol_type = genomic DNA
gtaatacttgcagtgattatacatgttaaaggcagttgcctttagaataactcaatttttgttatcttaataataatatatttttttccttggaacattttgtgaatgaattggtgttacatattttatcttttggggcttttaaaagttcgttttactctatgatttaaaccttctctcagttttttttttttgtttgtttgtttttgagacggagtctcgctcttgttgcccaggctggactgtagtggtgcaatctcagctcactgcaacctctgacttgtgagttcaagcgattctcctgccttagcctcccgagtagctgggattacaggcatccgccaccacgcttggctaatttttgttttttgtttttttttttaattttttatttgagatggagttttgctcttgttgcccaggctggagtgcagtggcgtgatctcagcttaccgcaacctctgcctcccgggttcaagcaattcttctggctcagcctcctcagtagctgggattgcaggcatgtgccactacgcccagctaattttgtatttttagtagaaacggggtttctccatgttggtcagactggtctcgagctcccgacctcaggcgatctgcctgccttggcctcccaaagtgctgagattacaggcatgagccctgcaccaggcctaatttttgtatttttagtagagacggggtttcaccatgttggccaggctggtcttgaactcctgagatgaggtgatccgcccgccttagactcccaaagtatggggattacaggcgtgagccactgtgcccggctgatttaaacattctcaattattctgttgatgccaggaaggtgttaggccatttttctaatgtttacattgtccggaatcaccttttagtatatttacgtatttctactttaatcaggtttgtatcattttttataatataaaagctgaaacaattgtaaatgtttattaataattttgaagtttaaaattttaatttggagtatttcctttaaatgctattgtttgtttttcagttgattgttgtgtttgaatcttaggtaccttagttttaaattactctaaaggatggggctgaaacttgatttatttttattttattttattttagagaagaatttctgctctgtctcccaggctggagtgcagtggcgtgatctcggctcactgcaagctctgcctgctgggttcatgccattctcctgcctcagcctcccgagtagctgggactacaggcgtccgccaccatgcctggctaatttttttggtatttttagtagagacgggatttcaccgtgttaaccaggatggtcttgatctcttgacctcgtgatctgcctgcctcggccttacaaaatgctgggattacaagcgtgagccaccgtgccgggccaatttttgtatttttagtagagatggggtttcaccatgttggccaggctggtcttgaactcctgacctcaggtgatcctccttcctcagcctcccaaagtgttgggattacaggtgtgagccactgcacctggcctgaaacttgatttgagctgtccttttttctgttaggatggtagtgattttattttagttttaatatatgtattttagtttctgaaagtcagatgttggtgagattcagaaaaatcagcttactctctgctttgctgtgatccgccacattcttcactcctttcaacaggcaaccaattgatattaatttttgttgttgttgttgttgttttgttttgagacggaatcttgctctgtcacgtacgttggagtgcagtggcgcaatttcggctcactgcaacctctgcctcccgggttcaagcaattctcctcctgcctcagcctccagagtagctgggattacaggtgcgtgccaccatgcccagctaatttttgtattttagtagagacggggtttcaccatgttggccaggctggtctcaaactcctgacctcaagtgaaccacaggtcttggcctcccaaagtgtttggattacaggcgtgagccaccacacctggctgatattaatatatttttatatacataatgttttttcatataaattatatttttatttacatgagtaaatacatacttcttagtcatcttccacgtctttcctttatcacaaacagaacattgtatattttgcagcttgccttttccactttgtggagatttttttcatatttttattatttatgtatttgtttatttttctgagacaggatctcattctgttgcctaggctggagtgtaatggcataacaacgcctcactgaagccttgatctccagggctcaaacagtcatccaacctcagcatcctgaatagctggaatagctggaatagctgggagcacagacgtgtgccaccacacatggctttttttttttttttttgggtggagatagtgtctccatatattacccaggctggtcttgaaatcctgagcttaataagggatcctcccaccttggccttccggagtgctggaattacatgtgtgagtcaccatgcctctttttttttttttttttttttttaaaaaggatgatttctccaaagtagaattcctggatttgattttatattttgaataatgaggtgcccaaaaacctttataaattttagtgtctttttttttttttttttttttttttgaggcagagccttgctctgtctcccaggttggagtgcagtggcacaatctcggctcactgcaagctccacctcctgggttcacaccattctcctgcctcagcctcccgagtacctgggactacaggtgccagaacctagcacagtactaggttttgtgtctgggcgcagtggctcacacctgtaattccagcactttgggaggctaaggcgggcagatcacctgaggtcaggagttcgagaccagtctggctgacatggtgaaaccctgtgtttactaaaaatacaaaaattagccaggtgtgttggcatgctcctacaatcccagctactggggaggctgaggcagaagaattgcttgagcccgggatgtggaggttgccgtgatccaagatcacactactgcactacagcctgggtgacagagcgagactctgtctcaaaagaagaaaataacttagtgtgttaaaaatttaataccttgaccagacacggtagctcatgcctataatcccagcactttgggagtccgaggtgggaggatcacttgagcctaggagtttgagaccagccttggcaatacaatgagacactttctctttaattcaaaaaaaatgttgataccttatcctttgtgacctgtctggatatttaaattctactactagaaaactctgagtccttcttttctaacctccctgtccctatgactgctggtttcttactcattagggtgtctctctctctctctctcctcgtctctcttttgattgagggtctcgttctattgcccaggctagaatgcagtggcgtgatcatgactcattgcagccatagcttcccagggtcaagcgatcttccctcctgtgccttccaagcagctggggctacaggcattcgccactatgcctggcttagtttttaatttttttgtagagacagggttttgccttgttgcccaggctggtctgaaactcctgggctcaagcgatctgcccgcctcggcctcccaaagtacttgggattactgacaggagctaccgcactcagcctatttatagtgtttcttatgcatactagttgagtccatgctatttatttgacaaatagtaaataccttgtatagattgagtactgtgctaggttttgggattcattattgggccatacatctatactgcttgctctcatgagaaattagaatctagtataagggacaagacaccagaaaataatcaaatgcattattacttaactgagaagtctgtccaaggaacaattttgatgcctattcagtgatataacagggataactgacctggactcttcatcagtggtgtttgctaataaagttatctctgatctgttacttgagaggatgagttgggagttaactagggaagagagaagaagatggttccaggaatctgcagctcacagagtaagggagggtggcacagtatgaggctgggaagtagatatgggacaaagtgttcagtgccttgttgactttgttaaaaaattttgttatttttatctcagaaacaatgtatataattaaaaagtgtttagcaggagccgccatgctctgatctgttcattttaaaagttcactgtggctggattgttgaacatgtgttagaaggggaccacaaataagtaaaaagagacagttaagtcattattagtgattatggtgtgatgaaaattgcgaatagaaaataaaaacagatgaggaggtaaaatgcatctgatgtagtaatgcattggataatgttgactgagggagaatgaagtcctgaggctttcagttctcaggtttccatatcataggatggctcccacgtttttagcttcatcactggatggctgaatagatcgtcatttactgagagaacaccagagcatctataactcagaaaggacatattcttgttcatattagttggagccatgggcaaggcatgggtgagattttttgggacaaaagatactatgagacaaaaggtacattgaggaagacatcatttgacatctgtatgaaagagactgagcttgctgaaaaagaatgatgaaaaagaatcagatgaaacaggtggaagaggaaaagtaggagaatgtggctagagtacagtagtatgtactggggatatgttctaagattctcagtggatgcctgaaactggatagtactgaatcccatatatataatgtttttcctgtacatacatacctattataaagtatcatttataaattgggcattgtggctggttgtggtggctcacgcctgcaatccagcactttgggaatccgaggcgggcggatcacttgaggtcaggagttgaaagccagcctggccaacatggtgaaaccctgtttcttctaaaaacacacaaaaaattagctgggcgtggtggtggatgcctgtaatcccagctactggggaggctgaggcaggaggattgcttaaacttgggaggtggaagttgcaatgagccgagatcataccactgctctccagcctgggcaatggagcaagactccatctaaaaaaaaaaaaatagtaaataaaaaataaattgggtattgtaagagatcagtaacaactaataataaaacagggcgggtgcagtggctcacgcctataatcccagcacttcgggaggccgaggcaggcggatcacaaggtcaggcgatggagaccatcctggctaacaaggtgaaaccctgtctctactaaaaatacaaaacattagctgggcagggtggcgggcgcctgtagtcccagctacttggcaggctgaggcaggagaatggtgtgaacccgggaggcggagcttgcagtgagccaagatgacgccactgcactccagcctgggcgagagtgcgagactccatctcaaaaaataaataaaacagaacaattacactgtaataaaagttatgggaatctgtcccctaccttcgaccccaatagcttattttactgtatcacaggtaactgaaaccatcgaaagtgaagtctcacgtgagctgggaccactgtagtttaaggacgatgtggtcaattttgctgagtgttgcctagagagcaaataaaatgtccattagggataagaaggtggagatcacgagtaccttttttgttgttgttggtttcattgaggtagaagttagattggactgatttgaggcaatggagacagagacagagaagggaggatgctgcaggcagataggtatataggattcagaaggatttttattttttgttgttattttttattttaatattagtcttatttttgagaaagagtcttgctctgtcactcaggctggagtgcagtggcacaattacagctcactgcaacttccatctcccaggctccagtgctccagggctccagcactccttccacctcagcctcctcagtagctgggactacaggtgtgcaccacaacacttggctaatttttatattttttgtagagacaagatctccctatgttgcatgaactggtcttgaactcctggccttaagtgatcctcccgccttggcctcccaacgtgctgagattacaggtgtgagccactgtgcctggccaatttatttttgactctagagacagggaagtttcaagatgaaggtgctagccaattcggatcccaagtgagggctgtcttcctgacttgtagataaccaccttgttgctgtgtcgtcatttggcagagagcgaaagtactcactgtggcatcttcttttaaggagactagttgcatcatgaggtcacctccatcatgagggacctattactaatctagtaatagtatttagtattcttagtatatttagtgtataaaattagtaaatctacttactccaaaggcctcacctgtaaacaccaacatatgggggggtcaaggcttcagaataatgcatttcaggaggacacaaacatttagtctgtaatagccctttttcatccttcttgaatgacagtcttactaactctgagttttaaattgtcgtcagtaagctgaattcatatccttagtgatagtctttatccaggctttagatttgtatactcaactccatacttgaagttttcaccaagatgtcaatttgaaaatatattcatcaccctaacatggaaccccatactctttagcttcctctgtctccatctttccacacccatacgtgtttgccttaagcaaccactaatgtactttctgtttctgtggatttgcatattctagacatttcatatgtagtaggtccccaatttgagttagaatttttcgaccttacaatggtgcgaaagcgatacacattaaatagaaatggtacttcaagttacctgtagaaccattctgtttttcactttcaatgtagtattcagtaaattacaggagatattcagcagttaattttaaaataggctttgtgtcagaaatattgcacaactgtagaccaatgtaagtgttctgagcatgtttagcgtaggctaggtgtattaaatgcattttctaattattattttttttttagaggcagggtcttgctttgttgctcaggctggagtgtagtgacgcgatgtcagctcactgcaacctctgcctcttggactcatgtgattctcctgcctcagccccccaagtagctggaactacaggcaagggccaccatgcccagctaatttttaaatttttttatagacagggtctccctgtattgcccatgcttgtcttgaactactgggctcaaacagtcttcttgccttggcctcaaaaagtgtttggattataggcgtgaagcctctgcgtctggccagccttcatattcaacttaatattttcttttcttttcttttcttttcttttctttttttttgagatggagtctctctctgtcaccagactagagtgcagtggcacgatctcagctcactgcaacctctgacatcctggttcaagcaattctcctgcctcaacctcctgagtagctgggattacaggcacctgccaccacgcccggctaatttaatttttagtagagacggggtttcaccatgttggtcaggatgttctccatctcctgacctcgtgatctgccaacctcggcctcccaaagtgctgggattacaggagcgagccaccacgcccggcctcaacttaatattttcagcttataatgggtatgtcatggagcatctgtgatttgtttataatttttccacaaatctgttgtgctcctcaacttacaatggggatacgtttccactaggaatgcattggttctgatttttcccatatccccatcattggttatttgacttttaaaaaatagacaaaacataaatttaatgttttttttttgttttgttttgttgagatagagtcctgctctgttgcccaggctgtggcaggatctcagctcactgcaacctctgcctcctgggttcaagcagttcttctgcctcagcctcctgagtagctgggactatacgagtaactgggactacaggcatgtgccagcacgcctggctcatttttgtatttttagtagagacaggatttcaccatgttggccaggccgttcttgaactcctgaccttaagtgatcctcccgcctcggcctcccaaggtgctgtcctgcctcagcctcccaaggtgctgggactacaggcctgagtcacctttcctcgcctaatgttttcattgtttcaagtaggcagttcagtagcattaagtatattaacattgttgtgtagccattaccactattcatctccagactctttcatctcccaaactgaaactctgtacccatttaccaacatcaccatagcccttggtaaccactgttctgtgttttttttccttataaatttgactattttagataccacatataactagaatcagacatttgtcctattgaccccttacttcatttatcataatgtcttctaagttcatcaatgctatagtatgtttctgaatttctttctctctctctcaatttttttaaaggctacataatacgtcattgtattgtaagtaccacattttgtttttccattcatccatcagagaacatttgggttgttttccttttggccattctgaacagtgtttctataaacattgtatagtatctggtgtttttgtatttttttttttttggatggagtttcactcttgttgctcaggctggagtgcaatgaggcgtgatcttggctcactgcaacttctgtctcctgggttcaagtgattctcttgcctcagttgggattacaggtgcataccaccacacctggcattaatttttgtatttttagtagagactgggtttcgccatgttggccaggctggtctcaaactcctgacctctggtgatctgcctgcctccacctcccaaagtgctgggattataggtgtgagccactgtgtccaacctaagcatctgtgtcttttttgttgttttttatttgttttttgagacagagtcttgctctgtctcccaggctggagtgcagtagcgggatcttggctcactgcaacctctgcctcctgggttcaagcgattcttctgcctcagtctcccgagtagctgggactaaaagtcagctaaaagtcaaagctgtaatggctaagatcttaacatgccatgcaaactcttacaagtctggttgctgcccaacctttattagtttcccttttcttctagtttatgatagtgtttagaactacttgtagttttgtttagttttattcattcatgcctttgagggttctgtgccctcatactataattctatctttaactgtttacttttttttttttttttgagatggtgtctcactcttgtccaggctagagtgcagtggtgggatctcagctcactgcaacccccgcctcctgagttcaagcgattctcatgcctcagcctctcaagtagcttggattacaggcaagttgcaccacgcccggctactttttgtatttttagtagagacagggctttaccatgttggccaggttggtcttgaactcctgacctcaggtgatccgcctgcctcagcctcccaaagggctgggattacaggcatgagccatcccacctggccaaactgtttaactttaaaagttgttcagcctggcgcggtggctcacgcctgtaatcccagcactttgggaggccgaggcgggcggatcacctgaggtcggcagtttgagatcagcctgaccaacatgaggaaatctcgtctttactaaaaatacaaaaaattagttgggcgtggtggcgcatgcctgtagttccagctacttgggaggctgaggcgggagaatcgcttgaacctgggaggcagaggttgcagtgagccaagatcatgccatagcactccagactgagcaacaagagtgaaactccgtctcagaaaaaaaaaaaaaagttgttcaagtacttcatttgtctcctcccacttataattgagtggttttttttaagaaataagtgtttatttttgcagttgtcatgccttttgtactgtaatcatttatatatgacttatctgtcagacagtgagttcttttttctcctcacgttgctggcacatcagaagttcttgatctgttaatgaaatttatttatttatttatttctaagacaggggcttgctgtactgccagggtggagtgcagtggcgtgataatggctcactgtattcttgacctttgaggatgaagtgatcctcccttctcagcctcccaaatagatgggactacaggcacatgccaccatcctcagccagtatttttatttttagtagagatagggtcttgctatgtttcccaggctggtctcgaactcctgggctcaagcagtcctcccacttctgcctcccaaagtattgggattacaggtgtgagcccctacacctggccagttcaatgtattgactcatgggagagtgatttaattctcaaattgactttaagaacctctgtataggtacacacatgtgtatattaaccagttccagttcctgtaggtgatttttattgaaggatttaattcagtaggtgggaaataaggagttcattttttttttcagtttgtttttaaaatgaaccagacaacacaaaatttaactaagttttagtttcattattaagctatgttttttaatagaaaaactaccatgtgtacacttttgaaaccagcatttacagagaagttaccgttgacagttcagtttataaatcccttctctcctttgtctttcttttttcatttttcattttgcattctgagggaagtaggcattccataattcttccaaaggttatttggattcttttctgtgttttgaaataagacatggttgttacaagggaactagatgtgagttaaaatgaattttcgtataaaatgatttttatttccttttattaaaagtgacaaattgttaaacatgtgttgtcctgactttcttttgtgacactttttagtgtaataaaagttgctaataaaattgtaaatgtgtggaagataacatatactagatgaattataatcttttctagatgggatttgtattttcatatttttaattgtatgtatagaactttagataaccaagaaattataggctaaactggatttatttttggttttattactggtaggctttcctttttcttttaaaatttccctaatttgaaatattgcatttcactttctttgcaaaaccagtgtttgaccatgcgcttgttctctctgaagttattgaacttactatatctaaaataccaaaaccatacattattttgggggtgtggttgtggggaggaatccatgcaaagcaccttgtgtggtgctcgtctatgagtagctacactataaatgttaacagatcatacatgttgctttgctgaaacatttcttcttctttatattagcctagtgtttttcacgttttcttgggtttttttttgtatatatatttttgttgctgtgggcttactatatacatcttctgtatttttggaacaatgaaattatagactgatagtgaaggaaacttacctgtctactatcttaatttcttctttgtagttaatctacatttagctggttttgaagctataccacgtcatcagactagactactgattctttcataacctcctgtgtattttcttgccacacatatataatacttaaaattttccttgtgtatgatctattctaggttgtctagttcagtgggcatgttagttgtttccagacagtcttctttggcggcaatgatgtggctgttctcttaatgatgagaagtaatttctttgatctaatgattctggttctcttacccttacctag

SEQ ID NO: 171 - DNA, 1384 bp, Homo sapiens; identical to SEQ ID NO: 100
  source 1..1384: mol_type = genomic DNA

SEQ ID NO: 172 - DNA, 6780 bp, Homo sapiens
  source 1..6780: mol_type = genomic DNA
gtgaggagaaaatcttgggggaccttctctagaagagaaatggaatagctggctcttcccactctgttcatgacaagaacggaagcacaagcatagttcgttttaggtagaggtatgagcttaaaagaagatcagaaatagccgggcacggtggctcacgcttgtaatcccagcactttgggaggccgaggcgggcggatcacctgaagtcaggagtttgagaccagcctggccaggcaggtgcctgtaattccagctacttgggaggctgaggctggagaattgcttgaacccgggaggcagaggttgcagtgagccgagatcgtgccactacactcaagcctgggcgacagagtaagactccgtctccaaaaaaaagaagaaaaaaagaaacaagtaccagaacaccattcctagcgcattgccaggattcccagtgtcaggagaattgattttaggtggacctaacctttaacctacctagtgaaatagtcatcaccattatcatctgggtccagtggagcctttgtattttaaacatttttatgtcatttatatgaataattgacagacataaaaataaagagacagtggagaacaaatgtattagaaattttagtgttatgttgttgctaaaataattgcagttttatcattacttttaatggcaaacctcaattacttttgcaccaacctaatatttactaaatcctttttacaaacctctttttatcagataagttagttgcgatgctcaaatatcataaaacatgaaagaatattgttaggcctgttgagaaaaggagattacccaggttgttcttgtaaaacatctttgatggcattgttcctggatgagaataccctatttcttttttgttcttagaaatgcattatttgttcacttatcctttgtgtgtgtgtgtgtgtgtgtgtgtgtgtgttgtttttttgtttgtttgtttttgagatggagtctccccctgtctcctaggctggagtgcagtggtgcaatcttggctcactgcaacatccatctcccaggttcaagcaagtcttctgccgcagcctcccgagtagctgggattacaggcgcacaccactatatgcggctaatttttgtatttttagtagagacggggtttcgccgtgttggccaggctggtctcgaactcctgacctcaagtgattcacccgccacagcctcccaaagtgctgggattacaggcatgagccaccacgcccggctgtgtgtttccaaagactgataatctgagatgctacttggagactaatttgaccaccatcttgagaatctagtatgtttaagtttgtctcaaatattggatcgagcatagttaaactgaaaaactttcgttgtttgtcagaaattcagattgaactagatgacttggatttttatttgctaaatctgataaccctaccgaaatcagaccttcaagatcgtgtctccagtgttttatacttgcttttttatttttaaactcctttcctcaggtgtagtagacggtcttttatactttttttaaacgacaatgcagtactttgggtaatgccgtaagaaatctaaagtgtgacagtttcagtatttcatcgtgcttatatgtgattccattgtgcttcccttgtcttttttttttttttttttttttttttgagatggagtcgcccaggatggagtgcagtggcacgatcttggctcactgcaagctctgcctcccgggttcaagccattctcctgcctcagcctcccgagtagctgggactacaggcgcccgccaccacaccgggctaattttttgtatttttagtagagatggggtttcaccatgttagccaggatggtctcgatctcctgacctcgtgatcggcctgccttagcctcccaaagtgctgggattacaggcgtgagccactgcgcccggcctcccttttcttattatttctgtcttctttagcatagttgtgaattattgatgagttagtaataatgtgtaatgatgaattagtaagttgttacaagatagaggaaaagtaagaacactaaaattccataccgtgtcttagatttagtctgatggacttacatggtatttacaagacagaatcagttttgttctttgtttgttcctttgagacagggtctccctctgtgacccaggctagagtgcattgctgcaattttggctcactgcaacctccgcttcgtgggcgcaagtgattctcctgcctcctgcctcagtctcctaagtagctgggattacagacatgagccaccaacgcctggctaattttggtattttttgtagagttggggtttcaccatgttgcccaggctggtcctgaactcctcagctcaaagcaatccacccacctcaacctcccaaagaactgggattacaggcgtgagctacgacacttggcctgaattttattcttttaaataagtatattttctttttgaactttggaagacctctaaaaagggataaaagtcataaacactgcttctgaagtctttttttttttttccccctgagacagagtctcactctgttgcccaggctggggtgcagtggcgtggtctcagctcactgcaacctccatctcctggattcagcccactctcctgcctcagcctcctgagtagctgggactacaggcattgtgccaccacacctggctaatttttgtgtttttagtagagatggggtttcaccatgttagccaggctggtcttgaactcctgacctcaggtgatctgcccgcctcggtctcccaaagttgagcctcccacggtgagccactgtgccaggcccagttttttttgcttttttctccccccctttattagagatgatgatttcactatgttgcctaggccgatctcctggcctcaggttgtcttcccacgttggcctcccaaattactgggattataggcatgagctgccactcctggcctttaaattgttactttaaatgtcataaaatatccataccaagattagattaaaaaaagaacaaaacgaaaaaagtcataaactgttaatccttacaaatgattacaacttctgaaattaagaatttcaaaacctataattggatctaaatgagtctcacaatgtatgtgaaaatatattcttggaacatagtcgttaggcctcagaaatggaaaataattctattcacatagtcctgagggtcagataacagcaaggtaggcattttagagttaacatattaaccatattgagctactgagagagcagtttcctgtgagtgatctcatcaagaacttagaggccaacttctttactccatttttttttttttttttaataaacatttccaggaaaaggatctagagcaggcattggcaaactatggttcatgggcaaatgtggtctactgcctattcttgtaatactcttgaactacaggttgtttttgtattttttagtgattggcaaaaaagagattttgtgacacataaagatgatatgaaattcaactttcaatcagtatccagaaaattttattggaatacaggcatgcttcttcatttacatattacatatggctgcttttatattacagtggcagagtcgagctacatgtggagatctatggcctgcaaagcctgaagtgtttactttctgaccctttacagaaaaagttacttaactcctgatctatagtgagatttacttagaattacatatccatgtctttgttcttaaccatgtgggatttgttttggtttgcttttggtttacgatgtgataagtacaaaacttatttttggattaataacaggttagatcagttgataagaaacaatgattaaaacatatattttccagcctgggcaacatagcaaaacccagtctctacaaaaaatacaaagaaaaaaaaaaatttggggtgcctgttgtcccagctacctgaatcacctgagcctggaaagtcaacgctgcagtgagctgtgattgcactactgcactccagtctgggggacagagtaagaccctgtctcaaaacaaaaacaaatatatatttgtagagagaaaagaagtagcatgaacctttatgtgtatttgggaagggttcaagtaaaaatatttcgaatcagaagtgaatgttcaaatgccctattcaggacttgtagtcttgggtgactgagattagctgttgttgtctgtccccttagaatttgccttagacattgtaagccttatgccttatggcttccagttgcatgtgttggggatatttctccattagcaagaagtttccaaaccttaccagtgttttgatgaatctaggaacagatctggcagtgagacctacatccattttccccacggacagcatcttgctggagtgtcttgcaggtctatacgatcctcccactgcagcttcctgagtagctggaacctcaagcacttgccaccatgcccggctaagctttataatttttttgtagacatagggtttcattgtgttgcctggtctggtcttgaacttctgggctcaaacaatcctccagtctcagcctccgaaagtgctgggattacagatgtgagccactgcacctggcctcctcctgttaaatgttgatagaaaaatggtttgatggcagcatatatccagattgtagatttcataatattaaaggggagtgggcaaataataaaatgcaagaaatgaaagcatttgaaaatttagaggacagaaatgacttttaagtaagtgattttaggtgtactggaatgagtaatctagaatatttgatatgagagaaacaatcataagggcattatataagaaaggaagaaagaatttaatatgtctaccatgtttaagaggcagctaggtgctgtactatacatatatttcttattcttacaatagtcttgcaagtaatttattcaaaatcacacagttcctgaacagtcaaaattttttgtgcggtttgtgtcttagaagactaaatttgactgttcccactgaaataatatgaaatgaggggagatacattctcatgcacaaatccattattgtactggaacatctattgtctttccttattgttgctagtatttgttaaaacctctacattaatggctttggtgtcacaataactgtttgaccttcatgttttaactcaccaaactttcactgtgtttttgagcactagcaccacttctaaattaatccatgagtgacattgctatagtccttttaaaagattttaaattataagctgggtgtggtgatacctgcctgtagtcccaactacttgtgaggctgatgcaggaagcatagaggaactcaaattacacacagatgatttcatgccatttatttgccacttaagaacagtgcttttgccaggtgtggtggctcacacctataatcccagcactttcagagaccgaggcgggcagatcacctgaggtcaggagatcacaaggtcaggagatcgagaccagcctggccaacatagtgaaactccatctttcctaaaaatacaaaaattagccgggcttggtggtgtgtgcctatagtcccagctacctgggaggctgaggcagtagaatggctagaacccaggaggcagaggttgcagtcagccaagatcccgccactgcactgcagcctgggcaacagagctagactccctctcaaaaaaaggaaggaagaataatgcctatttttttgtagcagcaaatgtgacaccaacatgtggcaatagcagaaacctagtttatagttcacctggcttatcagctttgaaaattttttttttttttttttttttttttttgagacggagtctcgccctgtcacccaggctggagtgcagtcacgcgatctctgcaagctccgctgcctcccagtttcacaccattctcctgcctcagcctcctgagtagctgggactacaggtgcccgccaccacgcctggctaatttttttgtattttgagtagagacggggtttcaccgtgttagccaggatggtcttgatttcctgacctcgtgatccacctgcctcggcctcccaaagtgctgggattacaggtgtgagccaccaggcgcggctgaaattattttttaaaatgaatttcaaaaaaatttttaaagttcatattttattttattttattttattttattttattttattttattttattttattttttgtgaccgagagaccgagtctcactctgttgcccaggctggagtgcagtggcacgacctaggctcactgcaagctcagcctcccaagtagctgggactacaggcgcccaccaccacacctgtctaattttttgtatttttagtagagacggggtttcaccgtgttagccaggatggtctcaatctcctgacctcgtaatccacctgcctcggcctcccaaagtgctgggattacaggcgtgagccaccgtacctggctcgtattttatttttttgagatggaatctcaacatatcggccaggctggagtgcagtggtgaaatcttgtctcactgcaacctccgcctcctgggttcaagcaattcttgtggagttcatattttgtatgtcaagtgaggctctgtttttatatgaaactaagtgttgatagttcaaaatcatgggaaatgtggctgcaacttcaaggaaaaaaagtttgcctttttcaggacgtgaattgtcttctgctgacttgttttatgcggtgtactttgtgttacttttccag

SEQ ID NO: 173 - DNA, 5409 bp, Homo sapiens; identical to SEQ ID NO: 101
  source 1..5409: mol_type = genomic DNA

SEQ ID NO: 174 - DNA, 21301 bp, Homo sapiens
  source 1..21301: mol_type = genomic DNA
gtaagtgcaggctctaatctggccccgttaattctggggcctcttgagagtggggctgtcttatctctatctccaaaaatgtgcaggtgactctcaggccaggccgacggcagttggagaattcccagatgttcttgaggacccagaatgacaggagccctggctgggcttacgttcggagccggcttcaatactggcccttttctctggccctacccaacccgaaaattctggacgcctctcaatcttggcccgtctctattgtccttttgtctctgccctttacacccttgtgtcttcagtgttctgtctgtctctggttgcctcttttgccttttttctgtcctctccctgccaggtttggctctgtccatgagtcacctctctccacatttctcctaactctcggtgtcttctttttcttccatttccacgccatgtgtacattgcatcttcaggtacctgggctcttctatcggggaaaggggcgtccgtctctttccctagcccgctgatagaagtcagaactagagcaatgacgcacacggtgtcagagacggtgattcgagatgccctttcaatagcagcttttttctgtgtttcgggagggagacttactttttgatgcaaggtcgtgaacgtggcaccacctttctaatctcaatcattgttgccctggggtggtttaattctaaatagaaaatcatagaaatcttttcatttctgtgcgttactatatgcattgtaatgagattaaattggattttataggaaattttgttctagtatcattagataccttcaagcttagctcattgttgcaggcatttgataggaagtaagatgcatcaagcaaaattggaaaaacgtggttttcctgaattaacttctaagcagttgttttgaattttttccagacctttttaagtggtatagataatttatcgtgtttataaggaatggaatgcattcgttagtttgtttttgttttgttttgagacggagtcttgctctgtcgtccaggctggagtgcagtagcgctatctcggctcactgcaacctccgcctcccaggttcaagcaattctcctgtctccgcctccggagtagctggaattacaggcacgcgccagcacgcctagctaatttttgtatttttagtagagagggggtttcaccattttggccaggctggtctcgaactcctgacctcatgtgatccaccctcctcgacttcccaaagtgctgggattacaaccgtgagccaccgcgcccggcccaatttgttttatataggttaactggagtccaaaatacagaactagatgagataacaatagttaacagtgttagtcagttagaattattgcataggtatttttaatctcatggaattttagtctttgagtaagttcacagcccttggtattaaagtaagttatttacaacccttgcatttctacttctcaatatttagtgaggaaacatatctgattttctttaaataaaaagagaaaagactgcagaagatagcattctctgttggagcaattaagatgtataagaagaactacaaagacggagttttaaaacaaactgatttataagtggtatttatttaattggctgtcattgggctaaattatttctaaagttaccatggatgccattgagtcatggcttaaaaatgtctcctggtgatggcacagtttagctacctaaagaagtagagatgtgggaagccagaagccccaagctctgcagtttttcttttgctatagttcctttgcatgttgtgaaagaatacagttaaattcctgctccctaacagatgagagcataagcatttctttgggcatacatatgtaaatacatgctcatggacatgtgaaaagatcaatactaacatttgggtgcaataaataattgtgtaaaattatttttaaaagaattacatattaggaaatgatatattgattaaaagtgatagtcaatgaacaagagagtagatttctgggggaaacctattttgcatcatacttgatttttagttttgactgaatattgaagtctatattcaaaattcttttcctttagaactgtaaaggcattgctgcattttcttctaatgtaattgtttattgctgctgagaattcttatgacaatctgattttttcatcttcatgattatcttgtttttcccttcatggaatctgttagggtcttgactttatcctttatcctaaatttctcaaggcttggaccaggtgtgggtttggttttgttttcttttgctactcatttgacttggcacactcagtgggcctttccctttatctttcttcatttctgagacgtttttctctcttattttttattatcttcctttcatttttcctgtcctttttctttctagacatctcttaggaggatagtggtcctcttagattgatatgttatgtccgtgatttccaaagtaagatttgtactcgtcgtctgttaaaaggaaaagcatacatataccctatgtatatatgcacacttttttatttttaaattatatatgtatctgtactaattatttacattgtaagtcaaccctaacataatcttaaaggataagatacaaaacatactgcatctagaagcttcagtactttcttcctgaatcccagtagatccttttgttcatcccacgggatgcattccgcccccatcctcccactccctttggataccacattaccacagctctgcatcacttaactttcctcttatgtttttcaccttttttttttttttttttttgcattttatgtcctggggaatttccttaattcatttcatggttttactgttgatttttttaatattggccatcgcaacttttcttttcttttcctttcctttcctttcctttcctttccttttcttttcttttcttttcttttcttaattttcttttcttttcttttcttttctgttcttttcttttcttttcttttcttttctttcacacaggatcttggcgtgttgtccaggctggcctcgaactcctgggctcaggtaatcctctcaccttggcctcccaaaatgccaggattacaggcgtgcgccactgcatttggcggcaacttaatttttttatttttatttttccttttagaggacacctagcactgagcattgcaacttttcatttccatgaacttttaagaaaactcttaaagacatgtttaattctgtacactttctattgttctttgattgctgtttttgaataacaacaaggagtacgccttagcattttgatggtatcctcttaatagtcgcaataatagtccccttggcgctctgtatactctcaagtcttaaatgttttgtatgcagctgtacgttgacagttgaatggtctcgctccaagtggatcagcaagaacataaagaatcatttaactggtacaggctgcggcttgtgaattccctattaacaccaaagaagacgtgtgagactccgtactgaaactaaagacgacttgtgagttccacactgagatcaaataagtctttatgatggtgacagagagtggtgtcaacgcctaaagttttggttaatctctctaaattgaggggctgaccaaaagggggaacttaactgtattagacataattttgagaaacatgggtatgtggatggtaatggaggaaatgggtgtagatgagattgcctagggagagtgagaagtaggttaggtctaagccttgatgagttcccaacatttccaagggtagttgaggatactgaaaatgagtggccagtgagatagaggtaaagctagagactgcccaggggagaggaattttcaacaatgaggaggtgtcaacattgtcaggtattgctgagaggtcagataaaaccagaattgagcaaaatggccattggaagcctatggtgccctccgtaagagctgtttcgctgaagtgatagaaacggaaatcaggctgggcacagtggctcactcctgtaatcccagcactttgggaggccgaggtgggcggatcacctgaggttaggagttcgagaccagcctggccaacatggtgaaaccctgtctctactaaaaatacaaaaagtagccaggtgtggtggcaggtccctgtaatcccagctactcaggaggctgaggcaggagaatcgcttgagccccagaggcggaggttgcagtgagcagagatcgagccactgcactccaacctgggtgacagagcaagactccgtttcaaaaaaaaaaaaaaaaaaagaaatggaaatcaggatggtttggcttttattttaataaaatagctagagcagggaaatggggtactttttttcccccttttaagatgagacatagccaggtgcagtggcttacacctgtaatcccaacactttgaaagggagggtcgcttgagctcaggagtttgagaccagcctaggcaacatagcaagaccttgtctctactaaaattcaaaaaaaattaactgggcatgctggcacacacctctagtcccagctatttatgaagctgaggcaggaggatcacacttgagcccagatacgtggggctgcagtgagccctgataatgccattgcactccacgttgggcaacagagcaagacttcgtctcaaaaataaataaataccctgtctcaaaaataaaaaataaatatgggaggagagatttgacttagattcctcaaagggcaggaggaaagagaattccaaacagtgattcacctttaatgggagaaagatcgcttaattttacatgaggaagaagaggattggtggagatacagtaggtgaacagtttttgtatgaggaagttgaacatgtgtcattctaatagcttccattctctgtgaagtagagggcaaggtcatctactgagagttggggaggtcaagagagataaggggagattagaagagctcttctagcagagagtggaagaatgaattgctaagagagatgaagtaggattgttaagtagttttgagggccctgttgagatgtgcttccagttgggtgtgattttctccagtagtgctttatttccctgggtacaggcagagagaaaaacaataaggctcatgtagggtttgtattttgttggacaagtcaaacagaaaagtcagaggacgagggagtttagaatgtttgcaaaagagttattgaaacgatgaaccgcataatctaaggtggtaagtgggtgaatagataaggaggatgtgaataggtaaggagaagaaagaaatatcagattattgattattgatggcgactctctaatacagctattatgccattttaaccgattaagaaactaaggctttagaaaattcataatttgccctaactgcacagctagtaagcagtggaaatgtgattggaaccagagttcttctgactcaatagactaaatggatgtaaggatgtagttgaaagaagggtgagctaaacgttgtggaaccatgagctctttctctggttgatatccctctctgtaagtgataacatgggtcacgctggataaaaccttgtggtgattggtgactttcctttgtccttcctcctgtgcctagtctggcgagtatctgcctttccctttcctttctcattgctgccacctaactttaggctcttccccttacatctgggtaactgaaataagatcacctttttgttccccttctgatttactttgacctaacattatctttactattttctttaaattaatgtttcattagtcttattctactcaggaactctgtagttccccattgcctacgaaaaaaagttaagcctcagccttatattcagtgactcttcaattggatattcagtccagttttactcctcctatgagccttctatgccagctccttgggtctcttgccctttcattgtctcagctctgcacccttctttctcttttttattcttttttttttttgtacttttttggttttctttttggtttctttttttgttttatttattaaacctccatcacacttcatcctatggagttttgaaccacagcaaggtgcagtatcatcctggggctctggaggaagtggcagggagtccaaaatgtcaccttagcttcttatctggggccacatgtatttctgcatctgctgcttcccacactcttgcccacaagtgtcgcttgtggaaataatttgagatttactgtctggctgaccctagtttcaatctcttttccaccatttgctaatcattctaccttgggcaaaacatagaattaaaagaaaacttcagacaagttaaatttgatggagtttaattgagcaaagaaaaaaaatgatccacaaattgggcagtctccagaatcaccgcagattcagagagactccaggggtgcctcgtggtcagaacaaatttatagacagaaaaggtaaagtgacctacaggaatcagaattgagacatagaaacagtgagattggttacagctcggcgtttgccttatttgaacgcagtttgaacactcagcagtctatgagtggttgaagtatggccgctgggattggccaacactcagctgttattacagatgcatactactaagttaggttttcgattttgtctgcctatttgagctaggttacagttcgtccacaaggactcaaatataaaagtacggagtcctcttcgggccatatttagttcgctttaacaattcccccttttggtcagcccctcaatttagagagattgaccaaaactttaggcgttgacaccactctctgtcaccatcataaagacttatttggtctcagtgtggaactcacaagtcgtctttagtttcagtatggagtctcacacatcttctttggtgttaatagggaattcacaagttgcaactttgtaccagctaaatgattctttatgttcttgctgatccagttggagtaagaccattcaactgtcaatgtacagctgcatacaaaacatttaagacttgagagtatacagtgcaccaaggggactattattatgactgttaagaggacaccgtcaaaatgctaaggtgtactccttaataaaagttcttatgaaatgaactgaaccaaatcagccaagttaaggttcagacaatataagcagttcagcagtattggggtctgattggtcagagtcttcagttggagtatgatagtgattaaggatcatagttcgctgtaaagtagcttgacttaaagaggtgctcgttttcattgttaccttgttaatacaagtcataataacttgaaaacctgctagaagagatataaagattagaaacccttggaaaacccaagcttgccattcaccacttaggatgcctgcaaaccaactgttagttgctcctataaacatatcgtgggttcctttctcttgagagatttctttattgtacttggtggcagtgtctaaggaaacagcagtatcagccaccttttaaattaagctttttgtagtaacagaatcaggggagggattagtacaaaattcagttttgtttaacaccaaacataggcctccagcttgagcaaaaagaagatctaagactgcatgatcttccattaagtgttttcgttgaatatgtatgttgtcatgtgcctttctgagagtagcttctacccatctgaaaccctgggaggtctgattggctaccaaatccaagaattttcccaatatacaaattagttttaaattccgtacaaatggtacttcactaccaccaagagtgagcccccaggaaccccagtggaatctttccccggtagaaactagcttatcctcgtctatttcgaggctagtgctaatttcagttattgatcattttggcctccaagtataagggctatcatgagaattttcaggggaagcaattcgaaaggcaggagcaggccaggccagataacaagaaccaaaccaaccaaggaggcagaacagaatatgcagattctccacagacccaatagagaccctcaggggttggaaaagggggccacctagttgtatttgagcagggatcattcaggtttgttcgaccatgaatctgtagctcctgaataacatccagtgggaaatttacttttctatggcccctttgtagtgtgttgtaagggtgtataaccacatctagtaaaaagagaccctactggatatacaagcaatcacttgtactaacataagtaattcccaaatcttgagtatgtgatgcctgcaagcacaatatacgttttgtaggcatcatttggatttgttttttatatttggtgtgatcgactttatcagttgaaaaagagtgttgtttttagtgagtgtaggaaagcaagtactagtgatgtttagagtatcaagaatagctttccattcttcccttggggtttcagggtgactcattgggaaacgtggaggggcactggcacccttggaatcatttcctgattttttggcattagcccacaaacccaacagttaccctggttttgtgctagagcataagcttgagctgaagccatccactgattatggtcccatggattttcatgtaaggaaaaggaaaggattagggaaaaaaataaggaaaacagaaaaacacataaggctttcatggtggtagagaagtcttgatctgtgatctagggaaagctgtctgtaaccaggatgctgtctgcttctgggaagagatttccctggtcagctttaccttaaagtctccaacgggtatatagtaccaggagtctgagggggcccttttgaattgtgagatgtggacccatggttcaaagccctgaagcttctctgcactgtgggtggtaagaaggacttggtatggtcccatccaacgaggttcaagagtgatcttcttctgatgtcatttccggaaggcccagtctccaaattccagaccatggagggtttgattgtcctcagttggtggatcttgaaatgcttcctttacctggtggaagtatactttggcgtaatacattaaagccttgcagtatttagtcatatcagagtttaagagagcaggagaagcatgagatgctattattagggacatgggcctcccagtgactatttcataaggggtcaatttatgttttccaacaggattgaatctgattgccattaaaaccaaaaggtagtacctttggccaaggcaactcaattgattcagttaacttggacagtttcagttttcaaatgccatttgttctttcaagctttcctgaagactgagggtaataaggacaatggtaatgcaactgtgtcagtaacaccttatttaactgctttataacttgctcagtaaaatgagttcctctatcactggagacttttagagggatcccccataaaggaaaaacattttctaataatttcttagctatggtcacagcatcagctttcctacatgggaaggcctttatccaaccagaaaacatgcaaactattacaagaacatactgataccccattgagggtggtaactgaatgaagtccatctgtaaatgttcaaatggtccatcaggtggtggaaatatactgcctctagtttttctgggattatgagtttgacaagtcaaacattgattataagccattttagtaatgtcagaatagtcaccccaccagtattttttcataatttggatcactttgtctgttccatgatgagctgtggagagctttcaataatggaagcttcaaagattcaggaaggaccaggcggccgtccgggccctttgtgagtctttgcttcacgttaaatttacatccttttagataccagttttgtttttgcaaatcagatgcgttgcactgtttattaaataggtcatcgtaaggaaattggcttggattaatcttatggagttcattcagattgcgtatcttgatggttccagcactagctgattgagcataaaaatctgctaaagcatttcactgatatttgggttcatttctacaagtatgagcttcagtcttaataacagcaatctgcatttgtaacaggatagcagaaaggagctcatctgtttggagtccatttttgatggggatcccactagaggtgagaaaccttcgtagtttccatatcatgccaaaatcacgtactactccaaaagcatgtctactatccgtaaatatttactgacttgtccttagctgtgtgacatgttcaggtaagggcagaaagttctgcaggttgggctgacttgacttgaagagttcgcttctctattaactcattttgggtggtaacagcatatcctgactgatatttttttttctgagtttttggcataggacccatcaacaaaaagtgttaattcaggattatccagtggagtatcttgtatagcaacacgaggggccactatttctgatactacactcacaccgttgtggtcttcaccatcatcaggcagagataacagagtagcagcattaagtagattacagccttttagatgaagataagaaggagataggagaagtaattcataagatgttagtctactcactgaaaaatgctgggtttgattggaatttaatagactttccacagcgtgtgggacttgcaaattaagttcatttcctaaaaccagatctgatgaagcttctaccagcttggctgctgctactgcttttaaacaattaggatatgccttagagactgggcctaattgcaggctatagtatgcagtggtcctatgtttagcaccgtgttcctgattattacattcatgaacaaacaaagtgaaaggtttagtgtaatttggaagtcctaaagctgggggctgttgtaaggccaacttcatttggctaaaagcctgctcatgactgtcttcccaaggtaaaggctctggtacagcatttttagtgagctcatacagtggtgaagctattaaggaaaaatttggaacccaggatctgcaatatcctgcaagcctaagaaagccttttgtcttttggttgcaggtcgaggaaaactttaaataggttttatcctctcaggtaagagggaaatcccttcagcagccaagtcatgtcccaaatagtggactttttcttttgaaaattgaagttttggccaggcatggtggctaacgcctgtaatcccagcactttgggaggctgaggcaggcggatcacctgaggtcgggagttcaaggacagcctgaccaacatggagaaaccctgtctctactaaaaatacaaaattagccaggcgtggtggtgcatgcctgtaatcccagctactcgggaggctgaggcaggagaatcgcttgaacccaggaggcagaggttgtggtgagccagtatcacaccattgcactccagcctgggcaacaagagtgaaactccatctcaaaaaaaaaaaaaaagaaaaaagaaaagaaaaaattgaagtttttccattgaagccctgtgacctttatatgcaagttgctgtaaaaggtaaactgagtcaatttccgggcactccttaataggagagcataacaataagttatctacatactgaatgagagtagaattttgaggaaactgtagtgtcattaactcctgatgcagtgcctggggaaaatatgaaggggcttcagtaaacccttgtggcattacactccaggtgtattgctgatttttccaagtaaaggcaaacaagtattgactttctttatggaatgctagagaaggctgagccaagatctattactgtggacaacttggaatcagtgggtacattaggttataaagtattaggatttgggactacaggaaatcttggtattacaattttattaattgcctgtaaatctggaacaaatctccagtctcatccattttgttttttaactggtaggattggagtgttacaggggctggtgcatggaattatgagtccttgtttaattaaatcttctacaattggtgagagcccttaaattgcttcaggttttagtggatattgtggtaattaggcaaaggtttagaatgatctgttagtacttttataggttctacacttttaattcttcctatatcagttgggaagaggcccataaacattaggtgttttcgaaagatcaggggtattacaggcttgagtttcgatcttatcaatttctgcctgtagacagcataacaattctagttcaggagaatcaggaaaactcttaagattatttctgtttctgaggaaaattttaggtgcccttttagctttgaaagtaaatcttgccctaccaagtttactggaacagtatcacgtagtaaaaaactgtgtttttctgaaagggggctcagagttaattggatgggttcagatatgggaacctctggaacttgatttgaaacccctgtcacagaaatgacctttttactctaagggatttgttggcttattaaggtggggtttatggtagatagagtagccctggtatccataaggactatacacaactccctatttattttaacctctgtttccccatgttcctttaaaggtattacggggagcaatccactggagaatcccttagagcctcctttaagttgaatattgtcaggaggactaaggtctcttgggctccctctagtggtgaaacagtttggcctagagggaggtttatcagccgacaatcccttttccagtgccctggttgtttgcaatacaggcagacatcttggggtaaagaaattcttgttctgggacctcttgatttgatttttttaatatataattttaaaaatattttccaaagtgtgacttaaaaaaatttttttttattatactttaagttttagggtacatgtgcacaacgtgcaggtttgttacatatgtatacatgtgccatgttggtgtgctgcacccattaactcatcatttacattaggtatatctcctaatgctatccctcccccctcccccaaccccacaacaggccccagtgtgtgatgttccccttcctgtgtccaagtgttctcactgttcagttcccacctacgagtgagaacatgcggtgtttggttttttgtccttgtgatagtttgctgagaatgatggtttccagcttcatccatgtccctacaaaggacattaactcatcattttttatggctccatagtattccatggtgtatatatgccacattttcttaatccagtctatcattgttggacatttgtgttggttccaagtctttgctattgtgaatagtgctgcaataaacatacgtgtgcatgtgtctttatagcagcatgatttataatcctttgggtatatacccagtaatgggatggctgggtcaaacggtatttctagttctagatccctgaggaattgccacactgacttccacaatggttgaactagtttacagtcccaccaacagtgtaaaagtgttcctatttctccacatcctctccagcacctgttgtttcctgactttttaatgattgccattctaactggtgtgagttggtatctcattgtggttttgatttgcatttctctgatggccagtgatgatgagcattttttcatgtgtcttttggctgcataaatgtcttcttttgagaagtgtctgttcatatccttcacccacttgttgatggggttgtttgtttttctcttgtaagtttgtttgagttctttgtagattctggatattagccctttgtcagatgagaagtttcagaaattttctcccattctgtaggttgcctgttcactctgatggtagtttcttttgctgtgcagaagctctttactttaatgagatcccatttgtcaattttggcttttgttgccattgcttttggtgttttagacatgaagtccttggccatgcctatgtcctgaatggtattgcctaggttttcttctaggatttttatggttttaggtctaaattaagtctttaatctatcttgaattaatttttgtataaggtgtaaggaagggatccagtttcagctttctacatatggctagccagttttcccagcaccatttattaaatagggaatcgtttccccgtttcttgtttttgtcaggtttgtcaaagatcagatagttgtagatatgcggcgttatttctgagggctctgttctgttccattggcctatatctctgttttggtaccagtaccatgctgttttggtgactgtagccttgtatagtttgaagtcaggtagcgtgatgcctccagctttgttctttggcttaggattgacttggcaatgcaggctcttttttggttccatatgaactttaaagtagttttttccaattctgtgaagaaagtctttggtagcttgatggggatggcattgaatctataaattaccctgggcagtatggccattttcacgatattgattcttcctacccatgagcatggaatgttcttccatttgtttgtatcctcttttatttccttgagcagtggtttgtagttctccttgaagaggtctttcacatcccttgtatgttggattcctaggtattttattctctttgaagcaattgtgaatgagagttcactcatgatttggctctctgtttgtctgttattggtatataagaatgctctcttttgttctttgttagtcttgctagcggtctatcaattttgttgatcttttcgaaaaaccagttactggattcattgattttttgaagggttttttgtgtctctatctccttcagttctgctctggtcttatttatttcttgccttctgctggcttttgaatgtgtttgctcttgcttctctagttcttttaattgtgacgttagggtgtcaattttagatctttcctactttctcttgtgggcatttagtgctataaatttccctctacacactgctttgaatgtgtcccagagattctggtatgttgtgtctttgttctcattggtttcaaagaacatctttacttctgccttcatttcgttatgtacccagtagtcattcaggagcaggttgttcagtttccatgtagttgagcagttttgagtgagtttcttaatcctgagttctagtttgattccactgtggtctgagagacagtttgttataatttgtattcttttacattttctgaggagagctttatttccaactatgtggtcaattttggaataagtgcagtgtggtgctaagaagaacgtatgttctgttgatttggggtggagagttctgtagatgtgtattaggtccgcttggtgcagagctgagttgaattcctggatatccttgttaactttctgtctcgttggtctgtctaatgttgacagtggggtgttaaagtctcccattattgttgtgtgggagtctgagtctctttgtaggtcactcagggcttgctttatgaatctgggtgctcctgtattggttgcatatatatttaggatagttagctcttcttgttgaattgatccctttaccattatgtaatggccttctttgtctcttttgatctttgttggtttaaagtctgttttaccagagactaggattgaaacccctgcctttttttgttttccatttgcttggtagatcttcctccatccctttattttgagcctatgtgtgactctgcacgtgagatgggtttcctgaatacagcacactgatgggtcttgactctttatccaatttgccagtccgtgtcttttaattggagcatttagcccatttacatttaaggttaatattgttatgtgtgaatttgatcctgtcattctctcaacatttgcttgtctgtaaaggattttatttctccttcacttatgaagcttagtttggctggatatgaaattctgggttgaaaattcttttctttaagaatgttgaatattggcctccactctcttctggcgtgtagagtttctgccgagagatcagctgttggtctgatgggcttccctttgtgggtaacctgacctttctctctagctgccattaacattttttccttcatttcaactttggtgaatctgacaattatgtgtcttggagttgctcttttcgaggagtatctttgtggcattctctgtgtttcctgaatttgaatgttggcctgccttgctagattggggaagttctcctggataatatcctgcagagtgttttccaacttggttccattcttcccgtcactttcaggtacaccaatcagacgtagatttggtcttttcacatagtcccatatttcttggaggctttgttcgtttctttttattcttttttctctaaacttctcttcccgcttcatttcattgatttgatcttccatcactgataccctttcttccagttgatcgaatcggctactgaggcttgtgcatccgtcacgtagttctcgtgccttggttttcagctccatcaggtcctttaaggacttctctgcattagttattctagttagccgttcgtcgaatttttttcaaggtttttaacttctttgccatgggttcgaacttcctcctttagcttggatagtttgattgtctgaagtcttcttctctcagctcgtcaaagtcattctctgtccagctttgttccgttgctggtgaggagctgcattcctttggaggaggagaggtgctctgatttttagaattttcagtatttttgctctgtttcttccccatctttgtggttttgtctacctttggtctttgatgatggtgatgtacagatgggtttttggtgtggatgtcctttctgtttgttagttttccttctaacagtcaggaccctcagctgcaggtctattggagtttgctggaggtccactccagaccatgtttgcctgggtatcagcagcggaggctgcagaacaacgaatattggtgaacagcagatgttgctgcctgatcgttcctctggaagttttgtctcagaggggtacccggccatgtgaggtgtcagtctgcccctactggggggtgcctcccagttaggctattcgggggtcagggacccacttgaggaggcagtctgtctgttctcagatctcaagctgtgtgctgggagaaccactgctctcttccaagctgtcagacagggacatttaagtctgcagaggtttctgctgccttttgttcggctatgccctgcctgcagaggtggagtctacagaggaaggcaggcctccttgagctgcagtgggctccacccagttcgagcttcccagctgctttttttacctgctcaagcctccgcaatggcgggcacccctcccccagcctcgctgccaccttgcagtttgatctcagactgctgtgctagcaatgagcgaggctccatgggcataggacccgctgagccaggcgcgggatatagtctcctggtgtgctgtttgctaagaccatcggaaaagcgcagtattagggtgggagtgacccaattttccaggtgctgtctgtcacccctttccttggctaggaaagggaattccctgaccccttgtgcttcctgggtgaggcgatgcctcgccctgctttggctcatgctcggtgcgctgcacccactgtcctgcacccactgtctgacaatccccagtgagatgaacccagtacctcagttggaaatgcagaaatcacccgttttctgcgtcgctcaagctgggagctgtagactggagctgttcctatttggccatcttggaaccgcccgattgtgatttaaaatgagaacgagatggtccctttggttcctggtccctgtaactgttgcaattgaaggggcataagcttattagccttttgaggttttttttgctctagagtcttctcaaaatgcttagctaggttgggcacgatggctcacgcctgtaatcccagcactttggaaggccaaggtgggaggatcacgaggtcaggagatcaagaccatcctggctaagatggtgaaatcccatctctactaaaaatacacagattagctgggcatggtggcacacgcctgtagtcgcagctactcgggaggctgaggcaagagaattgcttgaacctgggaggcagaggttgcagtgagccgagattgcgccactacactctagcctgggtgacagagcaagactccacctcaaaaaaaaaaaaaaaaaaaaaaaaagttcagctaaggccaccaattcagtcacatctctaacttcccattgcaacttatgttttttagttaaactgctaagttcaggatggagtccatttataagtaaagcagttaatgctgtttcagcccctgcagggaatactccttgctgtactttgagcccaggatgtttcacaaatatttctaagcgacttctgtaatctgaaactggttcatcttttcttttcttttttttttgcttacaagattgtatgatggaccaattttttgtggaaaaattttaggaactgaatgttaaaaggttttcagcgatttttctagctatttttggtccttcttgtgaggagctcttagagggccctttaaaatgtcctcctcaggtttgtcccattctgctgctgccatccatttctgagcttcaccagcccccagtatcatatgaataaattggtaaattcatgaagtcctggatcgtaagctcctattaggattctaaattcctcagtaaatttttgagacttttcccttggaccagggaagtccttcacaatggggctaagctcagttttagaccatggagtgaaagtagttacagcaggcaggcctggctgatataaggtctcactttgtaagacatctgtctaacttccttttttttttttttttttttttaaatcatcttcagggtgaaagtgtaatttaacaaaaagtttagtggactcagagtatgtaggtagagatggacaaagaaggaacagtccgagttagatcagtcaaagtacagtcctctttcttcatgtccttggtctgttgcttaagcttttcatttggtttttgcaaagaatcttttaaggaggcactttttgattcacttagtcttttggaggcctttgcgtatccatgagacaatacatcccactgtatttgtgggggctttgatcccctttttctaatatgccttgcaaacaattttatccaaattaaaacttctccattgtggccattttaattctaagttttctttagtgaggttaacccattttactgaaaatgcacatgttctgggcccataatttttatacgtaaaattagctggagtccctgaagatggagtcccagactccttggattgagatgatcccattattaaataaggtacttatcagaggtctgaggcctctaactgaatccaatccagttaattatcaaatccaatttgatcttggatccagtccaggctaagtattgcttgagtaaactcggagagctcaaaacacaagttagtggagctcggaatctgagagaaaactcacccatgacctccagttacaatcaagagaccagtgagagcaacggcctcagtgggtacctcaccaggtcacctggtgttccagggggttgccagagtttttcttcaaatcccacttctgacaccagatctgttaaaagaaaacttcagacaagttaaatttgatggagtttaattaagcaaggaaaataaacactttgcaaatcaggcagcctccagaattgaatgcagtttgaacacttagcagtctattagtgcttgaagtatggccactgggattggccaacactcagctattattacagatgcatactactcaggttttccattttgtctgcctattgtgctaggttatggtttgtccacaagaacacaaatatagaagtatggagtccttctcaggccatatttagtttgctttaacaatacttaaaaaaaaaatttgtaaaataaggatacttaaccttactcggtgtttctgagagttaacatttatatagttatgctgtagtgaaaacagctagcgtaatgtctggtatgtataggaacacaagagataccgcttttcccatatccccataccattcttcacagcattgctcctgtcttccttgattcctcctcctccttctttgttttttttttgtttgtttgtttgtttttttttggaggtggagtctcactctgttgcccaggctggagtgcagtggtgtgatctcagcttactgcaacctctgcctcctgggttcaagtgattctcctgcctcagcctcctgaatagctgggattacaggcacacaccaacacactcagctaatttttgtatttttagtagggatggggtttcaccatgttggccaggctggtcttgaactcctgacctcaggtgattcacccacctcagcctcccaaagtgctgggattacaggtgtgagccaccacaccctgcctccttcttaagaagtttccagtcccttgtaattaaaggaattaatattttttaactacttagaatcagactggccctgattattagtaagcaactaatagtaagcaagcaactatgtatgcaactatgagtgtatgttaagatatggttgttggtaacctttcattctcttcaggaagaagaagagggtggagctctacagtcaatgtgtacatttaaattctgttccctttcgagcttttttgctactttcattcttctggggatccaggtgcttgagttgggattgattaacttccttaatttccacccctgtgctgtcaggatcgggagacatagatgaaggtgttctaaactgctagaaattttgtttttgaaagcaaaagtttgcatgcatttttgttttcaacttttacttacagtgaatagtagttaataaaataagtccctgccttttctctctttggtttcaattcctgagaccaggatcatagcccacatattagagtggagtcccactgctttggtttgaatcatgcctttgtttcttatgtcagtgtgactttgggcaagttatttaagtctttgcaccacattttcctcatctgtaaaatgaggataatactagtactttctacatgggattgttagcaggattaaatgagatagcacatactgtaaccatgtctggcacatagtcaatggttagtaaatgtgaactattgtgtgacattgtggttagtcacgtatggggctgtgtttcctttagtatattgctcttttaatgtcatttcctttgtactgttaccctctctgatctttcttccatattca

SEQ ID NO: 175 - DNA, 4193 bp, Homo sapiens; identical to SEQ ID NO: 104
  source 1..4193: mol_type = genomic DNA

SEQ ID NO: 176 - DNA, 17476 bp, Homo sapiens
  source 1..17476: mol_type = genomic DNA
gtgagtggagcccgccgctccccggcgccgccccctgccccacacccggtcacctcctcctatcccgccctcaccccgcgtgctgggagtgcgggaccccgtgttctgcccacctgttgctcgccgtcttcggtatgaccgacttgcttgtggaaagcactcttttccataacctattactcagctttgtcatataggtacctatgtatattaaatattgtacatatctatcaatgttaactaactcacttcaagatttcacccctttctttttctactccgccggtccgcgcccctcactggtgcggacttaatttgaaggttcagggagtctataaacaccttgagatgctatgcagaatttttggtgtgtacgatctttttctgggagaaggagcccttcaattttattagatttgttaaataattaatgacccccataaatatcttggggaaaaaaaccgacagcactggcgctcctacaacctataaattgggattgtgctgtcttatgcaagtacttcggggcgctccaccctgtgtgggaggcgagtggtggatctagggagtgaagaaaagtagttaggaggctttggtccagggaacaaacacgccgaggaggaggtaggggactttggccctgccggcaacagccgtgcccgcctagctgcgcttcctacccccaccagtgcgggcgtgatgcaagtctgatccctccaaaaaattaaacccgaaggtgaaaggggtgtaagcacacacatgcacactatgttcatgattgatagacgggggaggtggaagggaaagaagatggcaagccacttgtgaaaattagagatcatgatgtatccttttctcccctgctgaagtcaggtgatgggatcaactcagtgacccttgttttacttcttgttgctgtgtatgtgagtttgcattataaaagcactatgttggcttatagcaaaaagaagaggaaagaaattgagcaattaagttggaatatctgtttcctgcaacgttcagttgtttctgtatgaagtaacttgggcattggcgaatgtaggctaacccattctagtttctattaggaaaacagaaaaattctaacaggccagaccagagatttcaaacagcagagtctgggaggctgtactgtgtgtgtaaaagaatcctaaaggatgacgtagtcaatattaacatacttgaaaggtaaagagaagatgttcaatgatcgtagttaatataactgagtgcatactatgtgccaagaattgggcgatgtggtttgcattcatttgagatatatatatatatatgtatttaaaaacttgtgagttaggtattttcatcctcattttacagatgaggaaactaagcagttaagtaacactgaagctctaatagatggtaagtggcagagctggtatttaaactcccaaacctgaattttaaacttatcagttttatcattaagttttaaaatgattaatacaaagtgggatttgttagatgctaagcctctccgtggccccctcccatttttctttaaataaaattgaggaagttctgaaaggctggggaggtctagaaaacacagaactgctgcaatacatggagggaaagaccttatatttatttagacttaggggtctgactaaagactgcgggatgagtgaggccagtctttgaaaagtggagccattacacccattcattctctgtgcccataggtccagtgctaaactgaaaccaaatcagcttcccctgcgtaggagacacaggaggcatattagatattctttcttatcctctgagaatggccagctaggaagagagcaagcagatacaactcttccataaatggagggaatggagccatgaacagaagaaaagggaatgttgctgagcatctactatgtgcctattccagaatcttcattatattcttgaaacaattgctgagatagatatgagaatccatctcacatatgaagtatgtgtctgtcagcaatggttggaaatttaatcccaactccacacataatctgttctttctacaaagtaatgcatcacctgtgtgatgaattcagcaagcatcaaatgagtatgttcttcatgccgggcgctgtgcaggtgctgaattaaacacaaagactctgcttgctttaaagcaaaaagtttgaagaaggaagccaaccgctagaaaaatacattaccaaataaaaagtagtaagtgacccaaaagaatggctaatatattatggagtttagaagtgtaaattggctgggcgcagtgactcatgcctgtaattgcagcactttgggaggccgaggcgggaggatcacctgaggtcgggagtttgagaccagcctgaccaacatggtaaaatcccatctctactaaaaatacaaaattagccgggcgtggtggcacatgccggtaatcccagctactcagctactcggaaggctgaggcaggagaatcgcttgaacccgggaggtagaagttgcagtgagcggagatctcgccattgcactccagcctgagcaacaagagcgaaacgccatctcaaaaaaaaaaaaaaaaaaaaaaaaagtaagttactcctggtggcaggaaattttgaaaagcttcctggaggtagatctcaaaaattcagtaggactggacatagggaggtgactggagaaagatcattctaggagggaacagaatgaatatttcacagttcacagagttgatatggtagaacaaagggcactatcttggtccttctgctataatgcttgggtcaactacttgactggctgttccaactaaggaacaaagcgtttgaaatattttgattgcaacagcagctttccagtaagctgaaatacactctgcagcctacacagaagtacaaatcagacagagagataaggcagcaaacaacacctacttactttaaagcctcagctttctaagactcaaaaaggaaatcagcttcaaaggaatttaacattagcatgccatgaaacaattaccaggggtggttcgtatgtattgtttaattaaacttctttgaaaaggtctgggggctcgtggtggttctgagtataatttttattatttccatgttactatcctgtctctcaagttgaaacagacaagcaattgttgaaacagtgctggtctggaaaaaatcctgtatcaacacaagaaattccaggaagaaaagaccctgatgttaactgctattagctccagggccctggagaattctgagttgttgacaaacctgtaaggttgagacagcggataacctgctgaaagcagagatgagataaatgtggctgatttgttgataagtatcttgcaagagtctttaaccctttgtcttctttccaatgccttagtatagctgggtggttttcattgtaaatcactcagtgacttttggtgttatttttaactgtgctgaacattttaaagttggctgtaactctttgggaaggggccttcagaggtgtatagcagcattgtgaagtaagtctgtattgtagctaatagttaaaatatttttctaaaatagaagacatttaagaattgcaagtattggcaaagggaaaaattaaaagcatccatatcctatttattacacttgccttaaaagtactacttgctacacagttctccccccccccccgcccccaccccaggtatctgagtggagagaaaattgtgttttaaattgtatttactacttataaaggacagtgaacaatctcctaatgcaattatatttacaacctctttggaaatccaccacaaaacttgaggcacactattatcttaggtgatttccttggtgaagctgcttttcaatatctgtgatcaaagtgaattctgggctgggcgcagtgactcatgcctgtagtctcaccattttaggaggccgagacgggtggattacctgaggtcaggagtttgagatcagcctggccaacatggtgaaaccctgtgtctactaaaaataaaaaacaaattagccaggtgtggtggtgcatacctgtaatcccagctactagggagcctgaggcaggagaattgcttgaacctgggagtcagaggtttcagtgagccaagatcatgccactgcctccagcctgggcgatggagtgagactccatctcaaaaaaaaaaaaaaaagtgaattctggagagagaattgaaaattggctcagggtagcaaaagaaaggtagttactaggcgctactgttaaaaaaaagttagacattgttcaaattctgcataaattcttcctttgacaaaaaggaatcccaggaatgaagcaattctggggagcaaggtgactaatcgttcagaaagtaggagggatcaggaaagggaaaaaaaagagtgagatggcgggtggcagggtcatggccctctgctctgaatgtgaggtgtcagtagcacactggattaaatgcacctctgtgtctgtgtaatatggcctgtgagccactttttgtccagggccaagcagattgagttcggtaagtccaaaaataattaaagaaatccttctgattatagtaagtgaaatagaatgttaacaaaatggtagttaacaacaacaacaaaaaaaacttcacacccctggaaatgttgagaacacatctcttaggggtgaagttttgtgtgagggtaaagtaaggatgcttcagaatccgtggaactgtaagaaaccacaagtagacccagagtagcagggtttgattatgaaagtacattgttctatatgtgacagataagacgcaggaaattaccttaaaggaaggaagactgttcatttaggcttttaaaagactgttgttatctgtatgccctgtgctaagagttccacagtcatgggaacagagggtagcttttgtattaaatattctaggtatttgtagttcacatttcctcaaagttttagatagcaactttacagttttttctcatttattaaaataagcctatacatagttacattattttatcttcacattttaacattgattttaccctacaattgaattcctagtctgatcaatacaaattattaaaagttttgattttttttctctgagagaacaagcatattattggcaaactatgatagtaatgaaatataataaatatgatgctaaaacctctggagtttataaatcagatgattaatatggcctataagatgatttatttccatctcagatgacattcaacaagtttaaattatacaattctgagacaaatgttggacttcaggtatcttgtgcatgtctacaaatatatgaagataaataccctacttctcctgaggaagtaaattagcagtaaaaggcagcaatgcaagtgggaatagacaataaattaggagaaaactttatttttctattagagtgagccacctggctcccctgactagtagagtaagactactaaacaaactatcaagtgctctcataataaaaacattaaaaacctgttgtgtgtcttttcttttcttttttttttttttttgtttcgctcttgttgcccaggctggagtgcggtggtacgatctcggctcactgcaacctctgcctcccgagttcaagcgattttcctgcctcagcctcccgagtagctgggattacaggcacccgccaccaagcccagctaattttttgtatttttagtagagacagggtttcaccatgttggccaggatggtctcgaactcctgacctcaggtgatccgcccacctctgcctcccaaagtgctgggatctcaggcgtgagccaccgcacccggcctgtgtatcttttctataatgccatttctggtaattggatattggacataaaaacagttgtaatgttcttaaagtgtttaaagacaaaagcttgagagctcaatatgtagatttaaataaaaatggacagttggaaaaaaagaaacttaagcatttgaaaacacaacctgccattactattaaaataattcacatatttatattcttggaataatcagctttagacttaataacattcgttaacctaagcagtcataatcaaagttctgcaattccttgatttccagaatttgtggatgaaaaccttcattagaagcttaatggattattttttctgaatctctcagtaagctatttatggggtgggtgtgggtgagcatcaagcttattggatcttgattactctttttcattgaagaatgaaaacaaatgggaacttttcttgacagataatatgaatttataggccaccaaaatattacagataaatacacaagccatacagataaaagaatgatagtaaacatatattattcaaatatagaaacaaccttgccaaaatgaacaaagtcagcttttctttttttttttttttttttttttgagatggagtctcgctctatgcccaggctggagtgcggtggcacaatctcggctcactgcaacctccgtctcctcgggttcaagcgattctcctgcctcagcctctcaagtaagtgggattacaggtgtgtgccaccacacccggctaatttttgtatttttagtagagatggagtttcaccatgttagccaggatggtctcgatctcctgaccgatccacccgcctcggcctcccaaagtgctgggattacaggcatgagccactgcacctggcccaaagtctgcttttctaataaaagtctgcctacattctggggaagcaactttccttcctctccgtatacccagaatgacagagaacagtcgaaactatttgagcaccttccatctaccccaagacaaaagcatgtatgtgactatcatactcacattttagttccattctggtgagccacagaatacatacctgcctgaatgattaagcgcaaactgaatttgtgtaactaggatatttctaatgtacaggtaatctgactaatcaacaattaacttgtcaagtactgatacaagactgtgctagaagtggtagtgtaagatacagttctttctgtcaaaatctctttggaagagaaaataacctctttgttttaacgtggccccactccaatccattctccacacagctgctagagtgaactttctaaaatctcattgcatcatttcccagtttaaattccttcagtttcttactgttatctgcaagagtaaaattattgaacacagcattccaagttcttcgtgatctaatgcctgcaacttctcaaacttcatccctggggccactacccttgctccccaccaaacacacacaggcagtttatcttgcttggtatttctacccctccttgtctccctcccttccttctcttgcccagttaacttagttcagttgtgtcccttataggcagcctccttcacccctctcctctgatcttgaatgcaagttaaagaatttgataattgtgagtcacagatatttccacagggaagaaacatgaaaagtgcaggagttttgtgaaaatacatttgacagatttggtggatttaaagtaggaacagacctagcatggtggctctttcctgtaatcccagcactttgagaggccgagacaggagaatcgcctgaggccaggagttcaaggctgcagtgagctctgaatgcaccactgcacgccagcctgggcaacagagtgaccctgtctcaaaaaaaaaaaaaaaagaggccgggcgcagtggctcacgcctgtaatcccagcactttgggaggctgaggcgggtggatcatctgaggtcgggagtttgagactagcctgatcaacatggagaaaccctgtctctactaaaagtacagaaaaaataagctgggcgtggtggcgcatgcctgtaatcccagctacttgggaggctgaggcaggagaatcacttgaacccgggaagtggaggttgcggtgagccgagatcgtgccattgcactccagcctgggcaacaagagtgaaaatctgtctcaaaaaaaaaaaaagaaaaagaaaagttgggttagcagttatgaatcagttgggaggggttaaccctggcacgtgagaggcaggggaaatataatgacttgaaagtcattacaaagaaaacctgtagtaagtattttaaagcaaaaaataatttgtgagttctataaattcacctttttttatattattgggagtataatgtgatatttgccatggaagttataaagtcttacaagtcttaaagtctcatgagatatctcagcaaataattggcaggaatgccaaagtaaagacacagttacagaaatgaacagtgtattcattcattcattcatgagacagcgtctgtctctgttgcccaggctggagtgcatcttggctcactgcaacctctgccccccgggctcaagccattctctcacctcagcctcctgagtagttgggactacaggtgtacgccaccacacccagctaatttttgtattttttttgtacagatggggttttgcctttttgcccaggctggtctcaaattcctggactcaagtgatctgcccaccttgacctcccaaagtgctgggattacaggcatgagccaccgtgcctggctgagaaatgaacagatttagatacttccaggatatttctatttaatacttcaccaggatgctaaattaccagtttataataacaaattctacaattacatattctaatacctcaaacaaaatatgacatgaacacctgtgatataaaagggccatttaatggctcacgcctaaagcgctggcactttgggagcccgaggcgggtagaactcttgaggccaggagtttgaggccagcctggccaacatggcaaaaccccatctctactaaaaatacaaaaattagtcagcatggtggcacacacctgtagtccagctactcggaaggctgaggcacaagaatcgcttgatcctgagaggaagaggtttcagtgagccaagatcgcaccgctgcacttcagcctgggcgacagagcaagactccatctcaataaaaaaagtgggagggggacatttaaaatgtgtttttgtcattacctagagcagtgatttgaggattgccccccaaatgtcataaattggtatatcagaagatagctcttgaattgcttagggggctcctgaaaaataaggactctagtggctggtatatcgtgtgagtgataacagcaatggattagtcagtcgcacactggcatgtggtatgtgtggcccactcttgcaggagagctgttctgtccctggcatattcaacgttttaagaactcatagccagtactttctagcatatacctgatacaccaagttgtttctcatggttgattatgtgagctaactggtcacaaaatatagcactgtacaactattggttaaattttcaatagtataaaactttattagactttcatctgctttgaaacaatttttcaccatagtgttccctttttttttttcctttttgagacagagtcttgctttctgtcacccagcctggagtgcagtggcccaacctcagctaactgcaacttctgtctccagggctcaagcaatccacccacctcagcttcccaagtagctgggactacaggcccatgccaccatgcccagctaatttttaaatttttaaaattttgtagagacgagatctcactatattgcccaggctggtctcaaactcttggactcgagtgatccacccacctcagcctccccaagtgctaggattgctagtgtgagccaccctgcccagccaactatagttttctaaaccaacaaattctacttattttccagcctaagcaaatgcttacttgggctgttgtgatttccatcaatatctggttgttcttcttggaaagtaagaatagaagataaaatatagttttaaaaaatatgtaagtccaaggaaatgaatcgtatgttttatgccaacacagacagacaaaaaacaaaaaaaattccttcaccaactcaggagtgcggacatacgtatggtctttgatgagtctcagtatattttctgctttcttttaagctcctactattgctagtaaatgactttaaggatccattcaaatatgaattgctatacaaattcctctgaataagtggcaagatcccatgtcttacctggaataacatgtcctcaactttactgtaatgggagaagttaaatcttttaagatttgtggagaacgagagctgttgcaagccagagattactgtagaaagaccaaataacagtaagatgataagcttttagactttcaggctctttccttctaaaagaccatcgtgaatccacactgtgaggacaactgctcacggttgttagcccaattacctgcagcatttaaatcaatactaatagcgaacacctgctgatttctgtggttacatttaaccacacctgtttttgtgggcacctctacatgtatcttcatctccagaaatcctccttttagagctcagtgtgaaccaaatcactttttttaaaccacactcagtgctagaagattgaaagaaaagacgcttttctgaatgtgagtgcacctctcttctctctaatagaagcaggctatataaagatcttgcttgtttagcagttctctgtcatttgcttactataaaagaaactgtagttggttttttataaatatgcccagaaacaggtaatggaaccacaatagagacttgtcaatttgatttcataaatacattcaatctaaccaattacataataaaattgttcacaaaactgtgattatgaaaatcaacttagttttttttttgggggggggacggaatcttgctctgttgcccaggctggagtgcagtggcacagtctcacctcaccgcaacctctgcctcctgggttcaagcccggcccccaagtagctggaattacaggtgcccaacagcacacctagctaatttttgtattttagagacagggtttgtattttatgttttagagacaggctttccccgtgttggccaggctggtctcaaactcctgacctcaagtgatctgcccaccttggcctcccaaagtgctgggattacaggcgtgagccactatgcctggccttattgactattttaaccctgacaataattcattatttcgagcaatgtttgtattggtgaccaaacacaaagcttctttttccataacagctgcttaggaatcatatcattccaatgaacactcagattgggaaagggagaaaattacattgtcctgtgacggcttcacctctgcaattttctgaggaatttagaatcctaccaccatccaaacagacctccttcaccattacccgcccccgcaattggtttgacctgaattgcttgttatttgagaagagtggagtttaaagttgctctgcaactacctactttattttccttaaaatgggctccataaaatgtgcatggtatttttagaaaaaagtataggtaatgttgcctgagcccatgttaatttgaaatatttcctagtaaatcatccccttctttaggaaacatcgaaagcacattatgcactgtgcaggtgaaatgaatggctggaaaacacagtaatatcatcgtgctcctcagtgacgggtcaatcagaagtcaccagaaaaagtccaattcaagaccagtggtaaacttagcagaaaaaaaaaaaaaactgctctacaacacagtgtaaaccatgcacactagtttatccctgttattagaatagactaattcatgaaaaaatgtgaaaatcaaatttttatgactcaaattctatttagaaaccttatctcatttttgcatattgcttgtgtagaggagaaaagttttcttttcttacccgtcaccaggtttatgcctgagacccctataacaaaagacagattaaaaagagaaaagcataacaaatttgtttaatataagttttatgtggcatgggagtcttcagaaatgaagacccaaagaaacagggaagactgtatatttattttttttcttgagatggagtctcactctgttgcccaggctggagtgcaatggcgtgatcttgactcactgcaacttctgcctcctgggttcaagtaattctcctgcctcagcttcccaagtacttgggattacaggtgcctgccaccacgcccggctaatttttgtcattttagtagagacgggatttcaccatgctggccaggctggtcttgaactgctgacctcaggcgatctgcccacttggacctcccaaagtgctaggattacaggcgtaagccaccttgcctggcagaagactgtatttttatagacagtcatgcagaagtctgatgagacaaaggtgggcctgatctaatggtaataaactgagggaatttagcaaggcttctttgttcaaattcttccctttatgacattcctttcctccaggtatagggaggatccttctggaatgagtctttgacctaattcaaaggaaggtcagcttgattttatatggtctgcttcaagggagaaggggtgagaggaaggcgtaaggatacacttcctgcgcctgctgcttcctcaaatgccaagtgccatattttgggatgacacgtcctgaaacccatcacttcacaattttgaaagcgtttgagtctatgctttctcaggtaaaccctctctctcagcagtcctattagtagctggaattacgggaaacaggcatctaactgatttgtccagacacatacaaagcggtagaataggggttccagatgaagcctacggatttcttcaatgtagggaagatgcctacttctttttcgaaataaacaaatcctttgaaatagaatcacacctcaattttcagtgtaagaaaatctggattttcatgttggatttgtttaaagctggatgcacctttgtgtatgtttttgtttgctttcttctattttcagaaaaggacatggctgagttattttatatgttcaacggtcatcacgatatcatcttattctctgaacagaaaatgacttattttaaagaaattcatttccatccttattagtatttactttaaaaaaattttactcagtccaaaatttctttaaaatcttagaacacagctattaattcatctttaatccagcatactgatctcaaactcatgactgcctaggcaaattagtctgcagtatttgttgtttgagattggctatttatccagaaaaaccatcgattgtgccaacttgcaggctgaatatctggagtcacatctttcatgtgtattccacagggagagtgtctgtgatttaaaaattcaatcttatttttttccctgtttccaactactttgtagttatttggcgaaccattaaaacagcctcagttcattcatctgaaaactgaagaagcagctttcttctaagaacttatgttggcaaataaagaattaatatttacagagtatttggagttgcgtaagtgaaggttttagaggaaagaaaaataatttttttgtcctcagatcaaaactataataataatccctctaaggccttgataaatgacaatgtcatagtagccaccttgcagtcagacagcagagaccaggggaaaggaggaacccaggttgatttaataatcaaccctgactattaaatctctttgcaatttaaagcaggtaatttaagtttccctatttataaacagagatgatagtagctggctccgcatcacagaatattataaaggaacataaaataatttgagctccttaaaggaaaagtcacattgaaatgtaaggagttcacacaagttgctttaaaaaggcttaaaactcacagcaacaacttgaatgtttaatgtcagttaaacattttagttcaataaacctgattataaatctcactgattaattagctatttgataggagatactgtttcactgggtcctgtccaaagattcttacacatttagaaaacctttgcagggatctcagcttaaagatggaagaagcacgccattaactgttcctgaatatctacctactcctggaattagggcaagggtatattccaggtgatgatgggctaaaggggctgatttacagagtttttcttgaattcctaaaattgcctgctttcatcacctgccgttttattatagagtaacaggaattaatggttccagctacggtccataaatgaccattagtactttgccattctagattgtccctgactttcctaattcagttttcatgtggtctaaaggtttgaacatggatagccctaaactaatttttataaagacagtaaattggatttcttatgtatcagctaactaataatgttctgcctggctgtgggctttgtacaaaggcttgttttattgggggtggggatagtgtaagcactctccccagccacatccctctaccccgaacccttcccctttctgcatattcccagtgctgagggtactctggcccccggactcttcaggattagaacctttttatgttccctgtacctggcctgctagcctcctttcccacagcagcctggcccttgcaggcctacctccctagtggcctggggaggagagaaggagtgcagagtagaggataaagggttagcctaggcgcgagcctcagccaacataaaataataatatgaggccagacacggtggctcacagaggctgaggcaggagaattccttgaacccaggaggcagaggttgcagtgagccgagatcgtgccattgcactccagcctgggcaacaagagcgaaactccgtctgaaaaaataataataacaataataatatgagttgctttcaacttacttataataataaatgtcagcgtccttaaggatccaactgttaatgtgtccttgatttctctcttaaattggctgtcgggtcatggaaaagattgctttcaagtaagggaggctgaggcagaaggatcacttgagctcagaggttggagttcagcctgggcaacatagcgagactccatctctaataaaatttatagaaaaaaattttttttctttatttaaggtccaagttccagccgttctttgccatagagattaaaaattaagtggctgcctgaccttttgccagcccttgtggagaaatcaagcccctggaaacaggagatgcctggtttatctcaactgctcttgtctctagggtgacagttacaagcctgccactgcctcctcacaagactccttgaggcctgaaaattgtttatcaggcagattgtttggctataggaaataaggacacgtgtacaaacataatttaggatggatttagactttttagctctctggcaaaaataatttcaaattaccattctccctccccttgaatgtatcatcagtattttgaaattttgtctttataacagtttattggaaaagttatgttgatgtgttcccattgtactggaaaggagcaccctgtgttgttgtattctcaacatctttcatgagtctctgaagcctagaagagttaattgagtatattttccctctgatttctaaaaaatgctacatgacagaaaaaaatttcagttaaatgtaagaaagtagatattacttggcttttggagattgttgattattttgattagcctttttttaaggcagtaagagaaaactcaaaaaaagctgagagaaggataaaggaggcagaagagggacacaacatactgctttccaccactcccccctcctcagacaggagtatgtgaagatatatgagacaggcatcagttgaatccctgtaggcttcacagagctgagcacaaagggctggctgctgtctgtgttttcatgagagtgggctggctattagaccaccaaacaaaagaggggccaggtgattccacaaaagcagccatttggatggagcatagaggttgatttcctttcctgcctaactctcctgttgccaaatatctcaaccccagcattggcctgaagttgatccatgtttcccttgatcatgctgatctaccctgttgtttttcttgcttttgtttttgtttttttgagacaggagtcttgctctgtcgccctggctggagtgcagtggcgctatctcggctcactgcaacctctgcctcccgggttcaagcgattctcctgcctcagcctcccgagtagctgggattacaggcgcccaccaccacccccgactaatttttgtatttttaggagagaccggtttcaccatgttggccaggctggtctcaaactcctgacctcatgatccgcccacctcggcctcccaaagtgctgggattacaggtgtgagccaccacgcccggcctatcctgttgtttatacaagctgtcttatctagtagtgctgagtcaccattatatttattgcctacacctgcttattacaagaagcttccgaattcctgccttgggaacagagttctgtgactcgggaaactgaattttatagtctcgaccagctaaaccagacaatgagtcccaaatttttcagcactataacaaccaaacatttttagatttttgtgaatttcctctcccttctttttctttttttaaattcaactttcattttgaaaactttttttttttttttttgagacagagtttcactcttgttgctcaggctgtagtgcaatggcgcaatctcagcttcactgcaacctccacctcctgggttcaagcgattctcctgccacagcctcccgaatagttgggattacaggtgcctgccaccacgcacagctaattttttgtagttttagtagagaggggctttcaccatgttggccaggctgctcttgaatgcctgacctcgggtgatccacccacctctgcctctcaaagttctgggattacaggtgtaagccaccgtgcccagccaaaactttctttttgagacagagtttcacttttgttgcccaggctggagtgcaattgtgtgatcttggctcactgcaacctctgtctcccgagttcaagtgattctcctgcctcagcctcctgagtagctgggattacagatgcccgccactatgcccagctaatttttgtatgtttagtagagatgggtttcgccatgttggccaggctggtcttgaactcctgacctcaggtgatccacctgcctctgcctcccagagtgctgggataagaggcgtgcgccaccacacccagctgaaaaacttttgtagagaatgttttgataacctttgatcacttgccatatcccagggtggtgtgaaactagcatttaaaaacattaacgtacgtttaatacttgttcttggccttcattacttaaatttaaaagtttaatacatcattgttatacagtctgtaaatattaattagcctacttgtattctgagttattttaatatttgcttgattgcag

SEQ ID NO: 177 - DNA, 16581 bp, Homo sapiens
  source 1..16581: mol_type = genomic DNA
gtaagtgtgccgtttcctagaaagttttatttagaaatgtttcttcctccaagaaaactgttctctcttttttttttttttttttttgagacggagtctcgctctgtcgcccaggctggagtgcaatggctcgatctcggctcactgcaggctccacctcctgggttcacaccattctcctgcctcagcctcccgagtagctgggactacaggtgcccgccaccacgcccagctaatttttgtatttttaatagagacggggtttcactgtgttagccaggatggtctccatctcctgacctcatgatctgcccgcctcggcctcctaaagtgctgggattataggcgtgagccaccgcgcccggccgaaaactgttctctttagctggaaaagaagtcacacttttttgcaaagaaagcttcagacgtggtaaagcatgacctccagtgcccctgggccctggaaggcgcgtgtcacggctcacggtgccccctcttgtgaaagccatgcacacatcaaacagtgcttgagattcagtcacggggaacagctaaagtacacagaccctaaccccagcaagcccgcggggggcagctagacatttttaagaggagacgtgtgcaagggtctgcatagaggtactgttggtaagagggaaggatgggaaacaagctgtacatgcgtcaaagggaaacagataaattgggatgcatttatacagtggtatatacttcatagcaatttaaaagaacagactaggctaggcgcggtggctcacgcctataatcccagcactttggaaggccgaggcaagtggatcacttgaggtcaggagcttgagaccagcctgaccaacatggtgaggccccatctatacaaaaaaaatttaaaattaaaaaaaattagccaggcatggtggtgcatgcatgtggtcctagctactcaggatgctgagggaggaggaccacttgagcccaggagctcgaggctgccatgagctatgactgccactgcactccagcctgggtgacagtgagaccctgtctttaaaaaaaaatttttttaagcaacattgaatgaaaataaacaagcttaatgaatatttttatgatccaattaatgtaaaatcttttattttttattttttgagacagagttttgctcttgttgcccaggctggagtgcagtggtatgatctcagcccactacaacgtccatcttccgagctcaagcagttctcctgcctcagcctccctagtagctaggattacaggcacccgtcaccatgccgggctaatttttgtatttttagtagagatggggtttcaccgtgttggccaggctggtctcaaactcctgacgtcaggtggtccgcctgcctcagcctcccaaagtgcagggatcacaggcatgagccactgcacccggcccaattaaaatctttaacactaaacaatctagtacatcactggtggaaacagacatacacctattgcaaagggcatctcagctttaaggactcagtcacctcctgagcaagatggagggagaactggggaggggtcccatggggactgtaattctctctaggttgtatatttttaaaagacttcagcagtgtgataaacctgggtggtgtgtacatgggtattacagtcatgttgcttaatgacagggacaggttgtgagaaatgcatccttaggtgatttcatcattgtgtgaaagtcatagagtacacttaaacccagatggtagagcctgctgcacaccgaggctctgcggtgcagcctgttgctccaaggcacgcacctgtacagcgtgttactgtactgaacggcgtaggcccctgtgacacaatggtaagtatttgtgcgtctaaacataccaaaacatatagtagaaaaggttacagcaaaaatacagtattatcatcttatgggaccatgataccacagttgaacttatggtctattgttgaccaaaatgtcactgtgcagtgtgtgactatacagaaataagctcagagaaattaagtaacttggctgggcgcagtggctcacgcctgtaatcccaacactttgggaggctgaggcaggcggatcacccgaggtcaggagttcaagaccagtctggccaacatggcaaaaccccatctctactaaagaatacaaaacattagctgggagtggtggcaggtgcctgtaatcccagctactctactcaggaggctgaggcagggagaattgcttgaacccaggaggcagaggttgcagtgagcagagatcatgccactgtactctagcttgggcgacagggtgagactccatctcaaaaaaaagttggggcgtggtggctcatgcctgtaatcccagcactttgggaggctgaggcgggcggatcacttgaggtcaggagttaaagaccagcctggtcaacatggtgaaaccccatctctactgaaaatacaaaaattagccaagcatggtggtacacacctgtaatgcctgggcaacagagcaagattccgtctcaaaaaaaaaaaaaaaaaaagtaagtaacctgccacggttcatacagccagaaagacacagagccgggcctggaccccgcctctcagcttgctctagagggctattctctgcatgctggcatgatcgcgccttgtaaaaggtggcagtgttctcagcttagtcaatcaggaattgcaagaggcaagtgagcccctgaggactctggggggcctttgtgaccgagcagctttgggagtgaccctgacagacctttacaggtggtgcaagttttgactccctttctcctggcgcgttaagcagaggataagcgctgtggaaggagtgaaggtgtagggagatcatggcccccagagcagtggggaaggggacagggaggctggaggagagcaaggaaaaggctccgtgtcaggtggcgccttgagtggcctgggtaggttgtcttgcagtgaacccgggttaatggccttgacaatgaccgcattgtttcctgagcactgcaggctgcccacacacctcacacctcggcttgcctaagcccagagcagccttgtgaggtcgttgttatgtttatttaaggaaggaggaaaggaggcaggtcccaggacatcctgacgtgctggagatcaccagcccagaacccagctcttaaccccacaatgtgggacctttcttcacccatcacagacacaccccatgctggttcaccgttttcctataatgactatttgtgctatttattagaaaaatcttttccttatggatttgaaaagatttatcttgcttttgtttttcttttttgcctttcttttttaaggcaggcaggctcccgcagccccacccccagggtgaaaaatatagttcattgtctagtaaaagagttcagagatacacttttttctttgggtaagatatactctagagcttgttctgaaatatggaatttgtgtgagctgcgggagtgggtgggtgtgtggctctagctctggaaagttctttcctggcagtggccaggagggctgcccagccccctcctgcctcctctggcagcttaaacacaggaccccttattctgtgctctctcctgacccctggtcctcatgcaggagggaaccctgctcttctagggtccttttctaaaagtagtgtcttttaggtcattgtcaagaactataatctaaaatgtatttttaactcatctggaaattctgacagaggtaaggcttgagaatttcctgcatactagccttgtggtctatataatccattaaaagccacatttaacccaattccacagactgaactgtgcttcccatctaaataaattaaaagcaggccgggcacggtggtcacgtgtgtaatcccagcactttgggaggtcgaggcgggtggatcacctgaggtcaggagttcgagaccaacctggccaacatggtggaacctcatctctactaaaaataaaaaaaattagctgggcgtggaggcgtgcacctcttaagcttaaggacatatttcttatgatccaattaatgtaaaatattttattttttatttattttttgagacagagtttcactcttgctgcccaggctggagtgcagtggtgcgatcttggcctgtaatcccggctactcaggaggctgaggcaggacagtcgcttgaatccaggaggcggaggttgcagtgagccaagatcacaccactgcactccagcctgggcaacagagtgagactctgtctttaaataaataaataaataaatagcgagggttcagggcaggagaaaaagggttccaaatttgttctgaaccaattccaaggaactttatggcacaaagaaaaaaaaggggaacttacaaaaagtgaccacactgaagcgtcctggtcacccatccctggttttgaccaccagcctttaaagtggcaagcgggtgataacccatttcttatttccccctcagcatttcctcactgttattcatacatgtggtcatttgtactcatctcacaattgttaaaacctctttcctcccttccaggttttactgaactgttactgcgaagtctgagagatgaggtcatttaagattatttcttatttgtaaattagatcgttcatatttgtacctaatctgatcttttgggtaatattcctagttatgtagactggtctctcagaagagccggatattaaatgcagtactttaaactttacacccaggagaccggatgggtgaggctggttcactcggccaaagtaccattttatctctgctttttcttcccggctttattgccataattgacatacaataaactgcatgtatttaaagtgtacaatctgttgggtgtacacacacacgcatctgtgaaaccatcatcacactcaaaatagtgatgtagaaattttgctccttagttcgactaaatctgggttcttgtgtcatgaccaggaaaaattaggcacgtggacacgttgaagggtgaggagagcagtattgggcgaaaaggaaaaaagaaaaaaactctcagcaaagctagaggggatcctgccaatgagttcccagctcacagactgattagcaggccaccacacatgagctggaggccaggctcctcccgctgcgcaaggtgagaacttcccgtggctccaccccattctcccaatgcccaggtgggtccccgtcccttgcgggcctgtccagacaagggaaccctgggcaggttccctcatctacacaaaagcacctgaggtaaacacttgtggggcaggttgcagattctctggggacgccccccttctctgcctcctgcatctatcagtagtgcctctgtctgtcacccctaaagtttacttgtgctgtttctaattcctctttccccagccccgtgcctccctgcctccctcccccagtaaaccatgaatccactttctatcattctaggttgctttatatttcctagaattttatataaatggaatcatacagcacgtactctttctaggctggcttctttcactctgcagaatggctgtgagactcatctgcattgcagcaagcatcaatagttcattcttcatccatcatgtggacatagcacagtttgctgattcacgcacctgttgatgagcatttaggttgtttctagcttatggctattacaaataaagctgctatgaacattcacgtacaagtctctgtacaaccctctgctttcatttcttttgaataaatacctaggagtatgacggctggaacagatggcaggtgtttgtgtaactttttaagaaactgccaaaatcttttccagcatttcagaaaaatcttagaaaatgctatactatgttatattcccactggcagtatatgggggagttccagttcctccataccctcatcaacatgaggcatgatcagtctttttaattttaaccatgtcagtaggtgtgtgatggtctctcactgtggtgatttttatttgcacttccctggtgattttgagcatcttttcgtatgcttatttgccatatatcttctttggtgatatttctgttcaaagcctttgctcattttttaattgagttgcttttctactattcactattgaacactatttatatattttgaatacaaatactttatcagacatgtgatctacaaatattttccccagtgtgtggtttgtctttcttttctttctactgatagtatcttaaaaaaaaaaaagaaaaaagattgttttgtttgttttgttttgtttttgagatagggtctcaatctattgcccaggctagagtgcagtggtgcgatcatggcttactgcagccttgacctcttgggctcaggaaaccctccgacctcagcctcccaagtagctgggaccacaggtgtgtaccaccatgcttggctaattttttttttttagatacagagactcgttatgttgccaggggtggtcttgaactcctggactcaagcgaccctcccacttcggcctcccaaagtgctgggattacaggtgtgagccatcatgcccgaccagttcttaattttgatgaagtccaatttatcaatgtcctttttttatggatacttcatttatttatttatttgagagagggtctcaccctgagcccaggctggagttcagtggcatgatctcagctcactgcagcctcaacctcccaggcccaggtaatcctcctacttcagcctcccaagtagctgagactacaggtacctgccaccatgcccgggtaagttttttgtatttatttgtagagacggggtttcgccatgttgcccaggttggtctcaaactcctgggctcaagtgatctgcccatctcagcctcccaaagtgttgggattacaggcgtgagccaccatgcccagccatatatatatatatatatatatatatatatatatattttttttttttttttttttttttttttttgagacagagtctcactctgttgcccaggctggagtgcagtggtgcaatcttagctcactgcaacctccttctctgaggttcaagtaattctcatgcctcagcctctttagtagctgggattacaggcatgtgctaccaggcccggctaattaccagccttatatttttgaactctgtttaaaacatttaggtgcataaacattcaggcttgttatattctgttgatgaactgaaccttttattattatgaaattgctgttgtaatccgtggtaaaattatttgttctgaacactactttgtctgttattgatgtagccactgcagctttcttttgattggtgttaacatggtatatcttttcccattctttttcttttaactggtttgtgtctttatactatggtttgatttaaatctattatctcacaatttgttctctttggtacatctttgttttgttcccttttcctctttttatgccttctgttgaattaattgagtcttttttgttttgtttcatttaattttgttttttgagacggagtctctctctgtctccaggctggagtgcaatggcgctatctcggctcactgcaacctctgcctcctgggttcaagcaattctcctgcctcatcctcctgagtagctaggatcagaggcatgcaccaccacgcccggctaatttgtgtgtgtgtgtgtgtgtgtatttttactagagacgggtttcactatgttggtcaggctggtctcaaactcgtgaccttgtgatctgcctgccttggcctcccaaaatgctgggattataggcgtgagccaccgcacccagcctaattgagtcatttttaagattccactttatctcctttgttggcttattatttataacaccttctggtgttattttagtagttgctttagggtttatagtgtatctctctaatgtctcccagtctaccttccagtggtatcattctatcttacagatattataagaactttatgacagtatactttcatttttcccttcatgcatttgtggtaatgtttcacataattttatttatttacctacattataaatattacaatatgttattgttttacatagacagccggttatctttttaagatagtagtaagaaaaattttttacatttacccacataattaccttttctagtgctatatacctttgtataaatccagatttccatctgctatcattttccttctgcctgaaagacttcctgtgatattatctataatatggctctactggtaacgaattactagcttttgtatgtctgaaaaagtcttcatataaccttcattctagaaagtatgtgattcaaagggccgggcacagtggttcacgcctgtaatccgagcactttgggaggccgaggcgggtggatcacctgaggtcaggagttcaagaccagcctgaccaataaggtgaaaccctgtctttactaaaaatacaaaaattagctgggcatggtggctcatgcctatagtccctgctacttgggaggctgagacaggagaattgcttgaacccaggaggcagaggttgcagtgagccaagatcacgccactgcacaccagcctgggtgacagagcaagactccatccccctgcaaaaaaaaagaaaaagaaaaagaaaaaagtatgtgattctacattggcaattttttttttttttttttttttgagacagagtctcgctctatcacccaggctggagggcggtggtgccatcttggctcactgcacgctccgcctcccaggttcacaccattctcctgccccagcctcccaagtagctgagattacaggcacccaccaccacacccggctaatttttttgtattttttagtagagatggggtttcaccatgttagccaggatggtctcaatctcctgacctcatgatccgcccacctcggcctcccaaagtgctgggattacaggcatgagccaccgagcctggccactttttttctttaaatgcttttaagatgttcctactatcttcttgtttttaattaattaatttattattattattattattattattattattatttttttttttttttttttttttagagacagggtcttgcgctgatgccgaggctggagtgtgctagtgccatcgtagctcactgcagtctcaaacacctggtctcaagcaatcgtcctgcctcagcctcctgaggaactaggactagaggtatatactaccatgcccagccaattttaaaaattttttgtagaggtggagactcgctatgttgaccaggctcctctcgaactcctggcctcaagcaatcctcctacctctgcctcccgaagtgttgggattacagggattacaagtgtgagccactgtgccagtccccactgtcttctggcttgcatcgtttctaaaagaaacttggtgtcatccttatttttgtttctctacatgttatatgtcctctttatctggttgctttaactttatttattaattttagtttaatttttaattgacaaataataattgtatttttatggggcacaatgtgatgttttggtctatgtttacattgtggaatgtgtaaatcaagctagtgaacatatccaccacctcacacacttaccattttttgtgtgtggtgagaacatgtaaaggctgctccttgaggccaggcccaatcccagcactttgggaggccgaggcgagtggatcacttgaggtcaggagttcaagactagcctggccaacatggtgaaaccccgtccctactaaaaacacaaaaatcagccaggcgcggtggtacacgcctatagtcctagctacttgggaggctgaggcaggagaatcacttgaacccaagaggcagaggctgcagtgagccaagatcatgctactgcactccagcctgggcaacagagcaagactccatctcaaaaaaaaaaaaaaaaagtctattccttgagcaattttgaaatacacaatacatcattgttaattatggtcaccatagtgggtagtagatcactaaatcttattcttcctgtctaactaaaacttttttccttttgaccaacatctccccattccctccctcaacctcagcccctgataaccaccattccactctctactgctatgagtttgacctttttagatttcacatatgagatcacatggtatttgtctttctgtgcctggcttcttttacttagcataataccttccagatttacccatgttgttgcaaatggaatttccttcttttttaaggctgaatagtattcgtgtgtgtgtgtgtgtgcgtgtgtgtgtgtgtgtgtatcacattttctttatctcttcgttcattaatgatcatttaggatgattccacatcaggctactgtgtatagtgctgcagtaaacatggaagtgtagacatctcttcagcatactgcttccaatctctttggatataaacccagaagtgggattgctggatcatatgtagtgctatttttgtttttttgaggaacctccatacttattttgcataatgctattctaattcacaatactaccaacagtggacatgggttcttttttctctacatgcttgccaaccacttgttatcttttatctttttatatatctggctgcttctaaatttttttctttcttaccaattctgaaccatttgatggtttcttcctttatgctccttgtgcttgaggttcattgagcatctgggatcagtgcacttattgttttcatcaaattcagaagattaggccattatttcttcaaacttttttgtcgttctctgtctacctttgagagctccaattatacatacattaggccacttgaagttgtcattacagttcactaatgctaagttctttttttaagtcttgtttctgtgtttcattttggacactttctattgctacatcttcaaatttactaattttttcttctgcaatatctaatctgctcctaatcctatccagtgtattttccatattagatattgtagttttcataactagaagcatgatttggttctgttttcacccatgtatctatataacatgtccagtctttcactcagcttcttaaacatttagaatatggtcagaataactttttttgctgttttgttttagagacagggtctcactttgttactcaggctggagcgcagtggcatgatcacagctcactgcagccccaacctcctcgtctcaaggaatcctcccacctcagcctcctatgtagctgggaccacaggtacacaccaccacacctggctaatttttaaattttttgaagagacgggtctcactttgttgcccagactggtctcaaactcctgggttcaaacaatcctccagccttggcctcccaacgtgttgggattacaggcatgagccactgtacccagcccagaataactttttaaaaatgtcttgaggccgaggttgggaaataatctgaggtcgggagttcgagaccagcctgaccaacatggagaaaccccgtctctacaaaaaatacaaaattagccaggcacagtggcacatgcctgtaatcccagctacttgggaggctgaggcaggagaattgcttgaacccgggaggcagaggttgtggtgagccgagatcacaccattggactccagcctgggcaacaagagcgaaactccatctcaaaaaaaaaaaaaaaaaaaactcttagccacaatttctatcatctgtgtcacttctgagtccctttctattcagttatttttctccttgtcatgggtcatatttttctgattcttcatgtgtcctgtaattttcttttctttttttttttggagatggagtcttactctctcacccaggctgtagtgcgatggcacaatcttggctcactgcaacctccacctcctgggttcaagtgattctcctgcctcagcctcccaggtagctgggattacaggtgctcaccaccatgcccagataattttttgtatttttagcagagacggggtttcaccatgatggccaagctggttttgaactcttgacctcaagtgatccgcccacctcggcctcccaaagtgctaggattacaggcatgagccaccgtgcctggccagttgttctcattggatgtcatatgttgggaactttattgggtgatggatatttttgatttcctataaatattcttgaactttgttctgggatgcaattaagttacttggaaaatctttgatcctttcaggtcctgtttctcagcttcattagatgggactatcacagtgtttgttttagagataactttgccccactgctgaggcaaaaccactttgagcttcacctgatgccccatgacttcagtgatcttccactgtgggaggcgagagcaggactatatccagctccatgtgggccccaggcagcgttcactatcatcatttcaggttgctactgaagtatccctttttcaggctctcagctggcagagcaaatacatatatgtatacatactaacctatgtctatacaggaatctatcggtatttctgtctgtggccatctgtagctgtatgaagccaaacatgagtgtgtgctgatgtctccagccctcatctgttaccagatggatcgttctagcctcctccacttgcctacctgtcaattcaccattccttgagttcatggttcattttcagtatacctgcacagtggtatcagaactgttaacccacaccctgtgggaaaaaaactccatcagctagagcacagtgtttacagccagatccttttgcctttagtcttacagattccaatcattccaaattattcggtgcagcgcctttccgcacctgcacccactttttcccctgagattgtttcctacattcgtagcacagttagattgttttgttacattctgcatttcaccctgggatcctccaacctcctaagttatttttgttttatttgcacacattaggttcaatctgaactataaagttctgtgggttttcacaaatgcgtagtgtcatgtatccaccactacattttccttctctctctttcttgctttctcgccttcttgtcttgctctgtcacccaggctggagtgcagtggcacaatctcggctcactacaacctccgtctcctgggttcaagccattctgctgcctcagcttcccgagtagctgggactacaggcacgcaccaccacccctggctaactttttgtatttttacaaaatacaaaagacgatgtttcactatgtgggccaggctggtctcgaactcctgaccttgtgatccacctacctcggcctcccaaagtgttgggattacaggcgtgagccaccacacccggtctctctccttcctttcctttcctctcctttccttttctttctttctctttccctctcctctcttctcctctcctctcctttgatggaggtctcactgtgacacccaggctggagtacagtggcagcataatctcagctcactgtagcctcagcctcccagggctcaggtgatcctcccacctcagcctcccaagtagctgggattacaggtgcacaccgctgagcccagcaaatttttgtattttttgtaaagatagggtttcaccatgttgcccaggctggtctcaaactcctgagctcaagttatctgccagcctcggcctcccaaagtgctgggatgacaggcatgagctaccgtgcccagaccactgttagattttcatatgaatagtttcaccacatcaaaaaaccccatgcttcacctattcaaccctgcctctcccacccccagccagctcagaaatggttctttttaccattgctataattttgccttttccagaacgccatgaatttgaaatcatatagtatgtagccttttcagactgacttctttcatagcaatatgcatttaagagtcatccatgtctttccatggcttgatatctcatttctttttacactgaatgagttcccactgtctgtttgtaccacagtttgtatatctattcacctatctaagggcatcttggttgcttccaatttttggcaattaataaagctggccatgcacagtggctcacacctgtaatcccagcattttgggaggccaaggcgggcagatcacttgaggtcaggagtttgagaccagcctggccaacatggtgaaacgctgtctctactaaaaatacaaaaattagccgggcgtggtaatgggcacctgtaatcccagctacttggaaggctgaggcaggagaatcacttgaacctggaggcagaggttgcagtgagctgagatcgtgccactccactccagcctgggtgacagagtgagactctgtcccaaaaagaaaaagaataaactgctgtatacatgtgtaggttttgtgtggacagaagttttcaaatcagttggacaaatacctaagagtgtgattccatcatacagtaaaactgctttgctttgtcagaaactgccagaatgtcctccaagggggctgtctcatgttgcattcccaccagcaatgaatgggggttcctgttgctccacatcctcaccagatttgatgatgtcagttttgtggattttagtcatcctagtaggtgtgtggtgacaccacattgttgttctcattctcagtgccccgatgacatatcatgctgagcattgtttcatatgcttacttgccatctgtatatcgtccttgctgaagtgactgttcagatgttcagatcttttgcccattttctttctttttttttttttttttccttttgatacggagtcttgctctgtcgccaggctggagtgcagtggcacaatctcagctcactacaacctttgcctcccgggtccaagcgattcccctgcctcagcctcccaagtagctgggactacaggcacgcaccaccatggcaagctaactttttcttttttttttcttttcttttttttttgagatgaagtctcgctctgtcacccaggctggagtgcattggtgcgatcttggctcactgcaagctccgcctcctgggttcacgccattctcctgcctcagcctcccgagtagctgggactacaggcgcccccaccacgcccggctaatttttttgtgtttttagtagagacggagtttcaccgtgttagccaggatggtcttgatgtcctgacctcgtgatccgcttgctccggcctcccaaagtgctgggattacaggcgtgagccaccacgcctagcccccatttttcaattgagttgtttgttttaagacctctttgtatattaccacatgtgtattgaaaatattttctcccagtctgtggcttgtctttaattttcttagcaatgtcttttgcagagcagaaggtttcattagctttcatagattccaacttatattttctctttcatggattgtgcatttggtgttgcccacacagatttttatactgtattctggtgccatttactgagttaacaattgcggaagaactggaagaaaggaagcaaacaaaacgagttctgcgtggcactgtcagtgcgggggcatggggagtcctgcagggtgaggtatgggcggtatggcaaggcgcgggcccatagatgtgcaggtctggagatgtgtgcagcggagatgtgcgggcccgagatgtgcgggtccgatgtgtgggtccggagatgtgcgcgtacccagaggtgcagatcggaaatgtgggggtccggaggaaatgtgcggatcaggagaagtgccagtcccgagatgtgcggatcggagatgtggagggctaggagatgcgtgggtccggagatgcgcagatcaggagatgggcgaatcggagatgcgcgggtccggaaatgtgcagagcggagatgtgtggatcaggagatgttggggggtcaggagatgcgggggtccagagatgtgggggtccggagatgtgcgggtctggagatgtgcagagcagagcaaagatgagctgatcggagatgcccaggtccggggatccacgggtccggagacgcgcgggtccggagatgcgtgggtccagagatgtgcgggtccaaagatgtgcaaatctgaagatgtgtggatgggagatgtgcaggtccggagatgcgcggggcggagatgtgtggatcggagatgctcagatcgaagatgtgggaatgaggagatgtgcggggcgggatgtgtggatgggagacgcgcgggcccggagatatgcggggcggagatgtgcgggtccagggatgtgtgatctgaggtgtgtgggtccggagctcggggtcagctcagcagcagtgagagcgagcatgctggctttgggagcacagcacaatggcagctgtaggagtgcaagagggtgtgacccagaggcagggcccggccccgcatgggtgttctgaggtttatgcctcagcactagaagcctcgtatgcgaaatcacatcctcatagacccggttcagacacaggatagtgatgcctggactattcatccgtctctcctctttttccccag

SEQ ID NO: 178 - DNA, 2438 bp, Homo sapiens; identical to SEQ ID NO: 109
  source 1..2438: mol_type = genomic DNA

SEQ ID NO: 179 - DNA, 4217 bp, Homo sapiens
  source 1..4217: mol_type = genomic DNA
gttagtgattagggactggaagcaaagtggttttgtgagttgaagaagcaaaaggtgcatgggtctgtatttattgtggaattttttttttttttttttttttgaggtggagttttgctcttgtcacccaggctggaatacagtggcgcgatctcagctcactgcaacctccgcctcccgggttcaagcaaatctcctgtctcagcctactgagtagctgggattagaggcacccaccaccaagcctggctaatttttgtatttttagtagagatggggtttcaccatgttggccaggctggtcttgaactcctgatgtcaggtgatgcactcaccttggcctctcagagtgctagaattacaggagcgagccactgcgcccggctaattttttgtatttcttttagtagagacagggtttcaccatgttgggcaggctggtcttcaacttctgacctcaggtcatctgcccaccttcgcctcccagagtgctgggattataggcgtgagccagcgtgcctcgccttattgtgatcttgatttgaattagtgtttagcatttggggtaaacttttttttttgagatagagtttcactctgttgcccatgctggagtgtagtggcgtgatctcagctcacggcaacctccacctcccaggttcaagcgattctcctgcctaagcctccggagtagctgggactacatgcgaacaccactacgcctggctaatttttgtatttttagtacagatggtattttgtcatgttggccaggctgctctggaactcctggcctcaagtgatctgccacctcagccgcccaaatggctgggattacaggtgtgagccaccatgccaggccagcatttgggaaaattttatttcctgctttatgttttagcgttctttgatttgaccaggagtattctaggtaagggtattgaaattgccatttactgtggcaagcaaagtgtgttatgtacattatttgcctaattacctatgtcgttgagtcattgagaaaattaaatgaaatgatcagaactcatcttaatgacagaggagactctccaaacataatgcaaagaagatataatccactgataaataattttaagttgactttatttttttttaacaggaagtatttgtgttttttcaattggcattgttaaataataccacataagtgtttcttttaccatttaatatttgaggggggtaatagaacatatacagaaatatgggtgggtggatttgcatatatgtgatatttacagaaggaaagaaatggattttttttgtgtgtgtgtgtgagatgttctctctgtcactcaggctggagcgcagtggtgcgatctcggttcactgcagcctctgcctcccaggttcaagtgattctcctgcctcagcctcctaagtagctgggattataggcatgtgccaccacgcacggctaatttttgtatttttagtagagacagggtttcaccatgttgaccaggctggtctggaactcctgacctcaagtgatctgcctaccttggcctcccaaattgctgggattataggcgtgagccaccgtacctagcctgtttttgtttttcaggcaaggtctcacttttttgtccaggctggagttcagtggcgagatcttggcttactgcaacctctgcctcccgggcttgagtgatcctcccaccttggcttcccaagtagctgggactacaggtcaccatgcctggctgatttttgtattttttttaaagattgagttccaccatgttgcccaggctggtcttgaactcctgggctgaaatgatcctcctgcctcagcctcccaaagtgctggacttacaggcgtgagctaccacgcccagccaattattttcttttttggggggtgggggatggagtcttgctctgtcacttaggctggagtacggtggcgcgttctcggctcactgcaacctctgcctcccgggttcacgccattctcctgcctcagcctcctgagtagctgggactacaggtatgtaccaccatgcccgactaattttttgtatttttagtagagatggggtttcaccatgttagccaggatggtcttgatctcctgacctcgtgatccacccgcctcggcctcccaaagtgctgggattacaggcatgagccaccgtgccaggcccaatgatgttttttatggagaatggggatggacgtattcacaacatatccttttgttatgtttctttcttttttttttttgagacggagtctcactctgtcgcccagagtggagtgtaatggcgctatctcggctcactgcaacctccgcctcccgggttcaagctattcttctgcctcagtcccttgagtagctgggattacaggcacgcgccaccacgcctagctaatttttttgtatgtttagtagagacggggtttcaccatgttggtcaggctggtctcgaactcctgacctcgtgatccgcccggctcggcctcccaaagtgctgggattacagacgtgagctgccaggcccagcctgtaatttttcattttattttattttattttttgagacggagtctcgctcttgcactgttgcctaggctggagtgcaatgccgtgatctcagctcactgcaacgtccgcctcctgggttccagcagttctcctgcctcagcctcctgagtagctgagattacagaacgtgcatcaccatgtccagctaatttttgtatttttagtagagatggggtttcaccctgttagccaggatggtctcgatctcctgacctcgtgatccacctgcctcagcctcccaaagtattgggattacaggcgtgagccaccacgcccagccctgtaatttttaatttttttattttctttctttctttacttatttagagatggagtctccccctgttgtccaggctggagtgcagtggcatgatcttggctcactgtaacctccaccttctggattcaagcgcttctcctgcctcagcctcctgagtagctggcattacaggcgcccaccaccacacccggctaatttttgtatttttactagagacggtgtttcaccatgttagccaggctggtcttcagctcctgacctcaagtgattcgcccacctcagcctctcaaagtgctgggattacaggcgtgagccaccatgcctgacccttccgtaatttttgaattttgaatatatcacctattcaagaaaaaatgttaaagacaaatgtttaaaaatatcttgaagcagtttaagaacaggtctgttttgcaaaatgtaagaggagttgtttggccataccctcaaagcttatcattctgaacttctttaggacagaaggggtttatagagactagggagcaggtctttgcaccatcgtctcttgtttcccaaactagtagttcaagtactaatatcatgattttttaaaaaaaattaagtataggctgggtgcggtggctcacacctgtaatcccagcactttgagaggccgaggtgggcggatcacgaggtcaggagatcgagaccatcctggctaacagggtgaaaccccatctctactaaaaatacaaaaaattagccgggcgtggtggtgggcgcctatagtcccagctactcgggatgctgaggcaggagaatggcatgaacccgggaggcagagcttgcagtgagccaagatcgcaccactgcactccagcctgagtgacagagcgagactccatctcaaaaaaaaaaaagaaaattaagtataatattttgtgtaggttctgttaggtttgcatgcattatttaagtggttaacactagacctgtaaggtaggtactgttttcttcccccttctagacacttaggaggtttagagactaagttccttatccaagataacaaaggcattaagtggcagagttaagattcaaactcaggtttctctgactccagagtctcaatcatcacactatattactacctaatatgctaatcttgctttaggaacatgggttgaaaaattccagtgctcacttatcttgactaaattttttgcactgtggtgcaggcagaatgtggtatagtcattcaaaacattttaagtgtctagacctgagagccttgtgggtttaaaaacctgaatgggagaagtaagaaggagaaattaacagtttttcaatttttttcctggagagcag

SEQ ID NO: 180 - DNA, 4345 bp, Homo sapiens; identical to SEQ ID NO: 113
  source 1..4345: mol_type = genomic DNA

SEQ ID NO: 181 - DNA, 1785 bp, Homo sapiens; identical to SEQ ID NO: 116
  source 1..1785: mol_type = genomic DNA

SEQ ID NO: 182 - DNA, 12179 bp, Homo sapiens
  source 1..12179: mol_type = genomic DNA
gtaggtgtcttgctttctgtttcccaccccttccagcaggaacacagaaacaggggtctctctttttctaatggcagtagctgccctgggcccaggttatagatcaagatgtagatgtaggtgtgggtaaagttcctttcatagcactgagatcttcatattaggaaggggaactctgaagtccctgcatttgctccagggggactaaccaaccaactctttagtctggtgggtttggcttaacttagattcagagattaggagaagtggaatcactggtctcaaaggcccttgttattaggctggggacaggaaagttcttgccccaggccagcaggatgtcttctttttgtggctgggagaaggggtgagagaatgagatgggggctgttgggacgaaggtggtagtgggatctgtggtctctcctgctgaccattcccatgaacacttccatccaactcaagtcttgataccggactcatccaaacaagtcagtttattaggtgaggggagttcatactgaaataaaatacccccttcttcccacacgttgccattctacagtgatcatgaaacttgagaaatccttttttcctccaggttccaagactatctccgaggtttgctggccatgacctcctgtgttttttccaggttggaagtgacatcctctctttctcaccccaccatcacttgtcccttgtcagctttactaaggatgatgactggtctcttattctatgtaataactaaagcttctttctttcagccaagtcagcattttaaagaaaggatgaatgggatttgtaggaccagggcctgtggaaaatttacttccttctgagggctgttaagtgccaagaaagtagaacggtggagactagactggtcatgtagaatgcaggtttcattggctgcatggtgaactacctgtagagtacctctgggatccaggatagagcagcatagaaatctctctgatggcaagtgcccaatactgagccatgatttctgctctataaatggatttcttttccaatacattgtctgcaatttccatggttaatgacccccttcccagaactgtcactgtgccctcagttgcatccccatttcaaaaagccagcctttgggaaatgcctaaatgaggtgaggaccccagccctagagggtaccaacgtgagaccctcgcagcgagagatgttagcatccctccagcaactgttgataccatcctgtggtggaaggacctgtaccccccacagacagaaagctggagctctaagacttaaagaatgggattgagataagacccagagagccaaagtgagactgggccagttctctttctggagaaagggcaagtgccatagagtcttcatttcacaatagctcctcaggactacctggcgtcaggtgggacacctgaactcaaactggtactcccagctgcctggggaggctgtgatttgaaacagagcttccccaccatgacctaccctcaccagaacacgttcttctcttttccctagggtgagctacccagaatttgaggatattgatcaggtatcccacatgcccctgctaaacaaataagctgctaaagcactaacagtcctacacattagcatttatttattttttgagatgaggtcttactctgtcacccagcctcaagtgcagtggcgccatctctgctcactgcagcctctgcctcctgggctcacacgatccttgcacctcagcctcccgagtagctggggctgcaggcacacaccaccatgcctggctaatttttgtatcttgggtagagatggagtttcaccatgttgcccaggctggtctggaactccttggcctcccaaagtgttgggtttatagacatgagccactgtgccaagccagcatttatttcacaaactttttttatggctatacgcaaggtggaagggggtaaagagcataggacaggcatgcagccaactgacactaattcataagctcctctagcttttgggggttgcttgatcattacattactgtggtgcccaactggctcctgtgaagacctctgtgccagttattagtaaataatatagttgaatgccattatctgtgtagaattgctccagaagcaataaggagaaacagaggttatccttgttgcaagcatgttcccagcccctggggagcttacactagcttccatagcaactatgtcctgactccaggcttgtgctaggtggggggacattcccaggccatcacagtggctccaatcgctgccgcttttgaattgtggatgaacaattagtcttggactgtcacctgaacagttggaactgctggactttttggtgtccatttgagtaaagtgtctgatttctttggcattttagaacatccagaaggttaggtcctaacttagcaccatccactggtgacttgatgtctgagtctgttactcatcgcatttgtttccctaattgattttcattcttccttgttgcctcttaaagctgtgagtacttttcagagtcatgggattatccagatgacttccaaggttaattccttttatttataatccatatgagttcccaaacaaggaaaacattctgttttgctcaggtccttggctgcattggagattgtgtcctgtaaaagaattttggcatcttttccccaggacatttatcccactgtatgtggagatcagcaagcctgtcagttctggaggtggggacttgcagagactacttgccttggcctgaattcagactgctgaaaacattccccgtttgaaaatattcacatcattttggaaaaatcacctaatgtctttccccctttttttccagcctgcaaccatagatgccctgaatttattttttttttcatttttaaaatttttttaggtaggtctcaccctgctgcccaggctggagtgcagtggcacaatcatggctcactgcagcctccaagtcctgggctcaagcagccttctcacctcagcctcctgagtagctgggactacagacacgtgccaaggcgcccagcttgatgccctgaatttgatgtctcctcaattccttttttttgttgtttgtttgtttgttttaggtttgattctttccttaaagaatactttaagcaatgttaggattatctccaggaggggcttaacagagactcagaggattataagagagccctcaactactaaagaataacccagataagacccttattgatcctgtcctgggccagattaatcagctgagtaacagcttatctcccagcaacgtttagagccagccactgaattggcctttagacctcctccttcattctccacactgtgggcctatttgttatcagataagtcacccaccctgaagagctgggatcttcttaccttatatggtgcctatagccactcaaagcttagtttcttgcaatctttacctgacaaagtttcgtaagatgaagctgacccaggggactgttgagtccaggtacttggttgagaaagaatagcttcccttcagatatacttattaaggcctcatgaagaatctggcaactttcaattcttttggagttaagagttggctgcacttggcaataatagggaagtagatacctccatataaattcttattgataatgatggatagatggagagaaagggattagttggtgctactatgttctagatagggcttttgtggaccatagtttaggcagacattgaactctggaccatctgccttttcatgaaaattagggtagcctaatagggcaacatttacttccggatttgctttggacattgcccagggcttcagagaagataactacactggtggattatgagcacatgcatagatcaaggtccatatccctttttattttatttatttatttatttatttgagatggagtttctctctttttgtccacgttggagtgcaatggcaccatctccgctcactgcaacctctgcctcctgggttcaagcaattctcctgcctcagccttccaagcagctgggattacaggcatgcaccaccacgcccagctaatttatttttgtatttttagtagagacggggtttcaccatgttggccaggctggtctcgaacttctgacctcaggtgatccacccacctcggccacaacacctggccatacctgtttttaaatcgaaacctttaaacctgctcatcctgacccttgctaggtcatacaccttccgcttctaccccctgccagtcatgctgcttaattataaatgtcttcatttttttaaaaattgtgtgtgtgcaattcacagacacaggatcaaagaattaaagccctaggatagagataaaaagcagcaaatgaaactaatttgtagattgtttctttttttttcctctctaaattttctttaaaatatcatcaatttaagtaagctaagctgatatgcaaccaccacttcccagtaggaagaatttaagagctgttgatggaaatatcttaacctatcctagaatttgtgttgtaagaaacccagaacccagccaggcatggtggctcaagcctgtaatcccagcactttgggaggccaaggcaggcgaatcacctgaggtcaggagtttgagaccagcctggacaacacagtgaaaccccatctctactaaaaatacaaaattagccgggcatggtggcacatgcctgtaatccaagctactcacccaggaggctaaggcagggagaattgcttgaacccaggaggtggaagttgcagtgagccaagattgtgccattgcactccagcctgagcgacagagtgagactttgtctcaaaaaaaaaaaaaaaaaatagaaacccagaccccaaacattctggagtttgactaactaaaggtatttttaggtctgctctcccctgaaaaattctgtaactctcagctcaggcccaggaaggcataaatgtagttagcatggtgttgagaaagcatcgtggtaactgctctgagagctctggtagaacaaggtaagtttgcctctggcagagcaggaaagtgtttgaccatacgtctaagcctggaggtctgcaggcttcttccccctggtacggcaacatattcaactctggattgtccagatagtcctgttggaatgttgttgtgtaacctgcccactggggacgtgacctgtctgtggaagaaaaagcattggcctgggagtcaggcagtggaggtctttaatcttggctgcagaactgccagtgtaaccctgggcaaattcttgtgtacgggtctcaatttcctcatctatcaaattttgttttccaataattcttccaactgttattctaatgataaaagttatagaagattgacatggaaatgacagacctgaggataattcattttggactgttctggaaggaaagaatgagaattataaggaaaagtgtggattcagttgtccagactcacccaagttcttgtggccatggaggggtcctggttgtagttaaaagtcagaaggttattttagttaaaagtgagagatagaaggatgtatttaaaagatagagatagaactcacttaagcgagttctcatggagccacagttcttgggaactgcaagtcagccatggtacttattgaacgttttcattgttgttaatgtcgtgacgcatcagattctcaaacaaatggttttttgtcaaccaggagtaaaagagcttgtccctcttggaaagccaatggtgaatgagctgaggagggggcagcttgtgtggagtatgtgtatttatctgtattcttttccataggtaccattaaatttgtctggcttaatttaatggggacttctgggacctgcagagactgtaaagggcgagggtaaggctcttgtcgtctgttcaggctcctctccttccagtggaacttcctcactctctccctctcctgtcagcctctccccttttccaacttgtgtgtatgttctaccgccttctcgattttctcttccctgttgttttttcttctgcctctcaaccacctttccttccaggtcatttgagtcaagttgaaataggcagctggtgttacccacttcctctacctggggggcccaatctgtgtctgcagtgctaggggctttattctaacactctggaacctctgttttctttctttttttttttttttttttttttttttttttttttttttggttaccttttttgtttttgtttttctcttctgtttctgtgtaggtctctttagtcagccttatagctaatgccctgggctactcggaactaggtgccataaagtcccttaggaccctaagagctttgagacccttaagagccttatcacgatttgaagggatgagggtaagatactaagagcagctgatccttctgcatgccagtggaaactgtttaagcatgctagaactgatcacatggtggaaagatcattcaaacacgaattctgtgatgcagctgctgatttgatcctccactctctcccccacacctgccccgtgcaaaggggaattgcgttaagctgcctcatcacattaatattggccccacccccaacaacatgccatcgcagaacatgttaacattggctattctcatttggcctggcttacctgtagcactcggggcggctttctgggctgttgatttaatagggagaatcaccaggtgcaaagaaggggaattgtaacccacagacccactgaaaagcacaagcttcaggcagggagagtgctgtgtaggggcatcagccaggtggggactgtggccttggggtcactgagaaagcagctgagaatgggcttgaagatatgacggcaggcctggaattggggatggagcagaatttggcatggccctgggagaagaaatgcttttctttctattcagattcctcttattgcaccttgttgttctcagcccagtcccaaatggactggcagcctctgtctgatagcaaagcttttttcctcacccccaacccctctgcccatgctgtatggtcccctaacactgtcaaaatgacaaccaggtatgatgctagatgactgaatatcagctagttctcctgaaatttcttgatacctcctattcctgctttggtgatactccacccaaaacaatacaaggtgttgtcaccctaccaacttagaaacaaggtgccttcttggtgccattttcttgtctcttttggtttaaacaattgtgcgtgtgcgtgcgtgcacgcgcacgcacgcgcacacacacacactaaaaagtcaatttcttaaaatcaaaggggcaactggctttggtggtaatagttgtcctgtggtgatcagagagaggtctgttatacttaacgagaccaagaaaactcgcttcaattcagatgttgaatacatgcaggagagcaaaccagaggatatatttttaaatgtgcaaacgtcagaatgtaagaataaaaattaaactgttacgatagtctacgtgaagcaagaccgattggaaaaactagataccaggacagtgctgctacgttcattcctcatctgtgatccctggctgttactccgtgaagccacccacagttgtataggaagatgaaaacttaattgggacttgggaattttattatgttaatttatccagacaaatgctttttgcaacaaattcatgtttcttctgtagcacagtcacagtttggtgtactaaatgtaagctttctgcaactctcctgaaaccatctgcaggaagggcagttccacagtagtgtaaatttattttaatttttcaaaaaacttgggattttaagactttgtcccacagataagagaggttttagaatgtgcgcaataaggtcattgctatgctcaggctaaatttaggaagagagtttattacacaagattcagtggtttagacagccacggtgagattgaaaatgtggttaaaatgttcttctctgctccctgcacctttgcatgttttccagagggagctaataaaatgttttaataaactatactggttttgttataaagttgataatccactttggtgactgaaaaactgaggacaagatgcaaccaaaaaagtccactgaagacagtacttgtcctgagctcctccgcatccccttacggtgatccctgatcttccaaaaagagattggtaatacctgaagaaatccccccatccccctacaaaagaaatgcccatctgacccatctgacgcttgttactaactatttccatctagatgctcattactgtcactcctgtccaggcagacagaagcagtcctcatggccgctgaggccagtttgctcatgaggcagttatttgaataacctggatgcaggagccgttttgggagccacacctcttccctttagctgccccttctttctgtacctttcctggaccctcagtttccagtcccctaaaaactttcatttgtcaacttgaaagtagtttaggagcttggaggtcccgaatgaataatcaaaacagtagataattttatttgaaaagcattacgatgttttatttgaaaagcgtctacatcaagatttttttcggtaagataatatggtcaagaacaagtttgaacccaaagctggaatttaaaacaataaatgcattaagggaagctttggaataagagtgccacctcatttgattgactccagccaactaacagacagtattgaccatggctggttggacaggtgaaaagggatcagggatccattcctgccctgtgggtttcctagcccttctgtgggagagtaactgcaagaagaaaagattggatttggctaagcgtatagtaagtcccccagtaataaacagaattaggtacacatgttttatttaaatgttgtttttctatggggcattttttttttattctttggttttggttcttctatatgccaacacttgagagattacctttagaatattttaaataagaaatcttcataaactgaacaccatccatgcagatgggctcaactgtcactgtgctgctccaattacagactcagagcttcgcttgagagggagcatatgacccaagcctgtcctggggcactgacttcagtctcctcttcttcctcaaaccaaagaccaggaaaactgaagcacttgtgctataggcaaaggaatacttaatgtagttctttgcttttctctcctccatagtaatcttcatttaaagatttcgctgtgctgttaaatttttgagggtatataatattagtgccatgaaacatgcatgcatttttgttgattgtcagtacatagttgtccattaaagccatgttccctctgccagatattaaaagccagctgacagattttatagtatttattgagcaacaataatgtccgagacattatagagaagacaaaaatactgtaagaattaatatccattggaattttctcatcaattaaatgggatttgtatcaattgccaagtataaacttccattgataaaagtaactttttatagattactaaaacctagctttgagtgatatttccatgtctagttcttaacaataatagatttcatgataattaaaggcaatgtagagtaactagagaacttgagaagagaggatcaaattcattaagtgactaccagtggaaatttgaattatcatttataatatatctttagtgtgagagttcaaaataagaaatatgatctcttgcccagtggttgctgagaataacagcacaatgatcattacatatggagcacagttaaatagtttctgcttaacatattgcagcttatcagctaatgttcaaagcaaggaagaattattagtacgtttaatcaactctgggctgggcatggtgtcttatgcctgtaatcccagaacttttggaggccgggatgggtggatcactttgaggtcaggagtttgagaccaacctggccaacatggcagaactccacctctactaaaaatacaaaaattagctgggcacggtagcacgcacctgtagtcccagttactcgggaggctgaggcaggagaatcgcttgaacctgagaagggcctccccttctcagtgagccaagattgcaccactgcactccagcctggtcgacagagtgagaccctttctcaaaaaaagtaaataaaaagttttcctctggttatgattaaagtacatttgcatcttataaaactttggattttataggattttatatcatatcagagaaaaaggctctgaatatttttgtatattgattcatttgatcaaatggatcaatatgtaaaattttctatatactttatgagaataaaagttcaaagagatcacgttaatgtttcttccctatggtaaatattaacccatatttaactgtaacccatagtatgtgggacaggttagactgggtttgagtagaagcatagtcagaagagttcctggaggaagtaggttctgaattgagattaaaaagcagcatgccttggtttcaagtctttggggcctacttcctgtgccacatttgtaatggtctaacagaaagtcacgatctcccacctaaggtctgctgtgaaatgctgtcacatagacttgagcttttgaatctttacctaatctactcccgtattgtttgagaaattatttttccatttgtggatcatcctccttttgcctgttcttttgcacatttcattgctttttggtgctcccgccaaagggtgagcaactgtagaatgaggaggtaaattcaaatctgggtacatgacaaatttggtaacataaataaatatgaatatcattctccaaaaaaagtgaagattttccagatttcagatatcctggctttccttgctcaacttaataaacaaagtaataaacactttaatgacagagctgtcagatctagaagagatttcttggtctaagaattaagaaataactgcctctcagtctaaaggccctaatatatgaattggagaaacacaaaatgaatattttaatctaaaaggaagagtgactccttagcagaagaatatcattgcattttttacacaagatagaacaggtagctctgatcagccacatgtcctgatgagtgacaatgcagtctaaggcaaaaccagaagataaggaaaccctaaactctaaattgtgtgctgctctgactgatactgtaaagcaaaatcaaagttgaaaacaacccagaaactttgattcctaaggggtttttttcttttgctttttttttattcctgagcttactgtagtcagtgactttttaacaatatgccaatttttttagtttcaagagcagtaatgatctaacccaaaactctcttaaaaaccttaagtcatccctatttctaatacactgtgatgagtggagtcaagccctggaatgagcagagagacgacagcattagccaagcagggagcgactctgatttaaaagcctacaaagtcagaataaaaaggctggagaagtataatgaaccttgagtgaaagcacatctgttcagattttattttatactgtttggtagagggaatatagctttttttttcttgagcctgcaaaatatgcatgctcagctattgcctgaaataaaataactggccttgcgtagtcataaaagagacattatgtactgttaactggctctctattaaccacaacgggtagttctctgtgattttgaacaattataccttgtttttcagagggggaatgtctgttgaaaggcaactagcaagctgaaagttactcatattttcccattgggcatattttatgaattgaggaagagggagactggactaagaaataatttttcagtcccaggctgatgcataggaaagaagacctaggtcagcttggctggggaatttgtgttagtcaaaataaaggtgtaactttttaaaattccttcaatatagtcctagacttagaaatttttggtcctacttgtcagtctgtccagttactctaattccaaagggaatgtaatgtttccatacagaacaagccacacaatgtcattcccctcctggaaatcaaaaaatgtgcttgctctcatttccacccaacactgagcaacctccccttccaatgcag

SEQ ID NO: 183 - DNA, 1670 bp, Homo sapiens
  source 1..1670: mol_type = genomic DNA
gtaagtactttcagctttttgaaacggcaaatttatgaaaatctcaggcagcacagtgttccaataacagcaaacctctggggtctgatttttccagcatggaatgtctgtatttaaaggaaaatggaagctatatgaaagctagtcattgataggcaaatactaaatttttcaaaaagactatctcccactcagaggtatgtgacatcattgagattgatcatcttcctccatgctcagcacttggatggatagtctatgcagtgccaattaggtttacactttttccaagttcttgtttaaaaatgaataaaacctataagaagcacacaaaaaactcaggcctttaaatacaagtacagtgctctttatattaccctgtattattcaattattttatatttttgtattaaaatataaaagtatatatttgtaaaagagctgtcactgcttactaagcctaagattaatgcattgtatacacattatatatacactcagtttattttcaaggaaaatattacattacagtataattttaatttattcataattgttactcttttcccaaatgtatttatcagaaaaatggatttttacaatctcatatctagatattctattttccgttaatgactttgaattatcaaagtaatccaggttcactggagccacctagacaatacagaagggtcttaagattcctaatatccgattccttcatccctgcctaacctcttttccatcaggctccctccttttgaggtcacatatgatggggcagttccatctgctacctgctgctaagaaaacattgtgcaaagaagactgcctcttctcataggtctcctttttttcctattggtacaattcaaatactacaaaattcacaattttaaagtatacaattcagtgtttttcagtatattgacaaacttgcgcaacatcaccactacctaattagagaagtttaacaaccccaaatagaaactctgtactcattagcagtcacttcaatttccttctctccctggccccttggaaaccactcatctatgttttatctctatggatttgtctatttggatttttttatgaatggaaatatcaaacagtatgcagccttttgtgtctgacacttagcatactattttcaatgttttataaaaaattaaaagtctaaattaccataatgttaagggtccaacaattgaaacatttagttgtttacgcatttaagtgtatgaatccaatttaataatatataatatctgtattttgtttgcatcaaatgagtcaaatcaatgctaattaaattaagttagttatgatagcaaaaaagacttgcagaactatacatttaaaatagaagccccaaacgtagaaaataccttgactaaaggctcaggtaagtatcatagactctatctaaattctgaataattctgatttaattctacaggtatttaacagaatttgtaaacctaggcaatgtttcagctcttcgaactttcagagtattgagagctttgaaaactatttctgtaatcccaggtaagaagtaattggtgtgaagcattaggccactcataactccaactatttgggagttgttctttgttcgtttgtgtgtgtgtcgtcactgtgtgtataaactcccctattacaga

SEQ ID NO: 184 - DNA, 8563 bp, Homo sapiens
  source 1..8563: mol_type = genomic DNA
gtaagtatccagggaaaattctttgttatgatgctttataaaaactcatttaacaggtaatgaatatctgtggggttttttggggtttttttttgagacggagtctcactctgttgcccagggtggaatgtagtggtgcaatctcagctcacctcaccctccgcctcccgggttcaagcgattctcctgcctcagcctcctaagtaactgggattacaagcatgcaccaccatgcccggctaatttttgtgtttttagtagagacagggtttcaccatgttggtcaggctggtctcgaactcctgacctcgtgatccgcccgccttggcctcccaaagtgcttggattacaggcgtgagccaccgcacccggcctgaatatctgttttaattaaggaataaccatgtgagaaataatttagagatacttcacatagagatagttccatttctaggaatctatttagatagaaattgtgttacatatatctcataggaagaaaatgtatgtgtaagcaaataattacaacaaatgagatgtaatttttaaaataaaatatttgtaactgaagtaacacagattagaactatttaactataggcagctttctaattaggaatggtctgaactagaagtactgttattaaagctggtagctatatccatatcatgcaatattagtagtattaggaatacattgaaaactcagttttccagctgaagatacagacagtgcactggaatattagaaccggaatttttctaagggtccattgataacagtcctactctttctttctcatctggcctataataatgctgccttctagaatgttgattagtttttttttctaaaatgtcagacagtacaccgagagatgttatataattgaacattaagagaaatataatcttatatctctgtatttcataaaatagggctataattataaaatggataaatatgaacaatgaatttattttaaaaatcaaaagatacatttatgtaaacaaggtgttccttttttcttgaatttgaaattatctttgctaatattcttccaaataattatcccatataatttttactaattgttgattcattttatttttcttattagagtttatttgcaatattgtttgctcctttattttcttcttaaattataccaatgttaattttttgaaaattgaagatacagtttgctaagcctttaaagagcatattttattccaaaaattttaaagcttaagttttgttcctggctaggaagctcaaagtttaatcatttatatgtattttgtgtggaacaattgatctttaattaactttggaaaaattatgagaattgcttcttattcataaaaagattaaatttttaggtcattcttaattataagtgacaacaaagtcctgtcacagaatttatattatcctttaagatgatctctctttgatgttcgcagctctaaagaagatggacagaacattaatcttgtataaaacagggaaaagcatcagcagatacagccgttttaagattggggaatcctggtgtggtggtgggcgcctgtagtcccagctacttgggaggctgaggcaggagaatggcgtgaacccgggaggggagcttgcagtgagctgagatcacaccactgcactccagcctgggcgacaaagcgagactcttgtctccaaaaacaaaaacaaaaaaagactggggagtgctggataagaagcagagattatttaagagaaaaggaaggggaggctgaacaactttcaaattccgttatatatcaaaggctgttattattttactcaacatattttatgcattttcagagaaaaatatacttttgagagtgacttgctatttgaaattgacctagtcatagactcatcttaatatggaaaattaagaggtggttgtgattacgtgtgctttcatcagtgattcttttgagcagcatataaatggggttagtacaggagcagttgatttgcaaactaaacaaaattctgttccccctaaaaaaacttaagagaaacccttcaaataaagatattaaaaagataaaagagagccatgctgcttgaatcagggtttgaggcctcagagcctcatgcagtctgtgctggagccagcatggacccaggttacaagagcagataatgtacacctcttctcaattaagaacattagagtggtaacttgaaatcagccatcatggaactatctacaccatggaaattgtcaaatgctacaaatcagggagattttttttttcctcatgcaaagtgacctctgaccttacctctcatcaggctcttcacccacgtgacaacttaaaaggcaccttaacaggtgtatagaactcagagcatcactgtgagaaaaccattcatgtcaggcagcaattgttctacataaaatgtaggaatactaaaccctttttagtaaaacagaataaaccaatgctaaattagaaaattctgctaacagtcccacttttcactgttttttagctctcaagaatgaccatttgtttcctgttccaaagcagtgtagagtaagccagggttagcaacacacatctgcaacagactccgtgaaaaaagggagtagtcaggatttgagaaatatttctataatgtggtttcttacatctggtgttgagaccagagcagctcctttaaatcaaaaaattgtcagatgagtgatccttagagaataaaagaggcagggtaggagtgacctttggaactcctcctggaaaagcgtacctccctgaagattctgtccctccacccttcaaccagcaaaacaccatgaagtcagctctctgactcaagagtggcagtgtctgtctcttcgttgcacttccagggtttaatatcgtctcatgtagccgaaccacctgcagccaagtaatccaaagtattctctcttctctaaggttaagaatgttgcttctgaagtcctcccaatgaaggatcaactgtgattttcctactttatttccccctacagtagtatggttgcccagtcaaccccataaatatatggctgtgttcttaaagaaatgagactggcagaaatctcataccctcgttctaatgttccctgtaggtgcttcttttaaaacacggttggtagctctgttagcaaacgaccccaccagcaagcccaagtcagtaggaagaagcctgccaattgtgtcattatatttttccgtaagtaattcaagtttgtggaagaaacaagacacttttggtatgttgcaaagggcagccaaagaatgaaaactctgtggccgagcaaacatattacattattctgctgcaacatgtataaagcttctgcaggagattgtttgtatagttgtatatcctgttaaagcagaacttaatgaaagtgttcaactttaacatctctttataagtataacagagtcatgtgcttccatcatcatgccttggacaggtcgggtacatgcaaaggatcacagaaaattgatgagccacatagtcagtagtggcaaggatacgagaagttcattgttggcagttttgttgattacatacgtcttctggttgtgcttacattagagtatttctctttctcttagatgtttgaaaacattcagttaggaatgtttctaagaaaattgaatgcataagacatagacatgaaaaattaattacatcgtctcacatcattattcaaaacgtgaataaaatttttaaaataaatattattaaagtttagaggagagagagattgtagtaaaacagtctgatttgaaaagggattaaaaaatgtgagattgagcttgccctagggtgattggacgtggataaattgagtaaggaaggaaggggttttcagatgaagggtacagcatacactacaagacacagatggaaatgaataagtgatttttcgaagctctgtgtgggttagtaggactggagcagtgggcttttatatgtaggggaggcaaatataaggaagatgagggtcagctaatacataagcacaagtcttcaactatgtaatttttttggcttcagacaaagggcttggattaccaaggttgaaacataaaatgagtttttctcagtatacaaatttcatagaccagtactagaaataagcatagattctagagtgccaccaagaccctttatttatctatataccactcatcccccacgtgttaggttaagatcccctcgaccgtgctagtcactctttctcagcctagttttgcatttattttctgcaatctgtcttcagcctcacctcctacctccttccttcactttgggctccatgatccagccatgccctacgaattacagttctctaaatactctaaattttgttttatcatccctaaacctcttcactgaccttggcagctgtaagttctccactgttataaacttgttttaaaaatattgcctcttgagtatgtagggaaattgatcctaaaccaaaattgattgtttatcttacatttgtttcaaattattactttttgtcataatattgttattttgctttgaatatgtctatctttcttactagaatacttgtgtctgaagataacagtaattttttattcttgtgtcccctactgggcacatcaaagtgctttttggataaaatatgctcaagtaatggatacgtatattaacatataagtatattctgaaaactgacctaatggacgtgaagattaagagaacatttagaaacttcagaaggcagcagatatttatgaatacctgagtataggaagcaagtttggtaaggacaattgctgttactttcctaacatggcattcttattgttcctagcatttcatatcacactttagtaatcagagcacttgaaatgtctttactcaaaaaaggagggcttatcactgcttgataaacaaatagctggaagaactgaggaaaaacatttaaaggagaagtttaaccaaaattacttaatgactatttgcagagtaaaattaatgttctaaagaatgaaacaccagcctagttagtggacaaatattttacgttagcacatagatgttatgttatcttgaagtttcaataaacatgttttattattttgcaaggtgagagaaaagttaatcacatctgatttattcttggcagtatgacactgagcaaactcagtgcagacagagtctacaaagggcaatcaatttgtgtttgtgttacattattagcactcattgtctgtcttatcagcagagttgatggcatgaatcaatagaataattattatcaaaaagaattgtttggtaagtttgaacatatactaggagacacttgtttctaggtgataaattcatgggagtattaaaaaaagtcttgtggagaatattttaatgaatgcaaagtaacttatttgatttgtttagattacctatttaataactatggttttgagcaaccttgacataattgttaacctggatttcatttaccattaagtaaaagccagagactaggcactggtcatttaataagcttgtctcacatcaaactgtactaactggaaattatgtaaattgtttagtaatatatgctaactttgatttttccagaactcagaaacgagaatgcttgcaaatacttaaggagacatttcagtttagcaagccatcattagcggtgttttataaagttctggaactatttaaattacccatgcattgctctttccatgttttcatgcagtgagcaatgtatttccctttttccactttgtgtgaagattgaggctagaaaacacccataattctatattttgcagaagtatggaacacgttcatcagcttagaacaacctcaaattaaattttttgtcctcattttggtctttgttgtgagcagtttgtaaatgtgtatttaaatataatactttttaaaaaataaaaacatatgaactccagatgaaagtctagttaatggaataaagaatgagaggtttcgttttattacttgtctcattactgctactcttttaagtcatttaattgctccttgtacctttctacaaaaagggaactatatttatcagatctgtaaaaagttctagtctggtaatgttaactggtcaaagtaagtctcaatattgcactcatgatgctgcagtctaaatgagtgagataatattagtaatctgctgagatctagctgcacgtggaggcctgcctgacaacattggcccaaaggcactaatactgttggacagctgttgcagggatttaacctggagattgtcatattttgtttggccccccatgttgctgttctttttttactgagtcaacattaaacacttggcagattttacataaaattccacattctatcttctgctgaggtctggaagcacgaggattttattcctgcttagaagcagtcagctggataagtgttcattgccatctttggataacacgtaactccccagtttgtcacagtccccattgcatcctgctatttatgactgatgctgtgcctattgctatcaaacaggcagcttgctttgttactttccttttatcacatacctctctaaagaggataaatgaaaaccaacacgatagtgctgtgtgtttcaagaaaaatatagtgtttttgtttctggaagtagagatatcgacaggaatttaatattgacaggtatttaataacattattaatagtaataatgtttgtatgtattaaaatattatacccaatggtttttctcatataacttaacactcagatccaattagtgagtgagtttgagttctggcttcagcagttcccagcctacccttaagtttggccttaggtgccctacgaatggaatcttctcctcagaagccctgtcaggttcccttgccagaactgctgacgctgttcagcagtcctttctccagatctcgttcttgttttctgcctgcccccttggactcagtgctctgaaacttttccctcctggccagaattgaggcccctgtttcatacagacccggcaccaaaattgcaggccagatacaatcaatgatataatgcattcattcaggccagatacaatcaatgatataatgcattcattcaactactctttggtgattatctactaaccagctctgttataagtctgatggcaaaacaataacaaaatagacccagttacagtcagcacaagcttacattctatagggagaaacaggcagttctagagggagaaacagacaataaagatgcaagcaactgatacataatatactgttaggtaaatagggctgtgaagaaaaatagcaggccaaggagacagaaagtaaagatggagaaggggagctacttttatatgtcatcactttcaagaagcaacttttgaactgagaactgaatgtgaggtaacagaaatggggtgttctggagaggagtatgccggacagggaagagcaggtgctaagatcctggaggggaagtatgcttgaggctcaggagcagcaagacctacagtaggaggggctggctcaggccagatcatgcagaggcctgtaggccattctaaggtgttggtattttattctaaggataatgaatgggatctttgatagaggggagttaccagatttaatttaacacatccaatctaagctgtcttcttccttcttcttcttctcttcttctctcctccccttctccttcctcctcctcctttctcctcctcctcctccttttttctcttcttcttcctttttttatagaggtgggatttcactctgttgcccaggctagagtgcagtggtttcatcacagttcacagcagcctcagattcctgggctcaagagatcctcctgcctcagtttcccaaggagttgggatcgcaggcatgcacagccacacctagctaatttttaacttttttcccagagatgaaattttgctatgttgcccaggctggtcttgaacccctggcttcaacatcctctcatctcagcctcccaaagtgctaggattacaggcctgagccacctaagcccctaagctccaatttctgagctctcttttgggagggcagatcagatgaaataaaacttttacatgtcagagtttgactgaatttaatgataataatataatttattttaacaagtggcagcattagattgtgtccactagtttttgttttctgaacaaaatggtgtctgggacaaaataaatagaaaagtggtgagtgagaagggtgaagagttatctcatatacaagatggcatcagctcttctctgaaaacagaataacatacaatgacttagcctgattcaaaattaatacacactgtactaatcatctacagatagtaaaacataatcatgttatttcttttcacttccataggtagcagatatacttaaaacaactggagcttctaagtgatttcaaaagtagagagtttttgattattactagaacaagacaactattttattaacttggttctttaaaactttctttctag

SEQ ID NO: 185 - DNA, 9564 bp, Homo sapiens
  source 1..9564: mol_type = genomic DNA
gtttgtgatttttttttgtttacttttgattgtcttgctttggtttaagatagataagaagtgtattattattcattcaaatgtgttttggaataattaatttagctcaacattataaaatacatttgaaataattccccactaagaaaatctccaaaaccttttgtttatatagtaatacataatatttattgagtgtctgctattcctcaacactcttctgtgctctaattaatattttaaatattcacaatgacatctgggatatatcattattttattctttaatacgcataaactattatgctataaaaatactgaagtacagagaaataatttggtcaaggtcttataacttgtcagatgcagagtgagaattcaagcaggcaatcttactcttgcagtctgtgtaaagaccaaggcatgtactgtctgttagcccaatgaactcgggttagattgtaatggtaacttctgttgcttaaaaataatatacacttgggttaagacatttctcttcaaaattttaagcatattaatattgacataattttgtctgattactattttaagaatcatacaatattttgagtttcaaattttttaaaaaacataagaatattataaatgagtttatttaattaatccaaggaacactacaaggcacctaactccaccccactccccaccaccgccttacaacagatcaaattttatcatgattctctaacatgtgattttattccattgcatggcagaatgacataacactgtaatttaagcaggcaggcatttttcattcccataataaatattgggccttagtgaaggaggcgagggtagagatttcctagggtctatctctctatctctcagtgccttttaagcagtgacaacataaacaaaaggaaaaacactttgaaaacatttctttagtcaaaaactccagatctatttgtttatacaacaatgtgattctcatcagccaaaaaaagtacccttaataggtagtcttaaaagggaaaacaaatatagaatatccatgactacgtgattacccattaatttcttaacacacatgcaaagcaaagctatctttttgtgcattgtcagatttttgtggaattatttggtttgagagtaacttcttaaatgtcacctatagaatagcttagatacctatttgagtaaaaagatatttttatggcttaaaatgaagtataagattgtatctctgtcttgggatggcaaatatcatgtttctcctcttctaaaagacagtagtattttttccattactgtaacatattcattaataagtcagcagcattgtcaatacaataaatgtaggaaatatgcattcaattattatttgcctagatatgctatttttagtactgtatgaagaagattagagattaggaagcctttgaattggtttaacaatttccttaataaacaacttctgagaccctattgcctactgggtgctattctacccttgtggcctgcatagatagataggggagggtcaccgacctcagggatgatgaacgccttgctcagcctgaagcataaagcgggagtaggagacaaggctacaaagctgtaaatattatcttgaaaccatgatggcttactttttaatcaaggagtcagaattttgtttttctaaaggtaacttacaaaaacaatagcatgttttttaatagcatgaatggaagactaaagaaggacgaggacagagagacaagaggccactgcatgaaaatagggaaatgagaaagggacagcaacaaaagtagtggaagtatatgagaatatactgcaaagaatatttgagagagaatatactgttttgtaaatagaagaatccaaggacatgagacagagctcaagagatttgtatgctgggaaaactttgcaattaaagaagccagtagaataaaataaattgaaggtaggagaaaagacaaatggtagaggaagtctcaattgactgacttcaagcaaataattatgatgcagaaaaactgacttttatggttctaggagattcaaggcagactgcttagcagttaaaagccagggtgataatatgacctactttgcccaggacattttcagtttgctcctgttcttttactcttaaaagtgtccctgtttagactaaaattgattctgtggaacttatttatttgtgcttaattcctgaatggtgactttggtcaaactttaatgtccattcaaattctttgtctgtaaatatggaatctattaacaatagaatctattcacagggcgttataaggataaaattaaatcatatcgggaagtctattagaagacaattttaagagctgaattagcatcaatatcatcatgatcattattaggtatcatgtggtaccatgaaggtagcagtgggaggtagaagtgaggctaaaacctgaatgctgtgtgattctctactatctctttagcattttgtattattgactgccttttcattctctccctctacacttcataattctgtgagctcatccatccgaatagtttcaactgtttcctgtgttccagtgtttcctaaaattgtatttccaaccttttcctgtaactaagtggcctcaaaaataatttatttggatgacttccatttttattctagattaaaagaaaaaagattattgttttatataaaaatcaagatatgtaagccttagttttgattgtgctgttaaattgctttaaggttgttacaagtggtttaatgaccctttgttttaattggatttaaagtctaaaatcttgtgaatgttatagatcttgtttcttctttcaaacctgtccttcaatatccattttctgatttttatctattttaactttcctaacttcatccacccagttaccttggagttatctttgattccttcctcttcttcctctcctttatctaatctatttctaagagcttttacttccttgaaaatatctgttgaccttgttctttctatggttaccattttcctataggtcttcattacctcatctctggtttattgccaccattttattgtttactaactgatctccccatctctcatctcttcccattcaaaattattttatataatatccatgctagtcctatctttggcacttttaaagtgctattttattgactgttataaacctgagagaattactatttacattttacatttgatgatatatttgatgtcagataatagttcatagttaaacagctagcggaggtgagattgaagctcgaatatgtgtatctcgcccctgatattgtatcatttccattgtataatacagttcatcggctcaaaatctgctcttttgatggcatgtcccctgctctttgcagcctcactacaaactgggacatatggacatgccatgtagggcaacagcaaatcaaggatgtgggtctggtagcaggaagcagggacagatagagaagatggagttccgcaagcaatgagggagacctaggcagtctggctggagccagggaaagcagggaaagtgcaagcagccattcagatatttgctgagggaaaggcaggccagagctagaagagcacaatgcttcaggagattcagtcattcaggagttccccagtccacagaaactagggcagagtaaggggagaaattgtagaaatgatgatattcttataatgaagagggatctgatggactaagacaaaatattggcttgctcagagaacatttctgtcctttatgagaaatgggcgattttccagatacagtcagcctatggtccaaagtcaatggagtcatctgtctggagtcaggagtgggaggggagagaatacagatgaactgcgacaagtgagtatttaactgttaagatgcagattctaaagagttatcatttttcatatgatgctacatgaatcttttataaatccatttttatcaccgaagcacttagggggtttaaaattcttgatacaggtgtgcatggcatattatgttctgtgccccacttggcattaaccagagtgagatcagctaaccacttaacagtgcaaggatccttctcagaatttttctaggactgtttaatccagtttagacttaaaaagtaggaatcctgattccttccttaagatactaatccatctagcaaataccttacgaggaggatacaaaatggcaaagatgaaattttttcatctttgaggcagttttcatttgaagttgtaaaaagtgttttttttacagtatttttatgggcatttctaaatgaagtctttgatggttccacactttgatttatcaacttaatcttaaaacatataggaaataggaatatagatgcaaactagggtgtttactcaaatgcagttgagcttttgttacaattttaggataaaactaagaagtgtgaccacttggaagatgaaagcgaacaataacgcctcagatgcatgcagatgtttttgttttctttcttggaatagatgagaacttttgttttaaattttcttttctaacatatggagacagttttcatttgaagtttctcttgggatgatctgttgtctgtaaactctccttccacatgaaaggagaacatcaaaaaatgataataggaaaatgagactataagaagtaataaaaggaagttaggaacttactatctattaaataatgctagtgtgctcatctgggtgaaaagagtttcatagggagaaagggaagtagtgtgtgctgcaggccacatgagtttatgccatgttcttttggcagtgcctcttggtgtcatgctagaagttcatctgaaaatgcatgatttcaagctgcattcctactggggcatgtactcaagtgccaaatggagaaaatgtgctataataaagcccaggtgcctaatggtataattttaagttgtttaattgatcaagtatgcactgattaaatgatacctatttttacccaaatttggcagtaaatcagggaagagtttctgtcataaaatactaacatcagagttctaagaccggacctcaacagaatctgcaagaaataaactctgtgcttgcaacttgtatttatttttaactctcaagtatgcttactatttaaatcacagaataaagcactacttgacactaactctttttctcataattaaatttctttatacaacaaacatttagctttaacacctccagtattcccttgcaaaacattttttacagtacttgcaagagagccaatatttaagagagagttcaataaaatcaataatgactgaataaacagaataagactgtctatggcatatatcagttgaaaggtaaaataaatatcacttggaaaaatatccatgctctttcctcctcccacctcattgatgtcatactgaaatttctgaaatgtagactagtatcatagcctacctattggccatttcaaatagccatacctgtcaacacttggatgatgtttttcatatctgaagtgggttttcctatgcatttctgcattatgacaatgaattgccatatttatttataccccttttacacttcttttatcattatgttctattttattattctgctcttttttcttttaattaaactctgtaaacaagtgaacaacaatcagctcatggaaccccttctcccatttgagtgattgaggaaagctttataagcaactctctccttcatattggtattccttttaactgttctgcttttcggtttcgaatcactgagttctcattttctctctagagagaagattctctacactttgtaccactatgttattttttaaattataaattcaattcaatcattttgtaggtttgacaggacactgaaatttcaagggacatcatgctgcatgtgtaagttctacattaattatatgcaagtgctacaataaattctactcatgttaataccgatgtaatcccacatatttgtgaagataaggaaatccaatcatttcctataatttctgcatagtttcagttttatacatttttcccattcaaattacttaagaatttattattaattccccacgcccccatatatacatacatagaactatattattgaccttgagttaatgagtctaaatgtatctttttcccatcccgtatatagatagggttttatttatttttgtatttgtatatgtttaaaatacacatggcagttcagctagagaattccatccagtttggcagcactggatttaagcatctgtaaattcaaaaagttctaaagattattattcatccctggtctgtgtttgtgggagcccactgttggttgtttttctctgttcattgttgtaatatcaagtcagtggaaaaatcatggctatgcattctctttagccatgtcttgaccatttgtcaatatttccttaatccagatcatacttggtttgatatagagtgtcagttcttattcattcttttattatttaattcaaatagttttctttttttttgcactaaattccttgaatataatagtaatgaaatacattatttctctgttttcttgaatttcagaaacccgaatctcacatttatagaacaatttgatcccacaaagagttgcttttttttttttttttttttgtagtggagtctcgctctgtcgcccaggctggagtgcagtggcacaatcttgtctcactgcaagctgcgcctcccgggttcaggccattctcctgcctcagcctcccgagtagctgggactgcaggcgcccgccaccacgcccagctaatttttttgtatttttagtagagatgggctttcaccgtgttagccaggatggtctctatctctttacctcgtgatctgccggcctcggcctcccaaagtgctgggattataggcgtgagccacaccaagaggtgctttttaaaagaaaacatgtttaaataaaaaatctgaagtgttggtttgcgattaaaaaaaaagagatttttactttgctcagtgatcaaaaccaagtattcgtgatttactaacaatttgaaagagggccggggcaggggttggggaagacattgaatggaatttttaatgggccttgccaatttgagattaattagaaaaaaattaaatactttatgtggttttctaaaattttatttttatatatttttgaaaaaccataccaaagtgagattatcaagaatataaaagtccattgaagctctaaattaccgacaaaacaaacaaaagaaaacaggaaaataatatagaataaggagaagaaagttcatgaatgtatttccctcctttcttttcctttcaaagctttgcattaaagcaaagaagagattggatgggagacacagggccaacccagagaggctgagacgatattgactgaatacccatcactcggaatccaacgttaactttttatttacttattttctttttgagacggagtctgtctctgtcgcctaggctggagtgccctggtgtgatctcggctctctacaacctctgccttctgggttcaagggattctcgtgcctcagcctcccaagtagctgggattacagatgtgcaccaccatgcccggctaacttttgtatttttagtagacagggttgcaccatattggccaggctgttctcaaactactgacctcaagtgatccacccgcctcagcctcccaaagtgctgggattataagcgtgagccaccacacccagccccaacattaacttgtctattaaagaaggctactgtgaagctttattgggatattggccaattgctgtacatttgcaggagagtgattttcataacacctggggcgcacagcaatcagagctctaggcaaaactctagaaaaggcaatattgatctttttcacctcccgccaatttatttttctgttaaaactttttggcttctcttttctcttgcttctgcttcttaaaaagtcagtgctctgttcttctttccaggtgccacatattttctaattgaagtctttccttcatttctcaataaccatactctctgtcttctttgctttaatccaattatttctgaactggtatcatcctattacgcatctgttacctggttaattcacaattatttaaaaccaagacttaaaatgccgaatacctcttaaacaaggttttagaaacccaaataaatttttcagtgatacagtgaaaagaggttcatcatattgcaaacatttttacactgtacatatattatggccatctttccaggtcagtacctacagatctactaaatttttaataatgacatattatttttacaagtacatggatgtactcaattttctattaacccctgtatattgtcatcgtaatgataatgcttatcagccccataactatcttaataataatcacacttattaaatacttattatataaccagcctttgcctgatgctaaatgctatacatatatatatatatatatatatatgctgtatatgtatgctatataaatttcagtatgacatcaatgaggtgggaggaggaaaaagcatggatatttttccaagtgctatttattttacctttcaactaatatataccacggatagccttattctgtttattcagtcattgattttatagaactctgtcataaatactggcttttgtactgtaaaaaattgttttggaggaatactggaggtgttaaagctaaatgtttgttgtataaagaaatttaatgctatatatatgctatatatataaaatgttatataaatgctatatatatagcatatatacacatataaaaaggaatttaatgcttatatatgctatatgtatataaatgctatgtatatacacatataaatccacttgataataatataaattatcttattaggtagatgacgttggtagtcttatattacatatgagtaaattgagtcattgaaaagataaataatgtgtcaaaggtcaccattccagtgagtggcagtgaaagagataaattcagaaagtttatctagagcctatactgtcatattgaacttgaaccaaacactactggttgtttccatttttatacccctagggcaattacacaaaattcatcaaagtattaatacatcacagtatgtcaaaatcagtgctagatttttactatttcctaagccgtttatgaaagacatggtggttgaaaactccattatatagaaagagaatataaaatgatagcatctccatatctgaaaagatctacaagcaatttagtctagtcatgttctcacctgctctctggaattcctggagaacttgttcagtacctctttatgctgatacatatttctacattgtgtcatcttcatttgtatacacatctcatttcccacatctggcttatagttcattttttaaaaattctactgctaattgcttttacgtggaaatatcatcaaactatgatgactggattgtttcagtatcttaatttatagcttcttttctttcaaacag

SEQ ID NO: 186 - DNA, 6211 bp, Homo sapiens
  source 1..6211: mol_type = genomic DNA
gtgagttatcctgctgttggttgtccttctgcagtttgctgttggggtgatctggaaaagtggtattttataagcattgtctcgaaaggacagttgaacaataatagtgtgaaacattttatttgtaaattagaaaatcaatacatgcttgtaaaaaaatttaagacaatatagaaatatgtagggaaaatgaatctcccttcagccaattccagctgcccactttttttttttttttttgagattgagtctcactctgtcgcccaggctggagtgcagtgggcgatctcggctcactgcaacctccgtctcccggattcaaggaattcttctgcctcagcctcctaagtagctgggattacaggcgtgagccaccacgcccggcaatcagatggccttttgtgccgagcttatttcctgaaaatgtttctcgctccttcgccttgtagcttgtgttagtatttcatcctgtttcatggctaaatgttccactgatgtatgcaccacagttggtttgtttgtacatggatgggtgtttgggttgtcccacctttctgctcttgtgtatagttctgctgtggagcatatgcaagtattcgtttgagagtccttgttttttattcttttgagtatgatacctacaagtattgctgggtaactccacgtttagctatatttatttatttattttttgagacacagtcttacactgtcacccaggctggagtgcaatggcgcgatttcggctcaatacaacctctgcctcccgggttcaagcgattctcctgcctcagcctcctgagaagctgggattacaggtgcctgccaccatgcccagctaatgttttttgtatttctagtagagatggggtttcaccatgttggccaggctgctcttgcattcctgacctcaggtggttcacccgcctcggcctcccaaagtgctaagattacaggcgtgagccaccatgccctgcccatgtttaacttttttgtttgtttgttttgagacggagtctagctcttatcaccaggctggagtgcagtggcgcaatctcggctcactgtaccatccgcctcctgggttcaagcgattctcctgcctcagcttcctgagtagctgggactacaggcacacaccaccacgcccggctaatttttgtatttagtagagtagtttcaccatgttggccaggatgtctcgatctcttgacctcgtgatccgcctgcctctttctcccaaagtgtgggattacaggcgagagccactgcgcccggcccgttttaactttttgaggaacgaatatactgttatctgcagaagctggaccattttacattccaccaacagtgggcaagggtttcatcttttccacatcccaacacttactttccattttttaattacagctatcccagtgggtgggaggtggtaacccactgtagcactgattggcattttcctaatgattcatgatatcaaacatctttccatgtgctttttggccatttgtatatctttggagattgaagtcctttgcgcattgtttaattgtgttgtcttttttattgttaagagagtcctttatatattctggaagctagatccttatcagagacatgatttgcaaatattttctgtcattctgtaggttgtcttttttactttgttgatgtcttttgatgcatagaagttttgattttgatgaaatctagtttgtctatttattttctcactcttttggaatcatatctgagaaatggtattgttttactcctgttttcttataagagttttatagtttaaagcttttacatttagttctttgatccattttgagttaatttttgtgtgcgctgtaaggtagggatccagcttcattttcttttatgtggatatgtaattgttccagcaccatttgtttaaaaaaactgtggtcttggcattgttgttgaaaatcagttggccataggtgtatgggttatttctagagtctcaattctattccattgttatctgtatatccttgtgcctgcactataatgttttggttactgtagctttgtagtaagttttgaaattaggaagtgtgagtccagcacatagtagaaacttgatatatacgtattattgttttggtcaactcattcattgaatgaccaatttattcaacaaatagtttagtctcctcagtgccaggccctttgctgggttctgtggatgtgaatagaaattaaaataaggtggagtcatccaacagttacaactgggtgccatacgaattttactataaatatgtactggacactacactgactcagctgtaggaacagagtaggctgggaagcacctttgagatgaggccgtctggatgtaagagtctgtttctggcagcagagacctggagtgtgggaggcctgcttgctctgttagggtttgaactgtatcctgacgatcatgggaggcattggaggatttttaggcaggaaaatgatgtgaagggatttgcatttaaaagagattatttgggactgggcacagtggctcacgcctgtaattccagcactttgggaggcctagacaggcgggtcacctgaggtgggaagcttgagagcagcctgccaaaatggtgaaatcccatctctactaaaaatacaaaaattagccaggtgtggtggtgcacctgtaatcccagctactcaggaggctgaggcagaagaattgcttgaacctgggaggggaggttgctgtgagctgagatcgcaccactgcactccagcctgggtgacagagtgagactccatctcaaaacaaaataaataaataaataagagaataaaatagataatttgggcaacaggttgatgttaattccccacctttgttcttctccttcagtactgtgttggctggtctgaatcttttggcttttcatataaatttctgaaactgttgctatctgttctctgcctgttttatttttgttgttgttgtttggattttttgtttttttgagatagagtcttgctctgttgcccaggctggagtgcagtggtatgatctcagctcattgcaacctccccctctcaggttcaagcgattctcttgcctcatcctcctgagtagctgggattgcaggcatgcgccaccatgcccagctaatttttgtatttttagtagagatggggtttcactatgttggtgaggctggtgtcgaactcctgacctcatgatccacccgcctcggcctcccaaagtgctgggatgacaggcatgagccaccgtgtctggcctctctgcctgttttttaagacttttgtctttggagttttgcggtttctccactgtggttttccatatgaattttcttttatttcttctgcttaaaatttgtaggccagttggtcatggtggctcacgcccgtaatcccagtactttgggaggccgggtgggtggatcgcctgaggtcaggagtttgagaccagcctgaccaacatggagaaaccccatatctactaaaaatacaaaattagccgggcgtgatggtgcatgcctataatctcagatactcgggaggctgaggcaggcgaattgcttgaaccagggaggcggaggttgcggtgagctgagattaggccattgcactccagcctgggaaacaagagcgaaactccatctcaaaaaaaaaaaaataataataataattgtaggccttccttaagaaaaataaaataaaattctaggctgggcgcggtggctcctgcctgtaatcccagtactttgggaagctgaggcgggtggatcacctgagttaggagtttgagaccagcctggccaacatggtgaaaccccgtctctactaaaaatacaaagatgagccatttgtggtggcacccatctgtaatcccagctactcgggaggctgaggcaggagaattgctggaacccaggaggcagaagttgtagtgaaccgagatcatgccactgcactccagcctgggtgacagagcgagatgccatctcaaaaaaataaaatataaaataaaattctaagccctgcaaccaactgaatggagccctccccttggtcaagggaaccccagagaaaccttggaagcttgagttcctggccgtagcaggagaggaggtcagacgcgcctcactgtacccctccctccccagccaccattaggcttcttcactaagggctaaacagaaaccagcccttttcaaagactctacactgctaatgtggattactggtttatcttcccagatacagattaaagacaagatgagattaatggttccttcacccttccctgagaggtctgcttagttctcttcctctgtttccttctatcttaggtaaaatgtacatttactgggcacttactgaagtctcacaagtacgtaaccactcacctcacagccaccctccctctttgaaggaccacatgtaattactaaacctcctgagaacctcttgggacagaaacaagcacagatgtgccgtgactcatgtttttcctgtgggcaccctcaggctggctcagtagccctcacttgcttgagatcctgaatctgcgggttggcgtctttcatggttgctggatcatactctgccgttatctcttcggatatgagttgcccctagcccactatctggcccctctctttagggacctctgattgaacatacattagaccttctctctcctgctgttcctgatcactcttctgtcctgtaattgctgcttcttgtgctgcattctgggtaatttcttctggtcttttttccagtttactaatattgtattctgttataaggtccttccattgagtgtttctttctttcttttttcccaaacagcaactcaaaacagacattgagttttaattttggttcctgtactttttatttctagaagttctatttggttatttttcaagtctgctacattattacataattttttaataattttatatctttaatagatagttttttgttttgttttgttttgttttgttttttgagacagagtctcgctttgttgcccaggctggagtgcagtggtgcaatctcagctcacagcaacctccgcctcccaggttcaagtgattcccctgcctcagcctcccaagtagctgggattacaggcacgcatcaccacgcctggctaattttttgtgttttagtagagacagggtttcaccatgttggccaagacagtctcgatctcctgacctcgtgatctgcccacctcggcctcccgaagtcctgggattacagagctgagccactgcgcctggcctttgatagatatttcaagttcatcttttttttttgcttccttaatttttttttttgctataccccatgcctccaagataacagttttttctttttaatttaaatataatacagttttactgtgtatccaagaatatctgaaatctttcgtgggtctctttcttttgtcttttgtatctgttgctttttgctgggctgagcctgcttaaaacaagccccgttagctgtaaaggtttaccttagaaagtcaggtgtcttcctctgtaactctctcccttttccatctgctccaaggcatttatttatattaatcttgacgcaaagggaagttgtgtccacttcaccttggccagtaaggaagcagtgtttggcagatgttgttactcctaataatgccagccagtgagtgaagctgacctgaatgcctcccagggctgaggcaatggcatgatcaccgaagctcaaaccagagacagtttcacctttctgactgaatagtgttcggtgtaggccaaatgcctgcagactactgtttgaggactggtgtggtctaccaggtgtttccttagcgcctggatgtctctggctgccatcccagggatagagcatggtgttagatacgctagatgcctgccgaagtaattatgggtgaaacatatgatgtccaagatttgcttttaaaggctccaatacctcctcccagattccggagggctgtgaaacaattagctatgaaaactggtaattcctgaagctgggtacatgggggttcatgatccctctctcaccttttttgggggagaatgtttgagactttaataagaacttgttgccttttccttttacagggtgttgcaggcatcttcctcaggcctgttttctctgttttcca

SEQ ID NO: 187 - DNA, 11213 bp, Homo sapiens
  source 1..11213: mol_type = genomic DNA
gtaagtatggcttgctggggtcggggccgggccgggccagtcacggtgctgatggttctgtcttccttccttctctcctccctccctcccttacttcctcttaacaccctgagctggacccgtctggcgcctgtgtcctccgtgccagggagagcgtggttgggggcctgcgttacggactttcactcaggcaaggccagttgtcgcagcggggcgtgcgtttgcatgggctcttggactccagttaaaatgccctggtagcgaaaccctcctgagaagggagcggcccccaatcccctaagactagccccttggctcccccagctgtccaaggagcagaggcgcccagtggaatcagcctgtgtttgtttgggccccgagagtttgtgtgcggccgccaacacgttttctgcgcagtgtgtggccgttaccggggccaggcgaaatgtgatttgtttatcctgtcagaggggaaccctgggctgccaaaaataactgtttgcaccggcttatcagtcagcaggagggaaacgtagcctttcctcatttgccagggatgtgacgctggaagcatccctggcccccggggctggaagccctgcccgagggggactgtgcctccctcccgaattgcatccggaagaccttacttttccaactgacttcttcaggcacggggctgccgctgggcatcccggacgcctctgcatctgtgcgcggagaagctcctacctagggcagcactggccggcctgagcctctcccagctggtgggggtggccgggggtgtccctgccttatcgcagccagacacgctgcacctgccgccgcctggcgggccctgcccaggccctgctcctttcccagccttcttaactttcaaaactttgcctcctgtttccaagaaaggaccttatctgctgggctaggcctcgagggactggcaaggacaccctgcgcagggcaccatgaccttggaaggaggtccggggaggggctgctgcggtgtctgctctcaccttcctcctgctcaggggccctggggctcctgccgtgtctgctctcacctctctcctgctcaggggccctggggctcacgtacatttttttttttttttttttgagacggagtctcgctctgttccccaggctggagtgcagtggcgcgaactgggctcactgcaagctccgcctcccgggttcatgccattctcctgcctcagcctcccgagtagctgggactacaggcacccgccaccacgcccggccaattttttgtatttttcagtagagacggggtttcaccgtgttagccaggatggtctcaatctcctgacctcgtgatccgcccgcctcggcctcccaaagtgctggtactacaggcgtgagtcaacgcgtgcggcctttttttttttttttttttttttttttgagacggagtttcactcttgttgctcaggctggagtgcagtggagtggtcttggctcactgcaatctccgccccctgggttcaagtgattctcgtgcctcagcctcccgagtagctgggattacaggtgcctgccacagtgcccagctaattttttttttttttttttagtagagacggggtttcaccatcttggccaggttggtcttgaacttctgacctcgtgatccacctgcctcagcctcccaaagtgctgggattaaaggcgtgagccaccgcgcccggccagcacgcttcttaatcagcatgcaggctgtgacatgcggaaaccaggggcacaggctctgaagtttgtactctggagctggagcagtcagggttaaatgggagcggctgggaagggtgtgtttccacgaggcctttctgatgtctcagtgcccagtctggacccgggtagaaggtgtggccagtgccttgagtcagtggagcagttgcctgtgcctggtctctgtgagatgggttggtcaggggctaggcagagcctgtgcctggtctctgtgagatgggttggtcaggggctaggcagagcctgtgctgggggtagcaggtgccctctaaaggggccagtgacagtctctctcccagcagtgagaaacccacgcttaggggccgggcgcggtggctcacgcctgtaatcccagcactttgggaggctgaggtgggtggatcgcctgaggtcaggagttcgagaccagcctggccaacatggtgaaaccccatctctactaaaaatacaaaagttagccgagtgtggtggcgtgtgcctgtaatcccagctactcgggaggctgaggcagaacattgctggagcctgggaggcggagcttgcggtgacccgagatcgcaccattgcgctccagcctgggcgacacagcgagactctgtctcaaaaataaataaataaataaataaataaataaataaataaataaatctggcttgagttttgacaaatgtatatgcagggtcaatgggaagacagacgctggagggtggaagcctgactgtgagagtgagccccctgctttcctgaacagtcagtggaggaggtcctgggagctcaggtgagcacctgaacggtagggcagagcctgagggtcttggtggagacaggcaagaaggttgcaggaacctagtctggcccagtgcctgggagaacgggagggaacacggaggcagggaggcagaggggttggcaggacctggactggactgtgcgtcgcagctacccacagcttgaccccactgccttgaagtgagtgatgcaccctcactagtgttcagcgtccaatttcatcctggccctgagtgtgtaacggctttgcccttgcggggccccctgggatgaggggtgagccctgtcccttcctggtcactgtctgccatcaggagctgccccgcttacagctgtgattcaggagccactgcatttcctccagccccctgggtgctgccagggggtcctcctattctgggagctggtgtgttctgactggaggctgccatgtgcagagtgctgtcaaggagaaggggtgtccactgcccagccctgaggcccaaggccttggccagccttgctgccagcgctgcagggaaaaagcctcctttgtgtgtgggaagtttaataaactccgctcagattgtgtctcgcagcgagtgtctggaaccttccagacaagcctcaggcgtccggtcctccagttggtgtggaaagcgtgggcgatcaccaaggggggtgggttggggcagatggagccggcgtgagtcccgtctcttcccttccttcccagaaaggcagccctggagtccatgccttgtcccgctctcaccggcaaaaagtataatcttattagaaataggaaagttccaaaaagcatcaatgagttaaaaagagggctgggcatgttcggtcatgcctgtaatcccagcactttgggaggccaaggcgggtggatcacccgaggttgggagttagcctgaccaacatggtgaaaccctgtctctactaaaaatacaaaattagctgagtgtggtggcgcacgcctgtaatcccagctactctggaggctgaggcaggagaatcacttgaacccgggaagcagaggttgcggtgagccaagaccatgccattgcactccagcctgggtaacaagagtgaaactccgtctcgaaaaaaaaaagggctggggccgggcgtggtggctcacgcctgtaatcccagcactttgggaggccgaggcggtttgatcacaaggtcagaagtttgagaccagcgtggccaacatggtgaaaccctctctctactaaaaatagaaaaactagccaggtgtggtggcacatgccaataatcccagctacttcatctgaggtcaggagttcaagaccagcctggccaatatggcgaaactccgtctctactacaaatacaaaaattagccaggcgtggtggcgcgcgcctgtagtccagctactggggaagctgaagcaaggagaatcgcttgaacctgggaggcggaggttgcggtgagccgagatcgcatcattgcattccaggctgggcaagcctaggagagaagagcgaaattgtgtctcaaaaaaacaattaattaaaataaaatcagtgccataggctgtttctggtaggcagtgggttcctagggtggagcagggaagggctggaaagggtcgcctgtgcccagcccgactccccgtgcttctcgggggacagcacggctagctgctgctgcggagcccacagtggggttctgggggggggggtgcaggcagaaggccgccatgcctccctccccctttccaccccagtgagagtgggctcgaaggcagggagtctgcccgccttgtggagcctccgcagaggcacccagggctgccgtgagcgcacagcctggcggtgtcccacggccctgccctttcctgtcacttccacctgttgcaaaacactgtgctttcgtatcttttctttctacctgtttggaaatgtgaaaatcactgctgccgtaggaaacgggcccagatccgggctgtggctctcccatccgcaccgcccccgcggtgtccagccaggaggtgggaggtgggcggcactcagtgtgcctggttgcggcgatgattggcagatgcttggacctatggtaaagaggattttcgcgagctgggagtcagtcctggactttgtaggtctttacatcccaggcggcctttatggggttccagcatctgctgaggcccctgcgccagccatgtgaggcctgggtgtcctcgaggcctctgtttgtgcccctctctgggcagcgggagggagagctctgagacccagagggagctcaggggctgggcagccgcagaacagcgggggtaatgggtccactgggggttctgggctgtgcacacagtgggcttccggtgcccagccagctggggcaggcctggaatgttggttcctctctcaggatctggggcgctgctgtagctgtcggggaatcagtgaggcggctggacggcccgtatatcccacaaacgccaccgtattgctcaaactggactcaattttcttaacacctttttttttttttttttttttttttttggagacagggtctcactgtatcgccgaggctggagtgcagtggcgcaatcatagctctgggctcaggtgaccctcctgcccccaaggtagctgggactgcagatgtgcaccaccacacccgactagttttttgtagagatggggtttcgccatgttgtccaggctggtctcaaactcctagactcaagctatccgcctgcctgggcctcccagagtgctgggattacaggtatgagccactgcttcgccacgttcacctttatttacttatttatttatttttgagacggagtctcgctctgtcccccaggctggagtgctgtggcacgatcttggctcactgcaagctccgcttcagcctcccaagtaagctggaactacaggtgcctgccaccaagcctggctaattttgtttttgtatttttagtagagacggggtttcaccgtgttagccagtatggtctcgatctcctgaccttgtgatccgcccgcctcggcctcccaaagtcctgggattacaggcttgagtcactgtgcccggcccacctttttattttttattttatagagacaagggcttgctgtgttgcccaggctggtcttgaacccctgaccttaagtaatcctctctggcctcccaaagtgctgggattacaggtgtaagccatagtactgggcctaaagttcaccttttttttttttttttttttttttgagatggagtctcgctctgtcacccaggctggagtgcagtggcgtgatcttggctcactgcaagctctgcctcccgggttcacaccattctcctgcctcagcctcccgaatagctgggactacaggcgcctgccaccatgcccggctaatttttttgtatttttagtagagatggggtttcactgtgttagccaggatggtctcgatctcctgacctcgtgatctgcctgcctcggcctcccaaagtgctggggttacaggtgtgagccaccgcacccggcaaagttcacctttttaaagtgtgtaattcagtggcatatagtacattgacagagttgcacaactatcacctctatcagcttccagaacattcttgttaccccagaaggaaaccccgtctctgtcagccatcactccccattccctccccagtcccggcacccacgcattcccttcctgcctctggattggcctgtcctgaacatttcacacgagtggtgtcacacaccgcgtggccttttgcgtccggcttgtctcacggagtgtgctgtcctcaaggggcatccgcgccgtggcctgggtccgaacctctctgctgttcacggctgcgtcactttccagtgtgtggagggccacgctgcgtttgactgctcatctgtggctggacacttgggctgctcccgcctctgcctgtgaattgtggctgctttggtgcacgtgtgctcagccggcgtccctctagaatccttgagggccttgtttcagccacatcaggagggattcagggaccagggcacgcgggtctggagctgggtgttcctgggtctccatgtgcctcccagtcctgctctgagccgtgggaggccggggcgagggccaggcccatctcttccctgtatgatctgtttctaggcagacggaggctcctagccccacctctctgtgagcttgagtggcgtttatgactctccttcctatttcctgtcctgctaatcaacaagtcagctaaacagtccatgctgcctgggcaagcccagtaggcccctaacgtggcacctcggagcggctggcgatgccccaagagccgggcttccccctcctggaggctcttcctgttcctcgccaagctcttaggtttcgctgggcctcctcttctgctctttttctggctggagacgtcagaggaagcctggcgatctagagaagctgatgtgcacccatcatcccggaggtgactgccaccaggcgggggtggctccacccccactcctcccctggcataaatcgggggacgcacgtgcctgcgcagaatgccttggtcccttttaattaaacagacaacccagtgtcccttggtctatgctgacctgctcaggagtgcctgggctcttccacgtttcagctgctgtgtgtcctgctgctgtgaagtgtccccgttgaggtggaggcagggcagggcgccttcggtgagggcgagtcctcctgtgcccgtttccccatctgtagaatgatggctcatggaggagacatggtgtcggcaggtggtggccggcgcagggaggtttccaggagggagtcctccaccctcatttgcttttagggccgtgcagcctcccgagcggcccccacgaggctctgaggctgcatgcaggttgagctcctggcctcactgcccctcctcagggttaggactgtgctggagcctgggtgggtgtggggtggtccctgcacaggcagcaggaggtgggccagagcggtgctggacctgaaggcccgtggctccctcagctccactgaggaggctggaatagtgtcctgggccaccttccctgccggtagccggctcctgctgagggagggggtgctttcgcctcctggtggagcatcaggctcttggggcctgtgcgtccgagcatctggcctctgctgtctgaaaacagcaccttccccgccccccggccaccgcatctcctctgaatagaaggcaagtcttgcctcccaggaatggcctgtgaccttcatcagcgggggaggttaggggcacacagagccctggggaacaaggggatctggggctgagccgggcctctcgggcccaccccgagctctcctgagcagcctggcaggcaggaaggcgctgggccccggggcctttgccgagcccagcctcaccctcagcgtccccctcaatgccctgggtgcctgccaggctgtggacacaggccctggccagttctataaataaccttgccgggccctgctgggaattggtgccaccaccacatagcccagagagaacggaaacacagggcttctcagcgagcagaccaggcctgcggtgaccagtggaagtgggggacgctttcagggctgggcagcccgacagggcaccgggcacagccaggggccggaaccagttgctcactggctccgcttctgggggactgtgtccctctgtgccccgtccccatcacaccttgctttcccttcatcctgctctcctagcccctccccagactggcggccccttgtccaggcccagccccagcacagcctgcagccctggcagagctcaggccttggccttctgaggttgccctgagggcagtgagcaatgagccctgggactggtgcactgggagggaaaggtgagccaaggcttcctgcaagaggcagccctgagctgggggtggggaaggctgggtcgtgggatacccctgacaccccaagttttttttttgagatggagtcttgctctgtcacccaggctggagtgcagtggtgagatctcgactctctgcaacctccgcctcccaggttcaagcgattctcctgcctcagcctcctgagtagctgggattacaggcgcccatcaccacgcccggctaatttttgtatttttagtagagacaaggtttcaccatgttggccaggctggtttcgaactcctgacctcaggtgatccacctcggcctcccatagtgtcgggattacaggcgtgagtcaccgcgcctggccccccagctgttttttatgctccatgcttgggcttcctgttaagaattaaaaaagaaaaaaaaaactatggagatggaatttacatactgtacaactcattcgttcacagtgtacaattcagtggcattaagtacattcacacggctgtgcaaccactacttctaattccagaacgttcggtcaccccaaaagcaagccccattcccattgtgtcactctccatcccctccaccagctcctggccactctgaatccacttcctggctctggattggcttgtcctggatattgcatagaaatgggatcctgtcggccgggcgcggtgactcacgagagcaagagatccagaccatcctggccaacatggtgaaaccccatctctactaaaaatacaaaaattagctgggcgtggttgcgggcacctgtagtcccagcgactcaggggctgagtcaggagaaatcgcttgaacccgggaggcagaggttgcagtgagctgagatcatgccattgcactctggcctggcgacagagtgagactccgtctccaaaaaaaaaaaaacaagaaatgggatcctgtcatcccagcgttttccgaggccgaggtgggcagatgacttgagcctagtagttcaaacgagaccagcctgggcagcacggtgaaactgtctctactaaaatacaaaaattagctgggcatggtagcacacgtctgtagtcccagctacttgcggggctgagatgggaggatcgcttgagcctgggaggtgcactccagcctgggcgacagggaaaccctgtctcaaaaaaaaaaaaaaaagtgcatcacacactgtgtgtcctttagtgtctcactgtgacatcctcaaggtgcagctaggctgtggctcgagtcagagcctcactggtttttgtggctgagtcttgttgagtgcgtggatgggctgtgctgatcctcgtctgtggaagggcccctgggtggttccacatctcggctgctgtgcgtcctgctgctgtgagcatctcgtgctccgtttctgcgtggcgtgtactgttcctcagggtgtgtacctgggagtggagctgctggctcacagggtaacagacctttggagaagctgcagacgcttccacgcccacccactgggtgtgaggaccttgctcctcgtcatttttgtttttgtttaattttttcttttatgagacagggtcttattctgttgtccaggctggagtgcagtagcacgatcacaggtaactacaggctcaagtgatcctcccacctgagcctcccgagtagctaggacttgaggcacgtacctccacacctggctaatttttgtatttttagtagagacagggtttcgccgtgttgctcaggctggtctcgaactcctgagctcaggtgatccacccgcctcggcctcctatagtgctgggagaaatgaagtgtctgcgacagggcggcagctgcagagggggctgtgctctctggcctgttgtgccccacccttgtgacaggcaggtgggcgtggccaactgggcggcagctgcagagggggcagtgacaggcgggtgggtgtggcaggaccccacaatgtctctttctgtggcgtctccttcttcgcctgccccttcctatgggccatccttccagctcacctgcggcccaccctccaaggagtgggaccctcggagttgggagcccttggctgcgtgggactgtactgtgtgacggagccatcaccagggctccaactcaccctggctcctgccacagtctgggctccatctgtgctaccattgcagtagtctggtttctaggaagcaaaactgttactgagttacaaagctcaattaagagtgtcctttgggaggccgaggcgggcggatcacaaggtcaggagatcgagaccatcctggccaacatggtgaaaccctgtctgtactaaaatacaaaaaaattagccggctgtggtgacacgtgcctgtagtcccagctactcgggaggctgaggcagggaaatcacttgaacctgggaggcagaggttgcagtgagctgagatcgggccaccgtgctccagcctagggacagagcaagactctgtctcagaaaaaaaaaaaagtgtcctaactgtgtcctccaaagccctcgccggccgatgacagactagagggcgctgtgctcccaccccctaccgccctgagcctggacgcgtggcccctgcagggccctttcccacagcactgtgaactcacagcttctctctagggaagggaggaggtacgccacttccacagggagatggggaggccgactccagggatccaggccatcatcctgacgttgggtcggctgatacacccctgtcctctctgtcccag

SEQ ID NO: 188 - DNA, 608 bp, Homo sapiens
  source 1..608: mol_type = genomic DNA
gtgggagcctcatccctctgcccgcagccccagggaggcggggcttttgtgcagaaatgtagggttgggggtgtcaggtggggggctattggccccgagaccccagcaggcattgagaggactgagtggagaggccgacctccccgcagggcctggtttgccaggtccctcagctccaccctgcttctgggccctgttcaccctccgaactcccaccccagagggcagtgctgccctgcgcctcccccagccccaccctcgggggctccctggcttgcagggtctgtcagggttgtcctgctgcacttcctacgcatggcagcaggtggcactggccgtccgtccatctgcccagtggccttgggagaacggaaccgccctggccgtccagcccagccctgtctccctgccagccgcgcacaggctgtccccggcatgtcccaggagtggagtggcctctgtcagggagaccgcctgtgcgcggggtcccccttaggagcgtccaggtatcacccagggcctgacaacagaggctgggcaggcggggacggttggtggggtctcaggcctgtgcccagctgacaggctcctcgccggcttctcctcag

SEQ ID NO: 189 - DNA, 3826 bp, Homo sapiens
  source 1..3826: mol_type = genomic DNA
gtggaaattacaatgtcatttatcttctccgtgtcccatccccatccatcccactgtctttcgtgcactcactacaccagccacctagccccatcaccatctgtctctcatagtctgctgtttgtccactggctgctcctggcagccccctagtgaccccatcttcatcccatcgtctgtgcctttgtcactcctggcagcgtcagcccaactcctgtgccttcccatccagtcttcccactcctctctgcatctcaggaccttctctaccagaaccttggtctttctgcccctagaccccacctagttccaagaacccctgccccttctttgctcactcctattcaagccacgttgttcagcttcctctgcgctcttgggccagagggctagaagctgccgttttctggaatagagcacagggcagtatgatctgtagtttctccaggccctggccggtaccctgaaaacttggggacccatcacctctgttctcttggctccctaattttcctgtctccttggcagctcctgcatagcttcctcttcctgactcttcagatcttgaaggccttccatcctgtaacctccctttgccctcagtatttaagtccagcctccctctggcctccctcccactctggccctcagaccttcccagctgcctgctgcccagcctctcttctcacaagccagcttctaggacctcccttctgcacccttaccccttgctttcccaaaattctgctcattttcctacccatactcctctttgctctgactgctaggctccccccgcctgccatccccccaccaaggctcctgaccccatgaccccactctctcccactgcagctcctcatcaggtaattctcctggttccgctttggccacgggcggaggacacagggggaggtgactccggaccactgcaggttggtcgtgaagcccactccctccaacacctccggagcctctcccctctcactgctgccctccacacccagagaacctccacagactccagccctccgacacctgcacagatccatctcccaagacaccacccaaagagagcatttgctgctgcttcccagaactgtccaacaataccttagcaacaccaagagttgggccctagatgggcccagcacattcacaggtcacacccacttccctgcaaaacccaccccctcccagcctcctcctgactctaagccctcctcttcctctacctctccagtgtatgtctgtcaccccccatttcaccagagcgtccttaggggctgggggtgggtttgttaatggggtggaggcaatgatgggttggaggatcttggctataggggctgtgctgactgcagcaggtaggttgggtttccctcttccttccctaatcttggttctctaccctcctttccactcctcacctgattctctctcttcctcctccttatatctgtgaggcagaaggcatctgaagctcatattagcccccattgggtgggaattaggagtgggtagttaactcagggagacttgagataccctggaaaaaatgctattgagatgtcctgacattaggcagggtggatggaacaagaaggagcaagaaaggaacctcaggcagatgttaggacatggacttgatcatgtggcctgggagtttagaaatggggagagacatcctcctagatcagatcgtgggctcagtaggcatgttgattcccagggagaggtgccaggaacagcatggtaaagaatgtactcttcacagctcacatccccaggttgctgatgccactcactccccctctcctgccatcgagtggccttgccggacacatcaccctacctaaaaagccagtaaatgagaacctgtcagctatagccatcatttctgagatgcgattttctttgggattgagctgcagtgggcagtggctccttacactgtaattttaattctctgcctgcccagcctctctgtcaaagtagctggtgatctataaagatgctaaaaggcaccaggggactttgccatttaaaggactcctgcagtgaattcttttgtaaaatgaataatggcaccctaatttatccactttctaaatttgggtccatgggggtgtccagggcatgcttatgtgctgtcaccagcagacaaacagagggaatggaatctgggggttccttccctgctctcccgccatactcaggataccctaccataagtgatttcctctcactgacttgcagaaaatgtgtgagatacccagcaagctaagaaggcagttttgctgggtatctcatacccaaggctggggtttgggtgatctgagaggttagctccttgatcctaggatggaagggagagcttatatagaagcttttacttggaaggttttgtatcctaaggtcagacatagctatattaccaagcctaaatgccatgtggcccaggaaataatttggacatttgttctaaaccacttgtggtaggtattggtctctctgcaactcagccattaattagaaattagttttgagcctgaattttaaaaagccaagtgttgcccccagcccacacacacacacacggacatgtacagtacaaaccccagataattacaacagccaaagagagaaggaagtgaatttcccaaccagaagcgtagggaaattcagatggctttcttttctcccagcagaggaacagaaggcggagctaagggcaggaaccaggagttggtcaaggagctataggaggtgatgagagtagaaccaggggtaggagctggtctggtacccctcaccctctaattgggagcccagggagaaggactgaaaagaagatgggagtggaaaagaataaagccagtttctgcttcccagggatgcagagattggggcatgctgtgtctgcagaagctcctagtcatttccgccataattgtgagagagaggggcagccctcccacaagatttttcccttcccatatcacttccctgaatccccttcctttccccccagtacagttaaacctctctctaatttggaatgttatatttgagaagatggccactgtgaataagtgacaaacggaatgacagtgtctatttaatgaaatgcatgtcttcaaaatatatacagaactcgatgaacaaggctttttccactcctcagggagcatgcattaatgaatagataggattcaaaagtctgttttctggtatgggttaaatatcccctcctacagacatatttccaccactaatttgcttagtacaccttttcttcacagataaaggaaaatgcaagctcagtttttcttcagattatgaagaaattccaaatccacaggggtttggattaatgaggttttgctgtactgcctccccttattcctcaacatgaagttcccacctcggattggggatgggtgggagggggtttcaagaggaggagggtgggatgggcaaggaatatacacaggtgaagccagagaagggttaggttgggggtgcggtgggaacttgctgttttgatctggtttcctggtgtgacactctgggttaaaggcttgaaggcccctgttaggagtctaggggtgagattctcttctctctgatcccagaggacgttaacttctactgcaggtgagaaacaaaataggaggatggtggggactgtcctgggaggagggggtggtccatggcttgtggtgtgggctggctataggggaggccactgctaggggactggcatccaggcccccttgaagcgtctcaataagtccgcgctctcctttttggtgtcttgcag

SEQ ID NO: 190 - DNA, 1465 bp, Homo sapiens; identical to SEQ ID NO: 130
  source 1..1465: mol_type = genomic DNA

SEQ ID NO: 191 - DNA, 3268 bp, Homo sapiens
  source 1..3268: mol_type = genomic DNA
gtaagatcacaacattgataaatctgtttccaaacctggaaacagtcccttggtgctaacgtttatatgtatgtaatttttattgtgatgttaaatcaatggagagtttcatattattcacataacagcaggccaggccacagtattgagttcataatgagatgaaatgacagtaagtatagattagttttggactttagaagtagactttgtatttttctgggttttagaaataatatacaattacaacatggaaaagatgaaattattaatgttataaaaattcaatttgtttttactcacaactagagtattgctttgtcatatgtctcatagttatacatgttaggtttaaaagtagaaaaaaagtcctatttttaaaaaccctcccattgatggatgctattgctgtagtatcaaaatctgtcaggcctttaacatttgggagtagtacgtagctctaataattatttcagagtttgtgcagtatcaatatcagctcatacttatatgcaatgtccttgtttaagacagtctacataatgcatcaaacacagtgcctaccagtagtgagtagtcatttattatataaacatactgcctgttgagagaagttttctgtgtatttactgaatgtatggaaagcatgaatttgatactgattcatataagccatctcttctgattgccacgaaaaggctataaaagccctgtgtgaaagggtaagaggtgaaggttcagagaggttcagcaacttgcccaaggtggcacagccacattgtggtaaaagtaggatttgaacccagcttagctccactctaaagtccatagtcttttcactgctctttgctggtttcagtatagtataaaaataaacaattgatattgaataatatatgaaccaggaatcttggaatatttactttgtagaatttattttcctcttaatctagcctgagaatgttaagaaatcagctctaatggtgttttcccataatgttattatttaaattaacaatgtcagtggaatccacaaatagacatcaccacctagctgctacctgcaaaaagaggaagaaaaatcagtactttaatgtctgtcttggttgagaatatatgttttattttaatatgttttatgccatgactatcgttaaaattattcttctgatcatatcaatattaccttttgtgccaccaatgctttattttgatgtgcttcagaaagagtaaaatagaaagtacaatttttaataaatggcttgaaatattttgaggaaaattgatcaaaggtagttgacattgggttttttgttatcactgtgtgttaaatctgtaaatgataatctagtaatttggctaatatttattgttttttaatttagtttaatatacttcagtttgttaaaaatatgatgtaaaaataactggtaataactaggtacatatagagttaagtttgatgaatgagaaatatgtaccaattttccagtttacaatatttaccaagatttatagtttgcgtcttcattgcaaaacaaatggtcactttagcttaattcagtaaacagcagctcatatgggattacctggtctatctgttgcagattcaactttcagaggttaatacgaactgtttaggggagaataacattcataaaaactgaagtttcctgttaattggaacgacttccagttcacaggaagactcactcactcagtccttgtttcatggtctcagcatggtgtctagtgtcagtggtaggaatagtaatagtacttcttcacatttgtgtggcacatcacagtctgataaagcactttcacctagtgtcatttggattcagcacagagggcagcatgtggctatggcgtgtgttaactgcagccttgtcatcctggcagcgagcgtacttgtactttaaaattcagaaagctaaaattgttagggagatttcaaatagttttggaactataggaaaaagtgtcttagaaaactcgggggagtttttggagaagttgatgtactcatctgaattaacctaattttaacgtgaatcccaaacatgggaatgtgtacctatccaggtttatagtcattcagaatttacttaacactcagaaagtttgagtttgactttctggtgtggggaagtctcagttatcttttatagcagtaccttgtttatcctgatattctttaagctaatgtttcataagaagttagacatctttcttctttcatgtgtaattatttcagggtttcaggacttaagattcttgaaagtatgggtgtattccatagataatctattttatttcaattattttgtaaaactttcaactctcatttggatctttgaagatttagaaatgtaagcaagtctgaaacaatatacaaagaataagtataaactcaatgaaaatacacttatccaagcaatattgcaatataaaatatatgcttcaagtggtgtaaaagtgtttgcacttagaaaatatatttaaactgtttgtcctcataaatttatgtcttcggccttcatatttatctcccaggagtgtcggttttatttgtattttaataagaaaattataataaaaacttggggtttcattttaggtgaggtttttgtatttgggtttgtttttctacagtagagtttaatccatgtgttgcttttcttcaagtatagtttaaaggagtacatttggaacgtgtttttggaaaaagcatgttaatgtagcagaagagacttcagtgcacactttcgaagaaaaacagtttctgagcattaagtggtaaaaggcaataataattcaaatgatgataacaagccaacctgctaaaaagaatgcatgttctgtgtatccagccatttcacatgaactaaccccatttaaaagaatacattttccattcactgtgcacatatgtgtaatcatttttgactaaaatcaattgccattatcatgccaactaaatctgcagtagaatatattagttgccagatacagtacaaaaaatatcatttaagagtaatcgtgattgaatcccagaaatgaatagatgcaatttgtaacaattagttataatgccaagaaacactccagagagtaaagttaatgttaatttttatatgtagtaactctaaattgctatggtaaagcctataatatggtagcaatatggggcgttttatgctaaaatacacgcaaacattagagacgagcctaactgcttttcttactttcctgaatatggtag

SEQ ID NO: 192 - DNA, 362847 bp, Homo sapiens
  source 1..362847: mol_type = genomic DNA
attgggcaccgcccacttcgtgggcttccaggtgcgagccctcgcgccgggcccatctccccaaggggccgcggcggactggaggagacgcccggggcctggcggcgcgcgcgtccgcggccagggcgggtgggcggatgcgccgaggaagcggctgggcgaggagcctccgctcccgggcctcgggtgcccgccaagggccacgcgggcgagggggaaacccagaacttcccgcccgggagcgactgcccccgctcccggctctggctggctagggggatgttctcgcgagaggagagggggcgcggggcaccgctggtttgggggcgcggggaagcctgaggacgagggccgggcagggaggggagcagaggcggcgggcagggccggggacgcggggaagccgctcccgccagtcgccgagagccagcccctgacgtcaggagttttcctcaaagtcaacaacaagccccgcggcgacggcgagaaccgatcggcggcggccccgagcgggaggaaggagggggcggggaggcggcggggggtcccctcagcgaggcgcagcccgggaggaggccgcagaacccctccccgcgccgggcgcgccccggggcccagagccgccgccccgccggcgtgacccggcccccgcccgagcggtgttttctggtgatgaatttgtagccgatatccgattcccatgtagagtctccgcctcctcctctccccgccgccgccctctctcctccctccccctcccgccgccgccgccgccgccgccgcctcccgctccagctccgcggcccggcccggccggctccctccctccctcccctgcagcccttcgcttgccctcccgccggccgcaccgggctccaggaggccagaggctctgtggggtggggggaggacaggaggggaggaggagggaggggggacccccgagtcgccccctctcctccccccgcccccccccggctccatcctccgccgccgcccgagcagctgcggggccgccaccgccgccgccgccgttgcaggtaacagccaccgcccccaactctagccccctccccgcctggcctccactccctccgggccccgggccccggtccgccctccctgcctccctcaggcgggggatggcggcggggtggggtgaggcgggggcttctgggttgtcaccgcgccgggggcgtgggcgggggctgggtcaccggaggcttcgggtgtgggtgtggaggccgggggatgcccagcgcggttgacaccgacaccccccgctttccggggaaagctggggggcggcggtgcgcagcgggccgggggaggggtgttcccggcctagcggtaccgtctgtgtctgggctgccccggcccggcgcctgctgtctgcgcaactctcgctccttcccctcgcccctccccgcccgggccgcgcggcgtggggagggggcgcccgcctggaccgggggcggcggcgaggttatataacgcgtggagcgccggtgtcagtgtgtttgggttggggggagggagccgtctgccgcgcgccctggcgctgaggctgtctgcgcgtggggtggggtgaaggcgaggatgcacaggcgtccccggggtctccttccttcccccacccttccccgccactggcgcgcaggaaaagacggcactggtggggtgggggggggggtgtgtgtgtgggaggtgggtaacgtgcttgtctgtgtttttaatagtagtggggttttgatccgcttgggagttgtgtgctaagaatagaaatgtgcggaagatgctgggtttggctgatccagtgatgctgtcgctgctggcggcggcggcagctctggctgcaagtaaacagaccagcctcttccttgtccacctcctccggcgcatcggtccgcatcagccatgatgccggtggggcccttcagagcccaaagttgaagcctagctggttgctgtgttgaccctgacgccgaggcggggtcaccatcccttgtttgggatttcccgggaatctacagttagcctagagataaagaatctcgttggggccaggtttttccaataccggtatttactgtttatgttctgaaagcagaggaaatgcttacccacaagtcaaagctgggatgctcacatttcttccatcaaaataatgttgttatgaaaataaaaccaactcatttcaccaatgtggcattttggttgaaagcctggtagtttgcaattgatgaagtttccaaatagaaagtcaacagtgaaacctatgcatctatattgggtaatttctagccataataaagtgttcacactttgattttagttgaggctaaagtaaaaaataatggctttttgtagttaatacattggcagttgtctcaacagtttagacatgtgttccgtatttggtaaagcatggtcatatatgtcttttagtagaactatacatcactaggcaaccactgggttttgtcagtggttgaagctgacaaatgagtgaaactcattggtttaggttatgtatttacttaggaaaacgaaggtggaagagtctaataaagatggtgtaggaaatgaagattagtcttcagaacttgagtatcacttgcaaaatatgtataaacgaatacaaacattccgggggtggttgtctaaaacatgaaaatattttataattaaaatagcaacttattactaagttactagttttccaaggtttatgacttaatgcacaattatatgcaagatatatatccggactgtaattgttttccttttgccagtacattatcttgacttggaaagtttaccaaggagatagtacttgaaagtttacagggagatggtacttgaagatctttttgttttccttactagggttgaccccaatatctttgattggcttgaggttccagttttaaagtgagggaggacaaatattacatgaatgagactgttgaaatttagatgaatgtagggttttagttttcagttgtgtatttgcattgtggttttgcagcatgttttcttacagcgttttaaaaatagtccaaagtaatcctgcaaaaattgtgaaattattatttgtattcatttggttttctttccataattattactggagtgaattgttttccaatttaaaattaatttttggcttaataatcttgacatcgactctaaattgtatatgtcagagtactttaaggttttgctttggactttttaaaaattaatttcatagctgtaaaatattttaaataagattatatttaacaaatactggagtgtgaactgtgtgctggtttaattaaaaacttttaatatttacatttcattcagaaaatcactgtcagaaggaatctgttttcagaatcactgcaaatctaaataaacgtgttgattaaacttactagggaacaaatggacttagcatagagacttgtggaaagtaaggacttattttttaagctgtagcttttgatgtaaacatcagaaattttctcataaaaattcagtggaaatttccagctatctgggtttctttaaaatgaggaacctgttttacaaattgattttgtagaagtttagcctttacttaaactttgtgtattttcgtgaaaagatagctatgttttcttttgttattatatcttttagttcaagaatttgtccttgggaaggtaaggcaatcactgttaacaacttgttagttggatgcttagcatgatttgataggagcttgtctttatagtgtgattaagttttgaagtgttaaaaagaaaaatttaaaactatcttagatttgagcaacaaaatgcaagaactgaaaaaccattttcattttgagcaaatcagtcttgtgatctgactggcatttttatttttaagttaatatgcattaataatacaattaatttttgttagaagatttgtgttactccaggtttcagcatgtgcatcagtattttaaatcctggtcacacagcataccttcttttggaaagatagtcctgaatcttccgacaacaaatactttgtcctgatcttttacatgggataggattagattcagtttagagttaatgctaaccaatgcctggtaagcagttgccatgtgccaggcactgttctatgtgctttacctgtattcatttaatctttcaaacaacccctgctacacttttgaaagtgattttcacataagaaaaacttattgtggcattctaaaaataccttttatttaaactttcctaattctgcaacacttctagtgtttttcttgtttgtacctattattacagttaacagtgataattctaaatttgcaaaatttggtacaataatttccatagcatcaagttaataaaagtgtattgactggcccattaacatcacctttcatttgtttaaaatgccaaattaaataactcaaatgtttacagattttattatagcatcatagtctttaatcaaattagatgtaaactcattttctctgccaagtaatctttgaatactaatgggtagataaaattaatatatgcttcttgacttgttgatgtgttttttagttctgtttcttttcagtactctatcaccaactacaggtatttctcatttctaaatattatgagaggaaagtaaaaagatttactagaagaaaacactagaattgcaaatgataatttttcttccctatattagataattcctatatatatatggatggatttaaaaaaatttataattagggagattcccaagacagattttaggaggattttacatgtatattggaatctatattagaaagcttctgactgtatttgggggactaggggatgggaggggaaggaggacagtatttttccaataatggagcttagcccaaattttgtcttagttgaaatgctgtttgaatgttttatcttccaattatcaaacttttgaggacatgaactatgtatgtataatcatgtctttcacttatgatgccatctatatatgaagtagatactccgtagattttaacttgcagaatcataaatattagctctggaagagctataaagctattcagagttcatctaatgctatactttcatttttatggctccggaaactgaggcacagataattaaagtgaccttatacagcatcactctgggtggggcagggactcaagtttcttggtctttctggtgctcttcctaatacaccattgtgatgaaccttgttagaggattccatacctattgggtagctcagtttaatctgggggtaaattctgtcaagctgattcttggtatttaatggaccatatatcaattgcattttatatgtatgtatggatttttaaaaatttatgatgaggctcccaagacagattttaaaatgattttacatgcatattacaaaaatatggccaactgtgcaaccaaattctttttcttttcttttctttttttttttttttgagacaggttctcactgtagcacccaggcacggtcaccactcagcatagcctagacttcctgggctcaggtgatcctcccacctcagcctcctgagtagctgggactacaggtgcctgccaccactcccagctaatttttgtattttttgtggagatgggttttgccatgttgcccaggctggccttgaactcctggacataagtgatcctcctgccctggcctcccaaagtgctgggattacaaactaatatccctttttgacactctacagcaacagactcatggtgattttgaggagtctcagccttacctataggttctgcctgtgacctcataatacatgaggctggtggtcttgcattcagctacatagcttttgtcaggctatttagtcaggctgtctagagaatgtttagtcttgattcctgactgttaaatggttaagctccacacttaatttgcattgaagaatgacctgtagtctaatttagcgctaggttgggagtctaacactgaacttaactgctatgtatcatttatcacaaaccaagttgagagagtatgtttgtgtagtccatctatccatttttctagttatctaaaatttatgatatgattcttgaccacataacactggtgtacctggaccacattttttggtccccttctgtgcaaatggatttactaattttatgttggcattttcctttttagtttgagagtgacaataagcaatgaccctgtaaaactcattgctgtatatgggagggtgtttttgaggactttcccgcatacatcttatgaagaagacccatgggataaattcgatgtttgtcccaggaaaagttgtatttcttctgaggaactttttttgctttttaaaaaaatttgtgcagcgtggacaatatagcgggaccccatctccacaaaaattttttttaaaaattagctaggcatggtgatgcctgcctgtagtccagctcctcaggaggctgaggtgggaggattgcttgacccccattggaggctgcagtgagctatgattgtgccactctactctagcctggatgatggggggaaaccccatctcaaaaaaaaattttttttggatactgtaaataggaaagcctgttgtgttttgttatttgcattgtcttcccaagagctccatgccaaatttgtgacgtatctttcccaagtatgtatgcctttactctgacttctttttatcttaaggcagtatagttttggaatgcaggctctggagtcagacagcctgggttcagatcttggctccacatttactaggtgtgttgaaattgagcaagttggtttatctgtgtgagcctcagtttccttgtctgtgaaatggaattaatagtatcctcataaggttataaagatcacataagaataatagatgtaagtacccgtaacagttcttggcacatcttgagtactaaatatttttttctactttcatattccctttgtttcactttactttataataagtacataatatgaaatcaattattttttaatctccttaaaatatttcttggaacaggcagagtaagaatacgtaaatgatgagttcttggtacgttgtattttatatcacttaaagtattcacgactggttgtggtggctcacttctgtaatcccagcactttgggaggctgaggcgggtggatcatgaggtcaggagtttgagaccagcctggccaatatggtgaaaccccgtttctactaaaaatacaaaaattagcagggcgtggtggcgcacacctgtagtcccagctgcttgggaggctgaggcagaagaatcgcttgaacctgggaggtggaggttgcagtgagcagagatcgcgccactgtactccagcctggcgacagagtgagattccgtttcaaaaaaaaaaaaaacaaaaaatttacaattgcttctgaaattacagggatttagggcaattaactttcattctcttccctcttcacctcaaatacacatcaccaaacaaattttctctattatttgggtaggcgtgactggttttcttaagacttttttgttgcaacctcttaggttaaaagtttcactatcatttgaaattggtcacaagactagggaagtgctttcattatagaactatttaataaataagttccccagtttgaagagccagacttttatgtgaggtcaggccagttgaagacatttacaaagaattagttgtttgttattgctctgtgagttgcaagaatggaaaaaaaattctttcttcaatacttccttccaggctgagtcatcactagagagtgggaagggcagcagcagcagagaatccaaaccctaaagctgatatcacaaagtaccatttctccaagttgggggctcagaggggagtcatcatgagcgatgttaccattgtgaaagaaggttgggttcagaagaggggtaagtgctccgcaaaccaaaaataatacggttggtaagagtgctagcagtgagtggtgtcttagaagttgatcttttttctgatactgttaaactgtgtcatgctatgtctagtaagagagaaatgatatatttaacgtgtgttaggaatttgcttgttattaagggatttttttgtaattcttgattttgagcatttataatctagttaagttaggtttgactttctggtatgttgtgtgtagcgtgttacagaaagtgttgtatttttctgtggtgtctacaggttctgtaatctggagagatatctttagaatcatttaatatatgtaaaagtacgatcctatatgcatttaatcacatgtaaatatataaataagagaattaagccagtttgaatggttgtaggggaatggcttaaagtagaaaaggggaaagggttcacccgcaaactcatggattaatcccataaatttggtaagtaaagtcctgacgtaaaaggccaaatgaggacaaggattttttgtgtgtgtatgtttatgtttaatttcgtatttttatttttcatcatctaggtttaatacaccttgttcactcctactttagataaataacttaagcacattattattttttattattaaaggaagaacccttcgatgtaaagcggtttatcatctgtgagatcacctgcttatgtggtcaatatatttattagaaatttagagtttagattagttgctaggcaactactgtttacccacatggccacgtcgagtaggatgaggactgttccattctcagaaccttttagttcctgtatatctactttatggttacaagttccctcctaatattgattttaatattttttgaaggtctgtagtaaatacctatcctgaaaagctgttgtcatagttaaatgtgattatggattattttttaaatgagccttattaagtcgtaacttacataataaaattaagcaatgtaaagtcataatttgatgagttttgccagagatacacagtagtgtaacaaacactctgaaaacgatatagtggttattttcattaacccgagaggttcctttgttctcccttgcagcccagtcctcatcccttaaccctggcaaccactttatctgctgttactataattttgcttttctagaatttcatataaatggaatcatgcagtacatagtttttttatggctgatttcttttacatagcataatactgttaatattcatccatgtcttgtatatcattagctttttttttatggttgagtagtagttcatggtctggatatatcacagtttatctgttaatcacttgttggacatttgggctgcttctagcttttggttagtacgaataaagagtctggacattagagtgcatgtctttgtgtaatgtgttttcatttgtcttgggtaataacttaggaatgatattgctgggtcatatggtaagtgtgtgtttaactttataagaagtatatgtttaacaaactgcccagctgttttccgatgtgcctgaccatttgtattgtcaagtgtaatttctttcaatgtcattctcctgttataaattacgaaagcattttcagatttcagtgctttataaaggcttttttgatttactttttaaacgtatttatattattctactttttttggagggggatggcaaatcacttgaacctttttgagttttactttactaatctctaaaatctgctttcacaagatggttttgagggttaaatgagatgatggttgtggatttattttgacagttctaacacaatgtaagctgttgctatctccacatatttatcaaaggtttaggatgattctttagtctgtttaattaattatatctttgaaataccataatagaaagtatttagtccatggactatagaaaaaaaaatgaataagaatttgccatcatttttctaataatgtgtatgtgtttattttgagatgtgtatgtgtatgtgtttctaataatgtgtatgtgcttattttgagatgaatagttgcataaacataaaaatttgaataacacacaaaggtataaaatgaaaaataaaaatctccctatcttttctacctcctttgtcagagataatcattttagaactttttttcctatttttaattgtctcatcattatgccagttttttatataatatactaaactttaaccttcagtaacctaatatctccccattgtgaaaaatagaaggatttaacttttaatactgatcctaccttcttccttttattttttggttgcctttatgattaaacttatagctgtttaacagttaactttagagtgttcagacattgtctctaaacttgccactttataagttgtaaaaaaaaaaaattagcttttctcctcatctttcccttgaattcctcacattccctttccagtttttcaactgtaacatttattttatatgtcaaggtttataatagttatacttgctgattctgaaaagcagttaaaatattacattatataaataatatgactaaacaaagtggtatgatgagattcttagagagcaaatggatttattttattttactttaagttctgggatacatgtgcagaacgtgcaggtttgttacataggtatacatgtgccatggtggtttgctgcacctgtcaacctgtcacctaggttttaagccccccatgcattaggtcctcatgctctcccttaccttgccccccacccccagcaggccctggtgtgtgatgttcccctccttgtgtccgtgtgttctcattggagaacaaatggatttcttacgctctctttgtactccagagctgccatactttaatttggtttctagtttggactgtggctatttttcctggattttctttatttttattttattttattttattttttgagacggagtctcgttctgtcacccaggctggaatgcagtggcatgatctcggctcactgcaacctccgcctcccgtgttcaagtgattcccctgcctcagcctcccgagtagctgggatgccaccatgccaggctaattttttgtattttcagtagagacgagatttcaccgtgttagccaggttggtgtcgatctcctgacttcgtgatctgcctgccttggcctcccaaagtgctgggattacaggcgtgagccaccgcacccggaccttttcctgtattttctgttttttttttttttttgagatggagtcatgttctccgtctcatcaacaacaacaacaaaaaattgatataataaagttataatatagttattactttgaatattagtcttttttcgtaagactatatgcatcaattgttgttatctccagatataatctgatttgtacttttaatgtgagtaagttgcttttcagtaaatatcttcttggaaaataaaaaaagggctgaaagataaatattcattattacgtaggataaatgctttcctaaccttggttattagtgatatattaatagtgatatcctattttttacacttttctggacagttgaaaatgataagtattaattgagataacacattaccatagtattgttggtgttagaaatggcaataaaagaaacatcacggagcaaacatcaagtaaagtattgtctgcgttttcctccttgatggatccaggacagctccttacaacttggttgcacatcagcataggaggcatctctgtatatattaaatacttactaaatgatcttactcaaagacgagcctgtaggtatgttctaggtgactctaaatctctaaattggatttcagcacttctcttaattttttcccttatagctagtggtaatatttgctatgaaggtacttagtgtattaataaagtaggaaatttagccagtttaaaaggtctaaattatagaattaaataaattgcaatagtattaattaagggcttattataatttattaactttcatttgcttaataaaatttcataaaaacctaagtagtcttttataaatgtggaaagctagttccttgataataagttaaaatataatgtataactagtcaattcataatgttactgttttgagattgtcataaatctaagaggtgatttttatcattaaaagcattttgatgaaaatgttccatgctcgtgttactttattctactttttgtattagtatctaacaaactgaactttcatgttgtattctctatgtgtaaccagttttggctttcaaataactttttcccttagttttctttgtactgactttgtcctttgaataatatttttcttatattccatgaaatggtttatttagatgaactacagtgtcggtatttggtaatgccaggataaagattttgtgtctatgagttgtctcacaagatagcttaattctgctgagcaaaatatactttagcaacataaagattgtgaacttggttatgctgtaagatgtgattcttgttatctagtcaaatttaacaagttgttacagaaaacaatttacatttttgagtgtttatctaagtccaggggtcttttcttctcctttattttgtgcatgcatgtgtttttttttgttcattttttattcacaaaatgactttagaaataagttataaaatgattaggagaaagaaaatgacagtatgatttcctgtttactacccagcagcaagctttttccatagagagtaaagagctgtggtagtgactgtgtaaaccacatggtacattagagaagctcactttgactgttgaggttatacatggagagtaaacataagaaaattaaatttattttctaatggtattgaaactctgagatttaactaatgtatttacaatactgtgaaattagcttttcttagagtttcaatgtattatttttgaaagtttcaaccaatagaaccacatggagcaaaccatcaaataagctttcatatacattttgaagttatttatagaattgtaaagttgctgttacacacacacttgctccttctcaatcaacaatcaagttttatgtattgattttgtaagttgaagtctcatgaaattcacttattaatgttagtttaaagattttctacatagatggtcaagttatctgcgaacatccacagttctgctttttcctttccaatctttatgcctctgatttctttttctgatcatatttcactggataggacctccagtacattgttgaataaaagtggtaagagtggatattttgctttattgctcatcttattgggaaagcatttattttaccacttaagtatcacattagctgttccttttctgttgctgccctttatcaggttgaaaaaattccctactattcctagttcggagagtttttatcatgagtggtggtcagttttttctaaagattttactgcttctattgaaatggtcatttgattttttccttttattctcttaatatggtgaattactttcattgctggaataaattccatttggtcatggtgtatttaaaaaaatatattaccaatttggacttactgatattttgctaagggttttttgcatttacaagagtattgatctgtaaatttcttttcagttttgatacagtggttatgctggattcataaaataggttgggaagcacttgtttctcataaggtggattgtattttttcttcagtgtttgacaaaatgtatcagtgaagccatgtgggttggagctttctttgtgggaagatttttgatgataaatgagatttctttagatacaaggctatccatattttctatttcctcttgtgtcatttttggtaaattgtattttttaaggatttccttttcatccaagatgttcgtctaagttactgggtgcaaagtttttaatattcccttatccttatttttatttttttagtagagccaagatttgctccattgcccaggctgaccttgacgtcctgggcacaagtgatcctcccaccttggcctccccgagtgctgggattacaggctcccttatcttttgaatgtctgtaagatcttagcgatatctccttattaaatcctgatattggtaaattatatacttgctctcttttttcctttgataatcttgctaggagtttattcattttatgaaatcttttttttttttttttttgagatggagtctcgctctgtcaccaagctggagtgcagtggcgcagtctcagctcactgcaacctccgcctcctggattcaagttgattctcctgcctcagcctcctgagtagctgggatttacagtcatgtgccaccatgcctggctaattttctacttttagtagagacagggtttctccattttggtcaggctggtcttgaattcctgacctcaggtgatccacccgccttggccttccaaagtgctgggattacaggcctgagccactgcacccagccaactttttaatgattttttaaatgatccattatgtggtcttatcatttggtctgtctgtattttattttttgggggtatagtgttataaatatctagtcaagatgattggtaatgggtcatagtcttctatgtcttcactgactcgttttttttttttcctctagttctgtgactcagtgttatagtctccagctatgattgtgaatttatctgtttctctctttagtcctacctttttaattttatatattttgaagctctattattagaggcttttttgttgttatatcttcttgatgtattgcttcttttatccttatgaaatgttcacctttttctcaagtgacactctttatcttggaattcagtttgtgtgatattaatatagtaactcctgattttttatgattagtgtttgcatcttgtatcttttcaactgtcctattatatttagtctttgttttgtatttaaactgtttctctcgttgacagcatatgtttgggtcgtgtcttttttaaaaaatctaatttgacaatctttaccttttaaatgggagtttttaggccagtcatatttaatgtaattattgatatgattgagttttctgtttgtgtcatgtgttctttgtatcttttccctatttttttgcctttgttaggatttagtatcttttcagtatcctattttatctctcctattggcttgttatttatgtgtcttattttaaagcaatttaaaaatttatagttaatgttattgttggtgtggttgaacttaggcatactgttatttttttaaaaaaatacctctcttcatactttcttatcttcttttgagttaattgaatttttttcagtatattccactaacagtatgcattctcaacaggagtggtaattctcctatagggcaatcataggttcttggaaaagggtacagaatatccttttatattacaattgtttgtggctctccaatcacattatataaacagatatatctttggtattaaaatttcttggtggggaccgaagtgatttagagggagttttctaaagaggctccttaggtgagccaaggaaaaacctttgataaacagttctgtcatcattttagcttgcattgcttttttaggtattgttctaaggtagtggaatacagaatacatgtacaggtttgttatatggataaataacatgttgtaggggtttggtatacagattatttcgtcattcaggtaataaacatagtaccctataggtagttttaagatcctcactttctcccactctccaccctcaaaatacatcctcagtgtatactctctaaagtacaaccagggtgattttggtccccagaggacatttggcaatgtctggagacatgtttgaaatgatgtgggggtgggattgctactggcatctagtgggtagaggccagatatgctgctgaatgttctataatggacggaatagtatcccatggcaaaaaaatttccagttcaaaatgttagtagtgctgaggttgaggaactctattcttgagattacaatattcattcttaatttattacagtctatgtagggttagtattttactgctccatataaaatataagactcttccaatgctatatttatatttgcccccacttctgagagtgccttgtgctgttgttctcctgtatagtatatcaccatgttataaactctgttataatgttatatattttttgccttattcatacgtcttttgaaaaagagcaggaaaagtatggtcatttacacttatatacctattttcagttaaaaaatttttttcctatagatttcattttctgtctgatattttttttcacctgaagaacttttccttagcttttttttttaaacttttagtttccagaatacattattggttagatgttatatgggtaaattgcgtgttgagggggtttggtatacagattatttcgtcatccgggtaataagcatagtaccctataggtagttttaagatcctcacctttctcccaccctccaccctcaaaatacactctcagtgtatactctctaaagtacagtgtgtactcaaatgtgtactcaatgtgtacacaaagtacaccctcagcgtgttcttgaaacatcgagtatacattgtccatgtgtactcagtgtttacctcccatttacacgtgagaacatgtaatatttggttttctactccttcattagtttacttaggtaataccctccagctccatccatgttgctgcaaaggacatgatctcattctttttttatggctgcataatattccatggtgtgtatgtaccacattttcgtctgctgttgatgagcatttaggttgattctgtgtcttttctgttgtcagtagtgctgtgatgaacatatgtgtacatgtgtctttatgatacatgtatgatttatattcctttggtcatattttcaataatggaattgctgggtctaatggtagttctgttttaagttctttgagaaattgctgaactgctttccacagcggctgaactaatttacattcccaccagctatcaaattagaatcctgtacaatttaaaaaatccttcaaaatgaagatgagcccagccacagtggctcaaattagaatccaaactatcaaattagaatcctatatacagttttaaaaatcgtatatgtggccggctaatttttaaattatttttttatagagatggagtctcaatatgttgtccaggctggtctcaaactcctggcctcaagcgatcctcccaccttttcctcccaaagtgctaggattgcaggtgtgagccactgtggctgggctcatcttcatttttgaaggattttttaaattgtatataggattctaatttgataattgtggtttttttatcattttaaatatgtcatttcattttcttctggctgccatggtttctgatgaaaagtcacctgttgttattttgacttgctgtttccttatatagtcatgtgccattgatatggttaggcttcgtgtccctacccaaatctcatcttaaaaattgtaatccctacgtgtcaagggagagaccaggcggaggtaattgaatcacgggggcagtttcccccatgctgttctcgtgttatcgagttctcatgagatctgatggttttataaggggttcttcccctttaactcggccttcctgccgccctgtgaagaaggtgccttcttccccctcaccttatgccatgattgtaagtttcctgaagcctccctagccatgctgaactatgagtcaattaaacttctttcctttgttaattacccagtctctggcaggttttttttgtttgtttgttttttgatatggagtcttgctctatcacccaggctgaagtgcagtggtgtgatcttggctcactgccacctttgcctttcaggtacaaacaattctcctgcctcagcctctgggactataggtgtgtgccactgtgcctggctaatttttgtattttcattaagcgacggggtttcaccatgttggccaggctggtctcgaactcctgacctcaggtgatccagccatctcagcctcccaaagtgctggatttacaggtgtgagccactgcgcccggcctcaggcagttctttatagcagtatgaaaatggacaaatacagccatataatgatgttttggtccataacagattgctaatgatggtggtcccataagattataataccatatttttactgtaccttttctatgtttagatatgtttagatacactaatacttaacatgtttcaattgcctacagtattcagtacagtaacgtgctgtactgagatctccctctcactttccagctattttggcagctctgaactctgtctcttcaaactagtaagactttctgagttctagccattccactctagtttcaaggaatgggagagcgccttgagtaaaaagccacatcagtgcgaatctcatttgtagctcccttctttacagtcagtttccttcaatttctgcctgcttttgcagcttttctactgccttcaaattgtcattctttatattttatacagagtttataattttatatatagaagggttagtctgatacaagttactatactactactggaagtgaaattttgctaggtatgtgttttaatgtatagatacacaaatttatttaagcttcatgattcacatactgctgtattccaatttaattcttaaattatgaggagaagaagtttgtgagaagtaggagtacagtttataaaaatttatcagaaattatgagtactacaagttatgaggtgtatgaaactaatagtttaaaccgagtttgaatcacttatctagaaagatagctttttcttaagctcatatgtagaatttcaacctagaagtgactttaaaagttatctagtcttttttttttttttttttttttttttttttttttttttttttttagttttagggatgagtctttttatgttgctcaggctgatctccaactcctggccttcaggagtcctcatgcctcggcctcccaaaatgttgggattacaggcaggagccactgttggtggcctctctagtcttatatccattcatctgacagatttcaaaactgaggccatatttcaagttaggtatagagccaggattagtacctgagatttcttttttgctgatcttagatacttcagattttgtttctttcttgacgtttaggaatagattgaatttcttcaaaaaatattttgtatcttgttgggggggaggggctcagaagttttgggtggaaagatttaaaatcctctgagtatggaaaagggggagtatcttccaccttgtggaatcctcacactgtgtgagtaatattattcactgctctacttcccagtggagaatgcagagaagctgtacctcttgaacttgtgttttctctctttgagtaactgtttccatagtttctataccctttgacatagagaaactttctttagtttgtgttcgcattttataatcaatcacattaccttttgatgtgtgatagccctgcacctaccactaattttctgtgtttttggttatgctagtttttcggcttggcatgttttttcccctctgtctttttaagtgaaaaatctcctgtgtccttcaaagccaaattatttacccagatcatggtcttacaaaattagaatgatttcttttgtctgtataatattgcaacaatttcctgtcttgacctccttatgactttctattgccttgttattacatagatctgttatttctcctttccattgtaacctccttgacagcactgtgtctaatacaactttatattttgtacagtttgtaattttccttctgaaatacagttcaccattattttgagcacggtagtctcttaatcagtatgtgatacaaaaatggggaagaaaataatgattctagaagttcagataacagtatgtcacagatattagggcaaggaactagaactgggacagctgaggcaaggtaggaaacacagactagatcacagttatgaaagcagcctaatgttcaggagagagtttcggtaagggcagcactggaattctagaaccatgttgtatatctgtcaaatttttgtgtagcaaaacagaactgacagggtaggaattggtagatttgactgaatggttattcctgacaaagatagtgggttgtaccctgattgtcccagaatggactagtaaataaggtatctaaattaggtaagtagaataaaagattgggaatattgtagtttttatggtttggaagattaatgcgtattttaagggtaatttttgctttactcttagaacggtaaagtacctctgatttcatgaaacctaactttctaagcctataagaagaatcttttctactgtgtttctaatggatcacttatcttagatattgtgggcaactaaagttgcactgtatctgtttcattatttaacagctctgagcactggtggtctttgtttgccctcctgagcaatataaaacaagttctgttttccagtttataggccttcggatttttcgagattgctatcctgtcttccctaaaatccctctttctaagcaaagtgctctcaattctttattatgtttataattattataagacacggtttgcagccctctcatacacggtacagttgtcccccagtatccacggggggttggttccaggacttcctggagatagcaaaatctgctgatgctcaaatcccttacataaaatggtgtagtatttgcatacaacctgcacacaccctcctgtatgctttaaatcatctttaaattacttacattacctaatccactgcaaatgccatgtaaagattctatgtaagtggttgttacactgtcctgtttagggaataatgacaagaaaaaagtctgtaagtgttcagtacagatgatttctttttcctgaatatttttgatctgtggttggttgaatccacagatgggaaacccacagatatggagggctgactgtattggtatcttactgtggaaatagctcagtttgtcaatgtttctcttacagcgtagtgcccagaagtgaatctgttactgcagatgtgatcggtgcagggaaaaagcacagtgagactgttagcctcttctcatagtctgtcactgtaggggccttcggtgcgattaaaggctgtagccactttttctcagttttactctttaagggaacttttattatgttttgattatataaatcatttataaagtcagtttattgtccagatgttaccagtttacattcctagcactaatatgtgaagggttctactttcttataccgtagccattgctgggtgttactctttctagtttttgccattgtattgctgttttattttacatttctttgttactgaggtttaacgttgcttaaatgaattattattcttgttcttagttaagttttaaatatgaggcctatccttaaacatgtataaattttatgttcttatttattggtaagagctttttgtgtattgagaatacctttatttgattaatcttttttgttgtgaatatttttctagtttgaatataccttttaatgttacggtatatttttgccttgtaaaattttttagttgttaagtagtttaatatgtcagacttttcccattcaaggagaccattgaggtcatacttacaaactcttcacctttttcctttgagcatcattatgatgaaaacattttgtattatctaagtaatatattctcctttaaaagagccaagcagtaaatatatagggtatcgtgtgattcctttcttccatattctttctcagaaataaccactgccaagtatgtcatgccaatataaagctaaaatttttaagaagtacttaagaactagaagaaaatgccaaattataggtagtattatccccttgtcaagagattcggattgaagagattaggcagggataggaagggggataattaagaaaatgagacttttacactttattctgtgtaaacattgcatctttctgttttgcctcacattacataaatgataccgtaatcacttactatgtcttggagatttatccatgccatgggaacctggaactcgaaaaaagtgactagtttgacttaacttgctcttagtgaatctattcttacttcttgtccatctacaatttcaaagtacatctgatgcttgaaacaagactagagttaggggcacagaccacctgcacggtcaaaaatgcgcaaatcacttttgactccctcacaacttaactactaatagcttgctgttgactggaagcctcgcggataacataaacagtccattaacacacattttatatataatgtactgtatttttacaatgaagtaagagaaaaaatgttattaagaaaatgtattatttttcatcaaggggaagtggatcatcataaaggtcttcatccttgatgtcttcaagtcaagtaggctgaggaggaagagaaagggttggtattgctatctcaggagtggctgaggcagaagaagcaaatccaggtacaagtggagtcattcagttaaacccatgttattaagggtcagctgtacctatatatgtcatttgagtgtaatggttaagaggatgggactgaattccaaatcctggctttgccatttattagtgtctgtgggcacaatccttaatctgtcttaaatttctggtctgtaaaatggagatgataaaagtgcctactttatatgggtataggaatccaagctcataatgtgtgattagctcttatcagactgcatgggacatattaaatagtaaataactatttaataatctgtagaatattactagtttgacatcaactttactaatatttagtatttaactcacccattgtttacttctatatagacagtcgggatacttgcccttttaagttttgttgttgttgttgttgttgttgtttttaaaacattcttcagatgcttttacattgatcaaaaatcactgatgctgaccggaactcaaagtgataagctacttgctaactatcaatatcaatgttttcattatgatatttctctttggagaagaccagtgtaaaagaggagttgatcagtattcctttcctgtcaactgaccttcatgttgtactctcttcctcaggcttcatctttcttaatttaaaaattcatgtttgtctgtagtaattacaaaaattcattataggatttccaagttctaatagttgctttctagatttggtcttcattatgatactgctcctatatttttcaacactttttcttaaatgaaatagtactaaagcgacaagtacgtacatacatttttttcctctcactcaggattgggtaagaccaaatagtcatattttaattctttggttaaactttatgattaaaaatgcttgctgtgtaagaatactaatttccttatcttacacagttaggagctaagacatttccatctaaaattcctgggtcaagaaatagaggcttaagtgtatttttttaatgtggaatacaaaccagtagaaaagctaaaaatgaaaatgaaagtaacaaaaattgggaagaaagggcagagggtatcttaatttctcaatctttatagtaagaagtcatttgatgtggttaataggtgataaatcaagaaacatccacaatgccaaaaatattaaaagtggctgtttatgagaagtggaatggagaatgaggtcttgtgtatatgtggtcctgtgtgtatgggaatggtggaagagatacttttatttttgagtcttacatgcttttatgtactactgagttatcactttctacctgtattagttaataaaacatcctacaggattccagtttataaagataaaagcatagttttatatgttgatatatgtataaaaatgaattggatggaaatataccaaaatataataagtggttatttctgggtattgagttttttccttccttatattattttgtattttgtaaaatttctgaaatgcatgtattttattaatttatataaaaattgttaagagaagttatttaggacttcctaacatttaatttaatttgtcccgggtttaatttgttgtcacacttacttggcatcagaatgtttgctttttgtttgtacaattactagaacttttttaaattaaaggaattgtacatcatagtctttgcatgcttagtaaggttggcattctgctgaaaataacagaaaacctagccaacagtaacaacaaaaaaggacattttctttttttccacttaagggtataggtgggcggttatagttagcagatcaggatagaatcatcagagattgaagctatctctggttcatcaccgttagcttgtttgcttttcatatacttgttgcttcaaggtttcaagatggctgtagtaatgggcattacatctctgttcaaggcagtcaaatgggagatggctggtgtcagccacactgtcccttatattaggaatgcaaaagctttctccgaagctcgctatcagacttacttttccagaactgggttatgtgccactcctagctgttagaaggtgaatatttggctttcaatttctgtagcgggagatggcaagagtaaaggggtttggtaattgatgttgtgttagacaaccagcagtctgctacaaaaagttttggcaaatgtaactaatgtttgtacttcagttctcaatcagatacccaggagagacagtagcctttctagaggtcagattgaaaatttgacataccaacattctctaaaatttactcttgtcgggtattattctgaaatgtagccattttgtctggtcctaggagtactaggtttatgctcctttcttttttttttcttttttgagatgaagtctcactctgtcgcccaggatggagtgcagtggtgccatcttggctcagtgtaacctttgtctcccgggttcaagtgattctcctgcctcagcctcccaagtagctgggattacaggcacctgctacaacacctggctaatttttgtatttttagtagagatggggtttcgccatgttggctaggctgacctcgaactcttgacttcaggtgttctgcctgccttggcctcccaaagtgctgggtttacaggtgtgagccaccgcacctggctatgctcccttcttaaaaaaaagatagttttggtatcctgaagtgataatgaattatggggtacgtttggtaaattatttcaattagttttattccccttgtagaatccaaattcctgtttgtagccggtaatctgaggattgtgaatttttaatgtaacaagtcaattatataagggttttcattgttgtttttaagttacagtgtgcaatgaaacggatagtcacaggttttacagcttatgactccacctctaccaacccaaataatggtcagccaaaaatatccaaattacatagtttgaagtattaggtgttacagttacttggattgtcttaaagccacatattttaatggttattatcccttattttcttattcctctgtcactgactccttttaaaatactttatgatgcagatttgaatagttgtcattgtgatttttttaagttctgggattcatgtgcaggacatgcaggtttgttacataggtaaacgtgtgccatggtggtttgctgcacctgtcaacccatcatctaggtattaagcccaacatgcattagctatttatcctgatgctctttctcccctcatccctgacaggccacagtgtgtgttgttccactccctgtgtccatgtgttctcattgttcagctcccacttagaagtgagaacatgtggtatttggttttctgttcctgtgttagtttgctgaggataatggcttccagctccatccatgctcctgcaaaggacgtgatcttgttcctttttatggctatatagtattccatggtgtatatgtaccacattttctttattcagtctatcattgatgggcatttgggttgattccatgtctttgctatcaggaatagtgctgcaatgaacatacctgcatgtatctttatcatagattgatttatattcctttggatatatacccagtaatgggattgctgggtcaaatggtatttctggttctaggtctttgaggaatagccacactatcttccacaatggttgaactaatttgctttcccaccaatggtgtaaaagtgttcctctttctccacagcctcactagcatctgttgtttcttgacattttaataattgccattctgactggtgtgaggtggtatctccttgtgattttgatttgaatttcttgaatgatcagtgatattgagcttttttttttcatgtttgttggctgcatgtatgccttcttttgaaaagtgtctgtttatgttctttgcccactttcgaatgaagttttttttgtcttgaaaatttgtttaaggtctttgtagattctgaatattagccctttgtcagatggatagattgcaaaaattttctccctgtacattgtctgttcactctgatgatagtttcttttgctgtgcagaagctctttagtttaattagatcccagtcgtcaatttttgcttttgttgcaattggttttgatgttttcatcatgaaaagtttgcccatgcctgtgtcctgaatggaattgcctagattttcttctagagtttttatagttttgggttttatgtttaagtctttaaatctgtattgagttaatttttgtatatgatgtaaggaaggggcccagtttcaattttctgcatatggctagccagttctcctagcaccatttgttaaatagggaatcctttccccattgcttgtttttgtcaggtttgtcaaagatcagatggttatagacctgtggtcttatatctgagatttctattttattccgttggtctatgtgtctgttttggtaccagtaccatgctgttatggtttctgtagccatgtagtatagtttgaagtcaggtagtgtgatgcctccagctttgttctttttgcttaggatttgtcttggctattcaggctcttttttggttccatatgaattttaaagtagttttttcttattatgtgaggaaagtcaatggtagttcaatgggaatagtattgaatctataaattattttaggcagtatgaccattttcacgatattgattcttcttatccatgagcatgggatgtttttccatttgtttgtgtcctctctgatttccttgagttctccttgaaaaggtccttcacttcccttgttagctctattcctatgtattttgttctctttgtagcaattatgaatgggagttcattcatgatttggctctctgcttgtctgttgttggtgtataggaatgcttgtgatttttacacattgattttatatcctgagactttgctgaagttgcttattagcttaagaagcttttgggctgagatgatgggattttccagatatagggtcatgtcatctgcaaacaagacagtttgacttcctctcttcctgtttgaatacacttaatttctctcgcatgattgccttggccagaacttccaatactatgttaaataggaatagtgggagagggcatccttgtcttgtgccagttttcaagggaaatgtttccagcttttgcccattcagtaagatactggctgtgattttatcataaatggcttgtatttgagctatgttccataaatacctaatttattgagagtttttaacattaagggatgttgaattttattaaaggccttttctgagtcttttgagataatcatgtggttttgtttttagttctgttgatgtaatgaattatgtttattaatttgcatatgttgaaccagcattgcatcctgggaatgaagctgacttgatcgtggtgagtaagctttttgatgtgctgctggattcactttgccagcgttttattgaggatttttgcattaatgttcatcagggatattggctgaagttttctttttttgtttcatctctcctgggttttggtgtcaggttgttgctggcctcataaaataagttagggagaagtccctccttttcaattgttgggaatagtttcagaagaagtgatactagctcctctttgtacctctggtagaattcagctgtaaatccatctggtcctgggctttttttggttagtatgccatttattactgcctcaatttcagaacctgtattggtctattcctggattcagcttcttcctagttcagtcttgggagggtgtatgtgtccaggaatttatccatttcttctagattttctagtttatttgcatagaggggtttatagtattctctgatggtagtttgtgtttctgtggggtcagtggtgatgtcccctttatcattttttattgaatctatttgattcttctctcttttcttctttattaatctagctggcgttctagctattttattaattttttaaaaaaaccagctcctggattagtttttttttttttgaagggtttttagtgtctctctctccttcagctctgctctgatcttggttacttcttgtcttctgctagctttgtggtttgtttgctcttggttctctagttcttttagttgtgatgttaggttgtcaacttgagatctttctagtattttgatgtggtcatttagtgctataaatttccctcttaacactgctttagctacatcccagagattctggtacattgtctctttgttttcattgatttcaaggaacttcttgatttctgccttaatttcattatttacccaggagtcattcaggagcaagttattcaatttccatgtagttgtgtggttttgagtgagtttcttaatcttgagttctgatttgattgtgctgttgtctgagagactgttaggatttcagttttcctgcatttgcttagaagtgttttacttccaattacgtgattgattttagagtatgtgccatgtggcaccaagaagaatgtatattctgttgtctttgggtggagagttctacagatatctatcaggtccagttgatccagagctgagttcaggtcctgaatatccttgttaattttctgtcttgatgatctatctaatattgatggtggggtgttaaagtctcccactgttattatatgggagtctttgtctctttgtaggtctctaagaacttgttttatgaatcttgatgctcctatattggatgcatatatatttaggatggttagctcttgttgatttaatccttttaccattatgtaatgcccttctttgtcttttttgatctttgttggtttaaagtctgttttgtcagaaactaggattgcaacctctgctttttactgctttccatttgcttggtaaattttcctccactcctttgttttgagcttatgtgtgtctttgcccatgagatgggtctcttgaatacagcacactgatgggtcttgattgtttatgcagctagccattctgtgtcttttaattgggacatttggcccatttacatttaaggttaatattgttatttgtgaatttgattctgtcatcatgatgttagctggtggttttgcagacgtgttgatgtagctgcttcatagtgtcattggtctttgtatttcagtgtatttttgcagtggctggtaatggtttttccttttcatatttagtctccctttaggagctcttgcaaagcaggcctgatagtggtgaattctctcagcatttgcttttgtgaaaaggattttatttttccaaactaagcctatgaagcttagtttggctggacatgaaattctgggttggaaatttttttcttaatgttgtatattggtccccaatctcttttagcttgtagggtttctgctgagaagtctgctgtttgtctgatgggcttcccttgtaggtgacctggcctttctctctggctgcttttaaccttttttctttgagttttgaccttggagaatctgatgattatgtgtcttggggttgatcttctcatggagtatcttactggggttctctggatttcctggatttgaatgttggtctgtcttactaggttggggaagttctcctggatgatatcctgaagtatatattccaacttggttccattttccccatctctttcaggtaccctaatcagtcatagatttggtcttcttacataatcccatagttctcagaggttttctttgttccttttcattcctttttctctaatcttgggaagatagtcttcaagctctgaaattctttcctccacttggtctctttggctatttatacttgtggttccattgtgaagttctcgtgttgtgtttttcagttctattgggtcattatgtttctctctaaactggttattctggttaacagctcctgtgatgttttatcatggttcatagcttctttgcattgggtttgaacatgctccttcagctctgtgaagtttgttattacccaccttctgaagcctacttctgtcagttcatctaagcgttcgtctagttgagtgcccttgctggagagatgttgtgatcatttggaggagaagaggcagtctggcttttggggttctcaatgtttttttcgttgattctttcttatcttcatgggtttatccagcttcgatctttgaggctgctgacctttagatggaatttttgtggggacttttttgttgatgctgctgttgttgctttctgttagtttctcttttaacagttagggctgggtgtggtggcttacgcctgtaatcccagcactttgggaggccgaggcaggtggatcatgagatcaggagatcgagaccatcctggctaacacagtgaaaccctgtctctactaaaaaatacaaaaaattagctgggcgtggtggcatgcgcctgtagtcccagctactcaggaggctgaggcaggagaattgctcgaacctgggaggcggaggttgcagtgagccaagatcgtgccactgcactccagcctgggtgacagagcaagaccccatctcaaaacaaaacaaaaaaacaggcccctctcccgtagggctgctgcagtttgctgggggcccgttccagaccctgtgcgtttggatccctcccacacctggagatgtcaccagagggggctgcagaacagcaaagatggctgcctactccttcctctgtgatttctgtcccagaggggcaccgacctgatgccagcaggaatgctcctatataaggtgtctggcgacccctgttgggggggtctctctcagtcaggaggcacaagatccaggacctgcttaatgaaatcgtccagctgtcccttggcggaggggatgcactgtgctggggattgtcacactcctctggactacctggattcctcagagccagcagggagaaagacttaagtctgctgatccacagagacagctactgcctctccccgcaggggctgagtcccagggagagcagagttccattcctaaacccctgctggagttgctaaaattcctgcagggaggccctgcccagtgaggagggatgggtcaggatctggcctgaagaggcagtctggccacagtctgccacagccgctgtccttgctgtggagaatttctcctgggtccaaaccgtccagtctccctggcaccagcagggaaaaaacggccaactggagctacagtgctggctgctgcccctccggagctcagtcatcttaggcagcaggcagctgcagtgatggctgctctcccttccctggggagcttagtcgtcttggacagcaggcagccgcagtgatgacggtggcccctttccctgggaattcggtagtcttaggcattctccagttgagtgaccgccaaacatctgcacagctctgcgcttggcacgcaaggccctggtggcatcggctcatgagggtgatatcctgacctgacccacgggttgcacagatctgtggaaaaaacatggtttcctgggcagggtagcacagtcactcactgcctcccttggctgagggtgggagctcccctttctccattgtggctcccatgtgggccattgcatcacccttcttttcctcactctccataggtcgcgccaactgcctagtcagtcccatggagagaacctggatatctcaaagttgctggtgcaggattcactggccttttttgttcttggtgggagcctctggccacagcgatttctatttggccatcttggcgcctgtcattgtgatttttatggacttctgcataacatattgctgaataaaattatcaaattagacttgtttaaaaaatttaagtcttaattgttttcatcaattgttgggtaaactttatgttaagttttcttaccagttagagatactatatttattcaacaccaagccattttttcttagtccaaaaaagtgttattgccttatacttttgaggagtaaaaaattgttcttgtaaatgagcatgtttgtatctagtttttggacaaactaatttctttatttacttctagcgaaatatgtgccagaaactgggatgtgtgagatactgagatgaagaaacacttgccctcatggagtctagagtctagtggggaaaaaagacttcaagatgagtcagtttcctcattgataaaatgggggtaatagtacctatctacctcatgaaggttattgtgaggattaactgagttaaattatgtaataatgacttagaattttgccaggtacatagtaagtgttccataaatgttggctgctgttattatttctgcaaaatcgagatttgtataaagtgctgtggaagtgcagactaagcaggggttgactttctagaaagttaggggagtgatccagttttaatctgctctcaatcctacttcgtagtttccttgtgcatagtaagtcctcaaaaactgttgaatgaatgaatgaagcaaagaatgagaatatacttacctaagtgggattgttaagacagcttctttaaacatcttaaaatagatgtcaataaaatttgaagatgcaatattacaatttagcatttatcttccatgcctgagttaattcatggatagaattcagaatattttttcaagtaagtaaataatggaagatagtttaagaaattaaaaagctattactttcagccaggtttttgaaacaagctgggttttcagactgtttgtttgtttgcttatttatttatttgagacagagtctcactctatcacccatctggagtgcagtggcacgatcttggctcactgcaacctctgccttctaggttaagcaattctcctgtctcagcctcctcagtagctgggactacaggcatgtgccaccacgcctggctaatttttgcatgtttagtagagatggggtttcaccatgttggccaggctggtcacaaactcctgacctcaagtgattcgcccacctcagtttcccaaagtgctgggattacaggcgtgagccaccacgcctggcctcaaacagtttaaaatattattttctagcagggtcttgaaatacaagtatcttatactacagactacagatattattcatatattttggcagtgtcgtgttgttgtagatcattatagctacatcagttaccaatgctgtgtaatggactaccccaatgtttattgccttaaaacaacaatttatctttttttcatgattctgtggtttgagtccatggttctcttggagatgtcacctagagtcattcctatgggtgcacttagaagggtagctgcactgaactaaaagatggtagaatggtttattcctgtatttgggtccttggtgcttgaatgttggctcagagtgcctcagttcgcctccatgttgcctctctctagcaggtcatcctggattactttagagcatgttactaacttctaagaatggaagccaccagttcttctaaagactagttgcagaagtggcagatcattgttccaatacattttactcgtgcaacaagtcacaagattcaccagctcagattcaagaggaggggaaatggagtccatttcctcataggaagaatgataaggaatttatggcctcctgtaatccaccatggtagcatagcaccttattatctttgattagacatttgtagcctatcctccttatctgccctttctccctttataagttttatgttttatcttttttcccttaattttccatgaatgtttgtagtttgtcttctgtttcactgattcagatttctattctcttgatagaaactatttctttctacggtggatttttgttctgcctttgtgttgttttactttgcctgtatgcttttcttatcttttctagtttactagtcatgtatcctacattttagatgccttttcttgatatcatttaattttaactttatgtaatctatttaaaaatttttctcagaatataaataatagttgcagtagtagaactaaaggtagtgtcagaaacagtagggtggtgcctaccatgttatgttagtgaccctgtgtctttggtttagggatctagtggaacatgaccagctatccccttttgcctgagataccctcagcttttgatcatcactactgagtttttacatgttttagtgaaactatgaattactcaaatgttgtgatttaaaatgtggaagataagctgttgatatgctagttcaaaaagcaattcaaactgctatgtgacctagaaaaacaccatcttgactcatctaaaggtggaatggccattaagctgctattcccaccagaaatggaattataagccaaaaactatcatgaacttttccatcatatgagcaagccatagtagaaaccaagtagggtcttctgatgactacatccctggctaacatattgtctgcaatttcatgacagaccctggtgcagaaccacctagctaagtcactcctttcccacagaaactgtataataaaaccttattgtattgaaaatactaattttgggggtaattatagcaatagataatagagattttgagcagggcacggtggcacacagctgtaatcccagcactttgggaggctgaggtgggtggatcacttgagctcaggagttcgagatcagcctgggcaagatggtgaaacctcatctctacaacaacaacaacaacaacaactagctgggtgtggtggtgcacacctgtggtcccagctacttgggagactgaggtgggaggatcgctatctctaagttcttgagcctgggaggtgggggttgcagtgagctaagattgtgctaaaagtgacagaatgagatcctgccaaaaaaaaaaaaaagcaatatagattttggtatcagagtggttttgttttgttgtaacaaaaatgtagtactgtcttttgaatttggaactggctacaagcttgaaggattttgaaacattagtgaaagcatgtagagccttgagttgactgttagtagaagtttgagtagaagtagaagcctttgagaaggctttgctcgagggcttaaaggaaagtgagaaaaatattaacggaaacacgaggaaaggggatccttgttctgtggtggcagaaagtttagcaactctgtcatgtgcaataagatggaaaatagaaaaatgtaacctatgaatgaagtgatctagctaaggagatttcttatcagaatgttgaagaagctacctggtttcttcttgctacttatgtataaaatgtaaaaggagagagataagcaaaatgaaatactattaaagaaaaaagagcagggaactgtagggcttgaaaattcccagcctcttcgtatgatcattgatactaaaattaagaaatgggttctagaaaagatccaatctaggaccctcatgggaaaacttgatctacagatcaagctgaagatgtgactttaatgtcctttaagaccttagaaatatccaggtgttttgaagttgtgactttaaagtcctttaagatcttagaaagatccaaagtgttgcctcaaaacacctgctggatttcagaattgctatgggtcagtgactcccacacacctcctaattgtcctttgtttgaacaggagtgctgatcgtagttttgctatgccttatgcatcactggtcttgaattcctgacccaacagaaactgtgagatcataaaggcttattgttattttaaagtgctaagttttgtggtaatctgttatgcagtgatagatagctaatggagtgacagttaagttgaatttgggaggctgataagatggcagcctggcaacagaggcaggtagtggggttgggggagaacatttgatgcagagtaaaaataagatttgtgattccaaaggtcatgaattgttaggatcatgggatgactgtgtatcattggaagatgtaagctcaagaatattcatgaatatgtgttctattaaacattggtaagaagagttttctgaccaataattatttctaggaactacaaaattttatatgtagaatgaggaagaattttttccatttgttttattcttagattgtaaagttatgtttttatagcttatattctcaggttagtttatttatattgtaaaagtatttaaaataaatgttagatataatagggttctatacttaatctaaactaaatctcttcaagataagcccctctatcaatttactaatgtttacagtgattggaaagaagagaatattactttcccttttaactttttattttgaagatttaaaaatatatagaaaagctgaatgtattgtgttcatgagcacaaaaatatccttaacattttgtcacatttgctttacatatatttaaaaattttattttgtgacctgatctcactctgttgcttaggctggagtggatcaaagcttggtgcagcctctaactcctgggctcaagcaatcctcctgaatgagcctcccaggtagctgggactacaggtgtgcaccaccacctggctaatgttttaatttttaagagttggggtctcactagattgtccaggctaatcttgacctcctgggctcaagtgatcctcctgccttggcctccaaaaatgctgggaatacaggtgtgagtcactgtgcccagtccatatactctttaaaatttttaattgaatcatttgaatggaagctgtagatatcactttatctctaagttcttctagcatgaatttccaaggttaggctattcataatcacagtatcattaacacaactaagaaaaatcatatttcataattatgcctaatatggtagtccataaaagtttataaattttttaaaatccagggtccttacactatatttggttatgtcacctgagactgttttattctagaaaataaaaatctaacgttatattgctttctatgacactgattctaattttttttttattatgtactttttttcttttttttttatttccataggcgtttggggaacaggtggtatttggttacacaagtaagctctttagtggtgacttacgagattttggtacacccatcacccaagcaatatacactgaacccaattttgattctaatttttttgagggttttatatcacttgttttgtgaatatcccacattctgaatttgtccagcttttcctcattgttagattcaggttgaaccttttttggtgagaatactgcatacatgatacatacttaatcaagaaggtgactgctggatctcttcactgtaaagatatatttttctctttttttttatactttaagttctagggtacatgtgcacaacgtgcaggtttgttacatatgtatacatgtgccatgttggtgtgctgcacccattaactcgtcatttacattagatatatctcctaatgctatccctcccccctccccccaccccacaacaggccccggtgtgtgatgtcccccttcctatgtccaagtgttctcactgttcagttcccacctatgccacctatgagtgagaacatgcgatgtttggttttttgtgcttgcgatagtttgctgagaatgatggtttccagcttcatccatgtccctacaaaggacatgaactcatcatttttatggctgcatagtattccatggtatatatatgccacattttcttaatccaatctatcattgttggacatttgggttggttccaggtctttgctattgtgaatagtgtcgcaataaacatacgtgtgcatgtgtctttatagcagcatgatttataatcctttgggtatgtacccactaatgggatggctgggtcaaatggtatttctagttctagatccctgaggaatcgccacactgtcttccacaatggttgaaccagtttacagtgccaccaacagtgtaaaagtgttatttctccacttcctctccagcacctgttgtttcctgactttttaatgatcgccattctaactggtgtgagatggtatcacattgtgattttgatttgcatttctctgatggccagtgatgatgagcattttttcatgtgtctcttggctgcataaatgtcttcttttgagaagtgtctgttcatatccttcacccacttgttgatggggttgtttgtttttttcttgtaaatttgtttgagttctttgtagattctggatattaaccctttgtcagatgagtagattgcaaaaattttctgccattctgtaggttggctgttcactctgatggtagtttcttttgctgtgcagaagctctttagtttaattagatcccatttgttaattttggcttttgttgccattgcttttggtgttttagacatgaagtccttgcccgtgcctatgtcctgaatggtattgcccaggttttcttctagggtttttatggttttaggtctaacatttaagtctttaatccatcttgaattaatttttgtataagatgtaaggaagggatccagtttcagctttctacatatggttagccagttttcccagcaccatttattaaatagggaatcctttccccattgcttgtttttgtcaggtttgtcaaagatcagatggttgtagacgtgtggtattatttctgagggctctgttctgttccattggtctgtatctctgttttggtaccagtaccatgctgttttggttactgtagccttgtagtataatttgaagacaggtagtatgatgcctccagcttttttcttttggcttaggattgacttggcaatgcaggctcttttttggttccatatgtactttaaagtagttttttccaattctgtaaagaaagtcattggtagcttgatggggatggcattgaatctataaattaccttgggcagtatggccattttcacaatattgattcttcctatccatgagcatggaatgttcttccatttgtttgtattctctcttatttcgttgagcagtggtttgtagttctccttgaaggaggtccttcacatcccttgtaagttggattcctaggtattttattctctttgaagcaatcgtgaatgggagttcactcataatttggctgtttgtctattattggtatataagaatgcttgtgattttggcacatggattttgtatcctgagactttgctgaagttacttatcagcttaaggaggttttgggctgagaccatggggttttctagatatacaatcatgtcatctgcaaatagggacaatttgacttcctcttttcctaactgaataccctttatttctttctcctgcctgattgccccggctagaacttccaacactatgttgaataggagtggtgagagagggcatccctgtcttgtgccagttttcaaagggaatgcttccagtttttgcccattcagtatgatattggctgtgggtttctcataaatagctcttattattttgagatacgtcccatcaatacctaatttattgagagtttttagcatgaagggctgttgaattttatcaaaggccttttctgcatctattgagataatcatggtttttgtcgttgttctgtttatatgctggattactttattgatttgcatatgttgaaccagccttgcatcccagggatgaagcccacttgatcatggtggataagctttttaatgtgctgctggatttggtttgccagtattttattgaggatttttgcatcgatgttcatcagggatgttggtctaaaattctcttttttttgttgtgtctctgccaggctttggtatcaggatgatgctggcctcataaaatgagttagggaggattccctctttttctattgattgggatagtttcagaagaaatggtgccagctcttccttgtacctctggtagaattcggctgtgaatccgtctggtcctggactttttttggttggtaagctattaattattgcctcaatttcagagcctgttattggtcctttcagagattcaacttcttcctggtttagtcttgggggagtgtatgtgtcgaggaatttatccgtttcttctagattttctagtttatttgcatagaggtgtttatagtattctctgatagtagtttgtatttctgtgagatcggtggtgatatctcctttatcatgttttattgtgtctatttgattcttctctcttttcttctttattagtcttgctagtggtctaacaattttgttgatcttttcaaaaaaccatctcctggattcactgattttttgaagggttttttatgtctctatctccttcagttctgctctcatcttagttattttgttgccttctgctagcttttgaatgtgtttgctcttgcttctctagttcttttaattgtgatgtcagttttggatctttcctgctttctcttgtgggcatttagtgctataaatttccctctacacgctgctttgaatgtgtcccagagattctggtatgttgtgtctttgttctcttggtttcaaagaacatctttatttctgccttcatttcgttatgtacccagtagtcattcaggagcaggttgttcagtttccatgtagttgtgtgattttgagtgagtttcttaatcctgagttctagtttggttgcactgtggtctgagaaacagtttgttataatttctgttcttttacatttgctgaggagtgctttacttccaagtatgtggtcaattttggaataagtgtagtgtggtgctgagaagaatgtataatctgttgatttggggtggagagttctctagatgtctattaggtctgcttggtgcagcgctgagtttaattcctggatatccttgttaactttctgtcttgttgatctgtctaatgttgacagtggggtgttaaactctcccattattattgtgtgggagtctaagtctctttgtaggtctctaaggtcttgctttatgaatgtgggtgctcctgtattgggtgcatatatatttaggatagttagctcttcttgttgaattgatccctttaccattatgtaatggccttgtttgtctcttttgatctttattggtttaaagtctgttttatcagagactaggattgcagcccttgccttttttttgttttccatttgcttggtagatcttcctccatccctttattttgagcctatgtgtgtctccgcacatgagatgggtttcctgaatacagcacactgatgggtcttgactgtttatccaatttgccagtctgtgtcttttaattggagcatttagcccatttacatttaaggttaatattgttgtgtgtgaatttgatcctgtcattatgatgttagctggttattttgctcgttagttgatacagtttcttcctagcattgatggtctttacaatttggcatgtttttgcagtggctggtactggttgttcctttccatgtttagcgcctccttcaggagctcttttagggcagacctggtggtgacaaaatctctcagcatttacttgtctgtaaagtattttatttctccttcacttacgaagcttagtttggctggatgtgaaattctggattgaaaattcttttctttaagtatgttgaatattggcccccacactcttctggcttacagagtttctgccgagagatcagctgttagtctgatgggcttcccttttgtgggtaacccgacctttctctctggctgcccttaacatttttcccttcatttcaactttggcgaatctgacaattatgtgtcttggagttgctcttcttgaggagtatctttgtggcgttttctgtatttcctgaatctgaatgttggcctgccttgctggattggggaagttctcctggataatatcctgtagagtgttttccaacttggttccattctccctgtcactttcaggtgcaccaatcagacgtagatttggtcttttcacatagtcccatatttcttggaagctttgttcatttctttttattcttttttctctaaacttctcttctcgcttcatttcattcatttgatcttccatcactgataccctttcttccagttgatcgaatcggctactgaagcttgtgcattcgtcacgtagttctcgtgccatggttttcagctccatcaggtcctttaaggacttctctgcattggttattctagttagccattcatctaatcttttttcaaggtttttaacttctttgtgttgggttccaacttcctcctttagctctgagaagtttgattgtctgaagccttctgctctcaactcgtcaaagtcatcctccttccagctttgttccgttcctggtgaggagctgcgttcctttggaggaggagaggtgctctgatttttagaattttcagtttttctgctctttttttcctatctttgtggttttatctgcctttggtctttgatgatggtgacgtacagatgggtttttggtgtggatgtctttctatttgttagttttccttctaacagtcaggaccctcagctgcaggtctgttggagtttgctggaggtccacttcagacactgtttgcctgggtatcattagcagaggctgcagaacagcaaatattggtgaacagcaaatgttgctgcctgattgttcctctggaagtttcgtctcagaggggtgcccggccgtgtgaggtgtcagtctgcccctactgggggttgcctcccagttaggctactcgggggtcagggacccacttgaggaggcagtctgtctgttctcagatctcaagctctgtgctgggagaaccactactgtcttccaagctgtcagacagggacatttaagtctgcagaggtctctgctgccttttgtttggctatgccttgcccccagaggtggagtctacagaggcaggcaggtctcctttagttgtggtgggctccacccagttcgagcttcccggctgctttgtttacctactcaagcctcagcaatggcgggcgcccctccctcagccttgctgccgcgttgcagtttgatctcagactgctgtgctagcaacgagcgaggctctgtgggcataggaccctccgagccaggcatgggatataatctcctggtgtgccgtttgctaagtccgttggaaaagcgcagtattagggtgggagtgacccgattttccaggtgctgtttgtcaccccttcacttggctaggaaagggaattccctgacgccttgtgcttcccgggtgaggtgatgcctcaccctgctttggctcacgcttggtgcactgcaccccctgtcctgcacccactgtccgacaatccccattgagatgaacctggtacctcatttggaaatgcagaaatcacccgtcttctgtgtcgctcacactgggatctgtagactgtagcttttcctattcggccatcttggaactgctccctatttttctcatttataaatctgtgggatgattgttcccaatagccttttacctccattgatgatattgcctgaatcagtttttacgttatgaattatagggaaattgctttttaatggccatatgtaatccatatttgagatccatatttgcaaggaaagatgcattactaccactgaaagaacccactcttgccttttctttttaaaagttaatatattatttggatcatggatttgaaggtatttgagttccatgtatgcatattttccttaatgagtaattttgaaaaactgatttaatttaaaacaataagttaatgacagatctctcagatagttttagaactcctaacaatgagacacatcaaatagctatgtgatatttattgagaccctactaaggtacaaggaatcacactagataatacaatgtacttaacattaaaagttgtagtctgaaagtacttacccatttaagaagataagacacatatgcatgtaaagatggaagtatatttgtggcaggaaaccaaaatgctaaatgactggtgtagtcagttaatgcttttggtattcacaaagctagcactttcaactttgatgcttgcaaagcactgcaggtatatgaagtgtcttgattatgcttctgacattctgaactgggacctttcaagtgttttttttcccctaataaatacttaccaagtacatgcctatcatgttatagcaactaaagaaacaaaaagaataaaacgtgctccttgcacctggacatagttattgggtgagatgaaaaacatagcaacctaaaatcatttaaaaagtgctatagtaaaggtatctacttagtgccatggttctatagaagggagaactaggaagtcatgttcattgggtgatgggtgtgtggcaggaaaggcttcacagaggaaggggcatttgagactgataggaatttttttgggtgagaagggaagaagggtgttctaggcaatagaaaataggaagcatgctgaggagtgtgtgtgtgcatgccatggttttagggaagacaagtgatgccattttcagaaaatttgggagtagtcctaatttgggaaggaaaatggttattcacccttttgtatgtgtgttgtaattttgccttatattggagaacaacacagttttaatgatagatataatttttcagagaaagcatatggaaaatgaacattgaagaatggactgaagaatgaatatgagaaacacacactttactaacagggaatgagaggaaaaggagacctctttagagaagtccaacagcaagagagctaaaatggattataatgtcattgaaccaatgggcaagattttacaagaggatagtgaaataacgccacatacagcggtgtgcatgaggaaatgaaattaaaggggccattggatttgacaataaaagaaatatcatgaattcagtttcagggatttgaggggagggaggaagctagacttttggggaataagggaagagtgatgcttaaataccagatttaaaccattcatttgaaaaatctgtcagtgaaaagtaggagagcaataaagtgagcagcttggttaagtgaaatattttttttaagttagagaaaatttttgtatatgtgatggcagaggggaacgtgctagtgtggtaggaaatactatagctggcagagaaagaataagatggagtgaaggttgggaggagatgagaacataggtgatggggttaatctttgaaaggaggagaggcaaactcccagttggtccagagggaaggtgagcatgagggatgagcagagggaaggaagaattactgaggaacagaagaggaaaaaagagggaatttctctgtgatggttgtgatgttctctgtgaatttggagaaggcagaatcatcacggttttagaacttcctcttctatttatgtatcccgggagtgtgaatgaagaaatctctgcccacctaacataacctatagttggtgagtggtatggcagaagtttgaaaagccaagggagtaaagttgtggtatgttctaccattagaaaaatgttaatacaaacaaaatatcaggcaatgtaacactctaatactatttaaaaatgcagttattgtacagcatgatgactacagttaatgtatattatattcttttttgtttgttttttttttttgagatggagtcttgctctgtcacccaggctggagtgcagtggtgcgatctcagctcactacaagctccacctcccaggttcacgccgttctcctgcctcagcctcctgagtagctgggactacaggtgcctgccaccacgcccggctaattttttgtattttttagtagagacagggtttcactgtgttagccaggatggtctcgatcttctgacctcgtgatccatccgcctcggcctcccaaagtgctgggattacaggcgtgagccaccgcatccggccatgtatattgtattcttgaaaaatgcagatatagtggatattaagtgttctcaccacaaaaatgataactatgtgaggtaatgcatttgttagctagatttaactattctacaatgtgtatatacttcaaaatatcatgttgtatgtggtaaataagtgcaattattgctaatacataaagatttagaataaccttatttaggaacactaaatgtattactagtttaattttaaaagttttgttacagtaatttaaaagtatattttagatagacaaaatgattaattgacctaattttaaaatgtttcaaattttgcagtgtagtgttattttttaactgagggcttctctctgagactagtcagtactattaaaaatttaagcagcacaaatccaactcaagcagtcaagcaaaaaattaaaagacagtggatatgttagattaagtaaatgggagtccaagatggactgatctcaggcatgcgtggatctagaaccctgatgatgatgtcaagggtcttcttctgctgtgtgggctggctctgtttccacctgccatggcttcattctcaagcaggcttctgttgtgtgcttatagcctcagggcaacgtcatcacggctcactgtctgaaaggaagatagactccttctcaccagttatatggtaaatttcagaggtgactctgtgttcctccttatgtcagtttttcatcccttaatgtatcacggtagccaggagtcagggggatggcaaacttgattgtctggatcctgggttatgtgctcatttcttgaaggaggtcactgtggttatgagttgtcggggagtagtggcttttaacatttttggcacatttcctttcagtcttatgtgtgtgtgtgtgtgtgtgtgtgtgtgtgtgtgtgtgtgtgtgtgtacatgtacgtctttgttctgtaacaaaccaagttgtcaaatgaaagccttgtgttgaaatcacattccttaggaaggaattagtctttgattgcttatataagtgagtcttcacaacttttttagtttatgttttcataaagatgcagtggaagccttttcttttttataagtaaaagtgtttttcatgtacataacctaatatttttaagtccttcacaaaaatgaagtaactctatgtggataacttcagtagtaacaaaaagaaacaaaacaaccatcctgtcccccacttgccccaccaacctggatttctccttgggattatgaaagcagtatgatggaagagaaggtacagctggctttggaggcagatagatctggacttttaatgttgttgggaggatttgagataattacatagaatccttaatatagtagtgctaggctcataataggtgcttgataagtgataactgttattataattttttaaaaaaaattattgagacagggtctcactctgtcacccaggttggagtgcgatcatagcgcactgcaaccttgaactcctgggctcaggacatcctcctgccacagcctccctagtagctggaactacaggtgtatgcaaccatgcctgctaatttttaatttttttgtagagatggggtcttgctgtgttgcccaggtgggtcttaaactcctggcctcaagcgatcctcccatcttggcttctgaaagtgccaggattatgggcatgagccactgtgcctggcctgttaaaattcttactgataagcattgacttttttgttttgctgaaaagcactggatgtgaatgaagtcctgggttttagtcctaactcttttggtaaccaactgtatgcaaccaaaatataaaactacttgacacactgggcctttgttttcttgcctgtaaaaataaatggatggattagaaattttgtctagctctaaatttctactatttaatagagtaatttgggttacacaaaaatataaaatagaaggaatcctagtatactgtaggaaaattaatgatcttggttttgatgtaaaaccaagagttccagcttctcttcccaaacttgctaaactttaagaacaacaataatgactggaaagtttacagtaaaaatgcatcttatttatgttcaataaaattttgttttgattagtgtccctaaagtctcttctagctccaatatttgatatttcctttccaataaattctagccaggaatattactttaaattataaatgtatagctattttcgtcacagctgcctgtcatggtttcgtttgctaccatgtcatgtagcgtagaggggtcatatggaactttttgtaacagaatttgactctaccttaccagtagttaggcttaatagtgtattgtgttggagtatacctgaggaaagagaaattaagccagcaaaaaagtatacaaacttacaaaaaggaaaattctgaccaggcatttggaaatgagctgcggcctttggggtctgttaagattcctacagtcaagccgggtattatttaagatgattgtgaaaaccaaaggaaataatgtatgcaaactttttagtgtagtattttccatatatattagcccccactattgtttttatcctataggaatatttttcctcataacagatttcaggaactaacataagatcagaaagaataaaattgtagtttggggtttcggttggccttcttcagtttttggatataagattccagtagcatccatataaaaattgcattagattttccattggatatttgctgttgactaaatgtggctcgataatttttgcaggtcactactataagactagtgcttcagcttttttgaaatagtagattaaattggtaaatatgcaaaactgcccttggttttttgatgctcccttctgcaggttctgctttatggctatcatgatctgaatttgtttctttatttctaagtagctcttcttgaactctgtttcaaagagtttccctaacctcagaattctcacacctggctgattggcctctagggagtattcagaaggcagtctttgtgctattatacttttttgttggctggataaacatcagtagtgtttaaatgaaataataaccctgaaaagatttttattaccgtctttaaaactttatccatggcatggcaagtcctgtttcattgaacatttacatatgaaatacatgggttgatggaattattaggtcaaaaatggcttttaatggtttttaagtagtgaacaagaaaatttgaattatctttttttcttttaaggatttcattctttgttacaatctccatatctctcatagttcagagataatagaaattgtttttaatattcattcattcattcaagaaatgtttatttaatactcattatgggataggccctgaggaataacatagataacataccttatattttaaaaagctagtagctcattttaatttcatttcagaataactttgtagctgcaaaataagactagtttaagctataaagtcaattagcacaccagtgagttttgggtaggctagatggtaaacttcatctttccaacatacttagctttatttaacttgatgtttctgaagtgttttgacctattcagccatcacccctactgaacccactttcagaaataatagttaagtatttgctaggttttcattaactggaactgaacattattaggttaattatatgatatttatagggcagaaatggtgcatatcattgtattttatggcttatcctaactagttgggtgatactgtcttaatttgcctaaggtagttctggtttactcttgtcgctccagtgtgattattatacataatctctcttttttttttttcctcgagactgagtctcactctgtcgctgggctggagtgcaatggcgcgatcttggctcactgcaacctctgccttgtgggttcaagcaattctcctgcctcagcctcccgagtagctgggactacaggtgtgcgccaccacacccagctaatgtttgtatttttagtagagacggggtttcaccatgttggccaggatggtcttgatctcttgacctcgtgatccgcccaccttggcctaccaaagtgctggcattacaggcgtgagccactgcacctggcccataatctcttccttaaatcttagaagtgccctgggtgaattatatggccctcttatagctaacactcttagttagaaaacatattatgtgccaggcagcattgtaagcatttgatatatattaactgaggcctcacaacagccctgtaaggttggcactgctttatccttgatttgcagatgagtagactgaggtacagaaaagttaagtaacttgtctaaggttgtacacctagcaagtagtagggtcaggattcaaacacaagcacatttggtcctggaaggtatactcctaaacagtgtgcttttctggtacagatgagattgctcaatgaacatgtttaagagaaggatgagaggatagcactctggagaatactgacatttaaaagcaagtaaaggaaatagaaacttggaaataagacagagaataagagctaaaaaaaaaggaactttaagttatagacagaattcagttacttggatccccccactccccaagaattgtcttcatccttttttaactagaaagaaatatttttcttttcactatttaataagtgccccaaagtgctagatagttttcctttgaaatatagtaaaagagcatttattgaaagcagcttgtttatgtgtgctttgtttaaaaattagagacattttattttttcttaagtaacagaaatcagactttcaaaaaagctctttaaacctagactaacttatttatgacaattttgtcatatatttgaaagttaattttaggaaaattacagagccttttaaccaccctatggccagacttcagtgttgttctttttatttctacctcatttcatgttgagtcttaacttcgctgtctctctttatcatcccctacccctagtctgaatgttgaagaatgctaaagtatattttattgcttcattgactaaaactatgtttctaaaactatgaatttgcttaatgagtcagcaactgtaactataattaacagtatagtttttacaaccatagttttgtggtaaatgtgcagttctcagaatttaaatgtaaacgttcaatgaaattaaacaaaacccaaatcttcatgcaataggtagtatatatgtattcagtaagggtcaccaaacattaattgaggttctattatggttaacttttctactttgtacttagggataaaaagatgagtaaaattgtttcctgcatttttccccacccattccctccccattttctttctttcctaccttccacagccccattgagtgtctacttaatgtgccaagcacacagtatataaagatataaagagctcaaggatgtaaagataaatgaggatctagtgcctgccctagttcagttatcccttaggaagacagaccagtcctatgtcagtcagctcagaaaagtgcaataactgttgaagccagggccacacccagtcttgtctgggttcactaccccactttccactcatactttagcgatgaacagaatttaagtcatctaaaaggaggagcaagattaaaacagtgaaggaggtatgatgagtaacagaaaggagctcattggtgactaatgaaagagcaactgctgtgttaaggggttgatgaccatattcgccagtgtggagttgaaggttaaggagtgaatgggaaatgagaaagtagacttcaaaaaagctggatgttgtggagaggaatagagaaaattagaggttgaacatgtagtaagagtgagtgaatattttttagaatggggagataagtgtgtttgtttgctgtctaggagtgagctatagaattgtccaggtgagatggaaagataacagagagaagatatgagaacaaaatcctgtaggaaattagataatatcaagaacataaatagaaggcctggcacaaagtctcatgcctatgatcccagcactttgggaggctgaggcaggcagattgcttgagcccaggagtttgagaccagcctgtaacatagcgagaccacatctctacaaaacaaaaaaaaaaaaaaaaaaaaaaaattaaaaattagccaggtgtagtggtgcatgcctgtagtcccagctatgtgggagatcaggaggctgaggtgggaggatcgcttgagtccaggaggtcaggctgcagtgagcagtggtcatgccactgcagcactccagtctgggtgacacagtgagaccctgtcttaaaaaaaaaaaaaaaaaaaagggcctggcacagtggctcacgcctgtaatcccagcactttgggaggcctgtaatcccagcactttgggaggccgaggcaggcggatcacgaggtcaggagatcgagaccatcctggctaacatggtgaaaccccgtctctactaaaaatacagaaaattagacgggtgtggtggtgggcgcctgtagtcccagctacttgggaggctgaggcagaagaatggcatgagcccaggaggtggagcttttagtgagccgagatcacaccactgcactccagcctgggtgacagagtgagactccatctcaaaaaaaaaaaaagaaaaactgttttttggtttttttttttgttatcctaacttttgaattacttcataaagaagtttagtgatctatttgattatgtagaagctcttctgatagttatacatgcttaatcatttaagaataattaaaggaactatattgtcatgttatcaggcattcctttatgaaaatgttagaaactcctctttcatctataccttccccactgtttaaccctccaatcaaaagcacatattctgtggtaagaacagagaatatctattttaaaggtcatttgtgtcaaattgtcctaactagctgttgggattgggaggtgctatttgggtcataaatagcaagttttctctcccaataaagcaatgtctgagaatcccaagattctcatttagtagatctgggttgagacctagaagacagttaattcatttagccaccaaatgtgtattgagtgtcttcctattatatatttattaccatattgtgtaggtagtgttagaagacatcccaggtgcctactctgtaactggcggagagataataaacaaacaggataattttatatagtgctaagttctgtgaagaaagtataccatgatatgtgccagataattacctggcaggggaaaggagagagagagctttgcatagagtgatcttgggaggtgtcttttgaagagataactcttattttttatcttgcttttttttttaaaaaagtattttttaggttgtagtaaaatatatataacataaaatttaccattttaaccatttgtaagtgcacgtttcagcgacatcaagtacatgcacattgttttgcaaccattcaccaccatctgcctccagaacttttttcatgttgtgaaactgaaactctgcagccattaaacagtaattttttattttctctctcctctcagcccctaacaacaaccattctttctgccttcttaaatttgactgctttagtgcctcatgtaagtggatcgtacagtatttgtgtgactggcttatttcacttagcgtagtgttttccaggttcatccatgctgtggcacatgtccgcatctccttccttcttaaggctaaataacactccataatatggatgtaccacattttgtctgtccacctttgaactgagatctgaaaaatgagaaggggccatgcaagaactagaagaagaacgttacaagcagaggaaagaacatgtgcaaaggccctgagatagcaataaactggttggtggtctaggccagtgttgtcagaatatattaatagtagagaaaagtgcctggaaagaatggtattaaatgggatcagagatagacatacattggccgtattattttaggctttgaaagaccttggcttttaagtggagtgagaagctgcttattaggaagttttaagtgggggagtgacttaatctgatttccatgtaacagcaaaagcaaaaatcacccagactgctgtgtggacaagcatccttgtggattctaatgcaagtctgtgatcggactttgagaaatactaatttagtccttaagtcagtatcctgagatagctgatttcaaaagagctctctcagggcttctgaccaaaagtgacagattggctacacctgtacatctcttcttatttcctaatccctgcctaaatggaagaaagaaatcagagactgggagaggttacaacaggagacagaagctgctatacctctttcaaataagcagatggacaggtagtgactgactttgcagaggaatcacacagtacctgtaagtgcacaaaaatacctgtaagaaatgcagtactgtgtttgtccgaagctcccaagagtctcagcatttggaggcaccagatactaaggaagataggggtcagaaatggagctgaaaacaggggagctggtcggaaaatctgtgtacactgacaggtggacccctacgattttctccctatgtgcccttgtggatgggtgagtcccttcactaccaactccctggcctcaggagaacaaggtttattctttgcaaaattaatgaagagctgtctggactttgaaaccaggggccgtggattgttgcttggtttaaaacaaggagatcggccgggcgcggtggctcacgcctgtaatcccagcactttgggaggccgaggcgggtggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaccaaaaaaaaaaaacaaaaaaaaaaaacaaggagatcaagggaaacctacgcctgaactatagaagtgttagctctcttcctctgctctccttccagaactgcacagtcaagcctgtcctatccttctcctgtggaagactgaagataacagcatcttcagatactgataggctttctgctgagagtaccttaagtgaattctaccagtcgttaagccctgttttcccacacagatctttcagttagttcttttcaggggcttattcttaaatatgagcaaacaatctaacaccattggtcatctgggggaagactccaacattaaaaaaaaaaaaaagtagacatagagaggtggagagggagtgatacttggaacactgggagaaaacagataccataagggatcaaaagaaaactttaaaaatctccagtattatcagagaagacatgtatttccttccccacttaaatgatagtgaacacatataaaagcagaaatccatgagggtaaagagaacgagatgagagatgacagcaggcaaacaacgtcaactaaatattggaagctgagaacctggtgcgtgagtggtaacagaatttagcagagctgagaaagcagaaagtcctatggtgtgggtagttgtgcaaaaactggtattcttttaattaatgatgtgctttgctctatttggactgctgggttcttatttttgagcagtatgctctctcccagttgaagctgttaatgggctgtccaccaatggagaaatcagaatgattaaaatgtagttcttgtatttttatggttctcttaagcagtcatgcattatactcttcttcttgtgtctgagccaacatttcataggagtagataacacccatttctggtggcactgacagcagggttgaaaagaatgttataaaagaaaatatgaataacatttaacttaagaatatgttccaaattttgtttgtaaagtagttgtttaaaacttggtagttctttttgatataatgttataaatggcagttatcctagaccaaactttaaaatatgtttcattagcaattaaatgggcatttgtaagttcccagggaaacctaatcacattgtatagtattttttaatgaagaaacactagctgggtacagtggcttatgcctgtaatcccagcactttgggaggccaaggtagatgaatagcttgagtccagaagtttgagaccagcctgggcaacatggtgaaacctcatctctacaaaaaatacagaaaaattaggtgggcatggtggcttgcgcctgtagtcccagctaattgggaggctgaagcgagaggatcacctacgcctgggaggttgaggctgcagtgagctgagccatgatcgtgctactgcactgtaccctgggtgacagaatgagaccctgtctcaaaaaaagaaaaaatgctttttaatggtaaaatggctacatggatttagatttagacttgaattcaagtcctacttctaccatttttctgctatgtaaccataagtaaatttctaatgtttctgggtctcagtagaatgagaataatatctaatcagagggtagttgtgatgattaatggatgttaaagtagatgagctactcagtcgagctcctagaccctagggagtcaataaatagtcggttttcttcaccctttttttttttttttgagacagttttgctctgttgttgaggctggagtgcagagtgcagtggtgcgattatagctcactgcagccttgatctcctgggctcaaaggatcctcccttctaagcctcctgaggagctagggctacaggtgtgcaccattgtgtctggctaattttatttttttatagatacagggtttcactgtgttgcccaggctggtcttgaacccctggcctcaagagatcctctcacttcagcctcccatagcatgtgggattataggtgtgagctactgtgcccagctgttgttttcagttttactcttctgtggtatgtggtaagagggagcatttgttttctagagcctgcagcatgtgtgggtcagttgaaaatgtataaaaattttgagttacgcacggtggcttgtgcctgtaatcccaatactttgggaggctgaggagggaggactgcttgtgccaggagtttaagactagcctgggcaacatagtgagaccctgtccctaaaaatatgtaaaaaaaattttaaaataaaaattttgaaatgcaatttgtgtcttaaaattctgccttatttatttgcaacgtgtgtttcttgtcatgtatttgctgctgtatgctggtagaaaaagcatagagagtggactcaggcagtccatgctctagcctcctgttctactctgaactagatgtgtgacattgtaagtgctgctgcttcacttcgggtgttactcctgatttgcacagtgaaaagtgttttattacaagatgatttctagaagtttgtttctgttctgacattagatgacctgtgatatgtgaagcttaagacatcttttttcattactgggtttatacggggtgttgaggcttgtgatacatttactgttataaattcattttaatgtgtttggaggacttgagatgattggagattattagattgatagctgatgtttggctttattattggaaaatagttctagctacgaaacctgtttttgagtgaaagtatgctaggaatggccattgcttttcttcctacagagataagtgatctcttggtgttgtacacatgaagctctcacctttatttttaaagtcatggattttaccttggctcctataaactcttctcccctcccccatgtagctgtaagcattcctactcctaggatgatttggaatgtgtgtgtttcaaatcatgtttagtgattgtaaggctaatctcagcttaattatcactgccaaaggaatcctctgacccccagggccagatcatgttgtttgctttcatggtatatttttcccttttcatagtccgggttatatatatagatgtataattccataatatcttgtcagcaaaactggaagctctgggagggcagtgactgtatctcttttgctgacttttatctataatgtcgggcacatgattggcagcattggagacatatttttgagttaagtgaataaattgtttccccacaaataataaattaatagaaatttaatggtaaaagctcaaaatgtttattagaatcatgatggtagcctttgttattaccagtgaatttaaaaggaaagaataaccaaggtgtttgtataaatgacttattattgtttgtgcaagaacagtgaacgttccctagtacaggaagcagctttaaaaaactgctggcagaactaagaagtcagactgtccttgacccctagatcaaatgtttttgagcctgagtttccttaaatcttcttcagttgagaataaacattttgacaaaatagaagatttattctgttaatttttggtcttcataaacctaactaaatttgctaaaacaacaaaaactttctaatttttactagttttgttttttaaaaagtttgtttccttttaagtgcataacactttaaaatgagctcagctgtattagcagataaacatgttgattcatttggtccagagctactgaatgaagcttgcaggagcacagtttgttctttatgccgcccaggggcagaatgtttctcttcctctcctccttattgagagaaggggactggaataagtgactcctcttatttaggtttgcctgaattgttgacgagggaagggggcaagatttcttcaccatttatccttcgtctcatttaaattctgttcattaacataaagtatatgcactcatactgtgatatacatgttgaattattagtgtcatatatttacagtttttacaaaaccattttacttaatgctctggtttgagtaatctgttgtttaaaggtataatgaatcagagttgtttttaggcgtattgcgtttttgaggatggacttaattttggaagcaaagagaagtatgttctatccagtggagtggagttgagataataggtatgcagttcgcctctcatacccattgtgggttctgcatctgtggttctatcaactgtgtgtcaaaaatacttgagaaaaaaaaaaaagaatggttacgttcatactgaacatgcatagactttttccccttattttcccctaaacaatacagtgtgactatttatatagtatctacattgtattaggtgttttaaataatctagagatgatttaaagtacaggcctagcttgttttattgcactttgctaatactgcatttcttacaaattgaagatttgtggcaaccttgagtcgagccagtctatcagtgccatttttccaagagcatgtgcttatgttgtgcctctgtgtcacattttgggtaattcttgcagtatttcaactttttcgttattattataccggttatggtgacctatgatcagtgatctttgatgttactgttgtaattgttttggggcaccacgaaccattacccatgtgaggtgatgaacttaataaatgtgtatgttcttaatgatccagcaactggctgtacccctgtctctctcactcctgagacacaacaatattgaaattagtccagtcagtaaccctaaaatggcctctacatgttcaagtgaaaggaacaatcacacgtctctctggaaatgaaaagctagaaatgatgaagcatagtgaggaagctatgttgaaagccaagacaggcaaaaagctagtcctcttgagccaagtgaatgcaaagggaaatttcttgaaggaaatgaaaagtgctattccagtgaacccatgaatgataagaaagcgaaacagccgtattgctgataaggagaaagtttgagtggtctgggtagatcaaaccagccacaacatttccctaaaccaaagcctaatccagaggcaggccctaactctctttaattctatgaagagagatgagaaagctgcagaagaaaagttagaagctaacagaggttgattcatgaggtttaaggaaagaagccgtctccgtaacataaaaatgcaaagtgaagcaatcaatgttgatgtagaagctgcaacaatttatccagaagatctagcgaagatcattgatgaaggtggttacactaaacaatagattttcagtgtagacaaaacactcttctatttggtgaagaagatgttatccaggacttcatagctagagagagaagtcaatgcctgccttcaaagcttcaaaggacagtgactttcttggtcgtagctaatgcagctggtgactttaagttgaagtcagtgctcctttaccattccaaaaatcctaggacccttaagaattatggtaaatctgtattctgcctgtgctctatcagtggaaaaagagagcctggaagccagcacatctgttcatagcatggtttactattttaagcttactgtggagacctactgctcagaaagattcctttcaaaatattactgctcattgacagtggacctggtcacccaagagctctgatagagatggacaaggagatgaatgttgttttcatgcctgctaacacaacatttattctgcagcccaggtatcaaggactaatttcaactttcaagtcttattatttaagaaatacattttctaagggtatggctgctgccataggtagcaattcctctgatggccctgagcaaagtcagtgaaaaactttccggaaaggactcaccattctagatgccattaagaacattcatgaatcatgggaggaggtcagaatatcagcattaacaagagtttggaaaaagttgaatttcaaccctcatggatgactttgagggattcaagacttcaaagaagaaagtaactgcagatgtggtagaaatagcaagagaactagaattagcagtggagcctgaagatggaactgaattgttgcagtattatgataaaacattaatggatgaggagttgctgttttttatctgtttattaaaaagatttttttaaagacaaagtctcattctgttaggctggagcagaatacagtggcacgatcctagctcactgcagccttgaactccctggctaaagcgatcctcccttctcagccttctaagtagctaggaccacagtcacacaccactgtgcctggctaattttttaaaaaaattatcttttgtacagacagggtcttgctttcttgcccaggctgttttcgaactcctcgcttcaggcgatcctcctgctttggcctcccagagtgctgggaatacaggtgtgagctaccacccctggccaggcattgcttcttatggatgagcaaagtaggtggtttcttgagatggattctactccttgagaagatgctgtgaacattgttgaaatgacaacaaaaggatttagaatattacataaacttaattgatacagcaatggcatgatgtgagaggattaactcaaattttgaagaaagttttactgtggataaatagtatgacacgttacagagatatatttcataaggaagagtcaattgatgtggcaaactttattgtctcattttaagaaattgccacagccactctaaccttcagcaactgccaccccaatcagtcagcagccatcaaggcaagaccttctaccagcaaaaagtttatgacttgctgaaggctcagatgatccttaattaaggtatgtgcattttaaaatcataatgctgttacacagaagactatagtatagtgtaaacataactgtcatatgaactgggaatccaaaaaatttgtgttactcactttattgtggtggtctggaacagaacgtgcaatgtctcgaggtatgcctgtatacaggataatgtgtgtaggttatatgcaaatactataccatttgatataagagacttgaatatctgtggattttagtatccttagtgggtcccggaatcagtcccccccacgaatacccagggatagctgcactcacacataatgaatttatagtggaaattctatgaaatgtatatagagttgttataatatacctaggatgatcattggtatttcggaatagcttttagaatatgaccaagatacatgacatctactattatataaacctgtgtttgtttcagcatgtttttttcctatgttttgttccatgttagatgtcatgagtttgcaaagtataataagctatattccctgccttcaagtagcttaccatccatgtaccatttcccaaagtgtacatcattagcaggtaggtattcctcaaaaatagattattgtctctgattaagtttcagagatacctggattaatcaaaattgaaagtttttttttagaatagggttctcaaatgcatacattagggaattccagaaagcgactgtatgttgcaaggttttccaagctttgtcgacacactattttttttctcatgaaacttctgtggtgggatctgaggggaatggaggtggggaagagagtggcagtggtgtttttaggaagaagattaatgtaggagaggagtgggaggaacacctaggacagtagctgtgtacctggcctaggttcctcagtccagatggtagcaagtctgaagacagggagagacttcttccagaagatgaaattcatagaaacctgaggcaaattggtatactcaaaggagctttgtcagactggagagtctggggtgaattgggataaatatatagtagataagtatgtagaaaactaaagaaatgagaaacaaattattaattgcaagggaaacaaaatgttatgcaggaaaagaaaagtaattattgtttactgcttggttcagctctgaataccctatgtagttataatgacataagcctcaaatattgatctaaccaaagttaggattgtgttgagacatcgggggtgggaagtgtggaggatgccaggaccaggaaacagctatatctcaaatttcctcaactggcagtcactgaataaagaaagcttttgggaaaaggaaatattggagagggagctgggactagtttttcataacaagccttgtagatctagttaatttaaaaaaatgtgcatgggtaacatttatttttacctttatcagatatttttctagatcaaaatttttacaattgttttagcttctcattgaaatgttgtcttactaggttaaagtttcacgtgtgtaattggatttgaaaaatgtaaattcactttgtcgttgcctttatgatttagctacaaagatcttacttatggatgagatgatgactggcagttattccacaccaaccactctgggaccaaggttttctagattaacctaatcctacagtccttttattctgtgtttcccactcctacattttaaactttgtatctgtattatgctcttctgtgcttgttagaatacacactgtgttctcaggtcagttcttacatgggcctcttcttttttttgccttctttaatttccttttcttcacagcttttttagcatgtcagtagcagagctgactttatgtagtgagaagctactgtgtgcttctctcttgacccttctccccaaacatggatggaagggcagaacaagagacctgtgggtgagtaggaagggctgaggaatgccatcaccctccagcatttctggttcaacagcttctaatcatttttaccatctccaccgcgcacccccccaccccgtgcttttaataacttcaagtttcatgattgactggtttacttttatttgcttattacatacttatttgttggattcagagctcttaattgttagtagaaatgaacttactagttaacttttgctaatttaagtataaacagaattaattgaagatatttgtggtttcttgagctgatggaaaggccaggctattaagattggggctgcacagctaggaacaacaataccaccattcctaaaatagctgtagaacaacacttaaataactgactatcctgcttttaaagactgctattctttttttacaaacttgtaggttgagaaatttttacttctattttcaattagaagtctttgggaaaattatgggatgactggatttgtgtatatctataatccagagataaggaaaaagaggaaacacagattttcaggagatggaagcataactttgttctgctttgtgcttgaatacctctttttgatcagggttagaggataaccttaggtcagtgcatttcccttgtgtttttgttaacaaaacatagttcagatcccttgattaaaaccctccactggtttcttgtctcatgaagaagaaaaaatcctaactgttcttgatgatctttaaggctcagaatgatctggacagaggtatttaccttgaagctcataaagcataggcctttctcacttgcagagtatctttctgaagctggactaaattggttaaggccactgtacttttccactttgtcttctttcctgtcacacaccctatcctttcaggctgtgttgggatggacaaaagcagttctggagtcctaaggagaagatgagtgggatatgtttctgtgacctgcagtcattttaaagtttagctgttgctagctgactccatgtaagaataccttccaggaatttgatggctgtgcactctggcagtgcagctggcatggttatagggtgcttggccgaaggtttgcatagcaatatgaacgcatcctacgacacatctagccaacactggaagactgtgggtaatggacgagaaaccaagattgactttttgcaagtttttaaaaataatcttcttgtaactcacatgtgaaagaaacatgagaggttttcacaaattcagtaatttgagacatttacatagcatcaccaatagttgtgaagctgaaactttagttctaaactataagtagtaaaaaaaaaacgttgattctctattgtaaacaaaagacaactattttctgtgttctctgtgtagaaaattatattataaaattgaggtggggctgggcacggtggctcacgcctgtaatcccaacactttgggaggccgaggcgggcagatcgcaaggtcaggagatcgagaccatcctgactaacacggtgaaaccccgtgtctactaaaaatacaaaaaaaaaaaaaaaattagctgggcatggtggctggcgcctgtagtcccagctactcacacctgcggctgaggcaggagaatggtgtgaacccaggaggcggagcttgcagtgagccgagattgcaccactgcactccagcctgggcgacaaagcaagactccatctcaaaaaaaaaaaaaaaaaaattgagttggacagtggcttgtacctgtaatcccagctacgggggaggctgaggcaggaggatcacttaagccgggagttgaaatccagcctgggcaatatcgtgagactgtgtctctacagaaataataataaaaaatagctaggcgtggtggtgcactcctgtagtcccagctactcgggaggctgaggtaggaggatcccttgagcccaggcctttgtggctgcagtgagctatgattgtgccactgcactccagcctaggggtgggagggggagcacaggaggccgtgaaggccagccctgctggctgtggctactgtgcgtggaccaagagcatgtgcagcatgagggctatggtggtgcccagagagcagtgtccagcgtgagggagattgtggtgcctggagacctggcagtatcacccggcatgagggagatgctggtgcaccggctgtggatgtgagcttgcctggtgccagaactcggaggggccagactctaatttagtacttttttatgtgattggcagtttctaaaaatttgtaatttgatgtcgtttcctttcttattctgaataaatattcaatttaggacctaaatttgtttttatagttttatgttcctttttttttttgaagagggctgttcccccaattttataagctttaaaattccgttaaaacctggattgacccctgggtttccttgtctgcctttttaatcttgtctcatactcaccccctcattccctgcagtctaggcactttcatctttctgttcctcaaatggattatgtttgttctcatgtcaggatttctgcacttgcctggtctcctctttccttagctttttgaaggatttttcattatgtacttctcaggacgggtgtcttctcagagagtcttagaacacccaatctaaagtatcttttctccctccctcatctctgtcacgtcatccattttgttttcatagcatttatcagcatcttttttatttgtttatatttttgttggctgtctctgccttttagaatataagttcagtgtattaatatgagagctgtattgttcactgctgtcttcccagagtctagaataatggctggacttattagcattcaacaggtattttttggatgaaaaattactaaaaagctggaatttgtacattttcccatgggtttatttataatactagcataatttcttattgttaattttgtgtttgtgtatggtactgctttctattatcaattgtataaactcgtttgatcttttctgctgaaaatgttgactaagttattatttaccattcattttggttaaacatattttgttatagactattcaagcagtcagaagactatagagaagaataaagtgagcactaaagtacccatgtcctagctttgtcgtactttttcaccagattttttttaagaattaaaaattttttaagttaacttttcatttacaaatttttaaatttttttttaaaaattcaccttaattaactgaagtttatgcattcttctctcatcttactcctcatttttccctacttacccagagttatacctagtccagatgaagatatagggtgaggtacagaaggggcctgagcacagaagcttctgtcctgtggagttagggtatgccaccctgctggcacatggatgccatcactaacccagaagttcttcaagccccatggttttggcttttatgtgtagacataattaatcaaatcattggccatcgatgatcaactccatttctagctcctctttccttcccagaggttgagggtgaggtgaagctgaaagttctaaccctctaatcatgctttatttagtctttctagtcactggccattatcctgaaccgatctagggaccccactcaccagttcacttcattaatatacaaaggacactcttgtcactccagaaattcttagaagctcttgttttaggaactggggattgagaccaaatttataataaaagatgctttatcactcctattactcaggaagcgggaagagctttaggagctctgtgctagggacccaggagcttgggaggaagataaaaatacatatttcttgtaatattacaatatcacaggcttgaataccagggtgtgaggatcattagaagccatcttggagggtagctaccagagtctcatatatttccttataaaatacctaaagttctttcacatttactgcttctttaatccacccagaatggggtgtgtatgtgtgcatgcgtgagtgcccatacgtgtattgtgtatggtgttaaaggaatctaatcttttattctttcaaagatacgctaatcgtcccagttccatttgttaaataattcatcagcattgttccatttatatatgggtttgcttctgggttctctgtacttctctgctatgatctgaatgtttgtccttccctacctccccaaattcctatgtcgaaacctaatcccggatatgatagtgttaagaaaaggggctttgggtgaggtgattaggtcatgagggctctgcctgcataaatgggggcaagaaggtaccccagtgaagtagttagcttcttcttctgtatgaggacacaacaagaagggtgccatctatgaagaatgggcccttcccaaacattgaatttgctggtgccttgtacttggacttccagcctccagaactatgagaaataaataagttgtttcctatgtttataagctccctactttatggtatttttgttacagttgcccaagcagacttaagatgttttcctgtagcctatttttctattcttaggccaataccgctttacaagttttgatctctcttaggcaagtctcccctttttgttcttcatgtttggcttggttctcttgtctccaaagggccattaagagagactagttggctgggtgtagtggctcacacctgtaatcccagcaccttgagaggctaaggtgggcagatcacttagcccaggaatttgagaccaggctgaacaacatagcaagactccacttctacaaaaaatacaaaagttagctgggcatgatggtgtgcacttgtagtcccagctgctcagaaggctgaggtaggaggattgcttgggctcagaaggtcgaggctgcagtgagctgtgattgtgccactgtgcagcagcctgggtgactgagcaagaccctgtctcaaaaaggaatgattaaataaatccatcaatccatgtgaattttagaatagttttccaggtttcatcaaaaatcttgttggaattttgcttattttaaggaatataaaaatatgacctttttaacttaaaaagtaatagatacttactaaaggtattagatacatttaaaaaactgttaaaaaaatccataggtctgtcactcaaacatcaacattattgtggcattaggaatccataaagatttgatattgtaaaagtgaaatcatctctgcaacaaaaggtatatactgggtaaaaaatagggttaatattcttatacaatgtgtttctataaatcattaagaaaaagataaatgacccaatagaagaaaggacaaagaatgtgaagaggcattcgacagaggagggaagtacaaatggctaagaacaaataaaaagaggaggaaaatgtgaagtaaaacaaaatgaaccaacgcttccccatttttacagcattgtatatgaaatgaaaaaagttggagacagtcttaagtactcaccaaaagatgaatggacaaatgcattcattcgtactatggaattctaaccaaccattaaaaaaagattatgtgctaacatgaaagaatgtctacggttaactttaaaaatgtaaagtaaaacaagggtttatatatgtggtatcatgtttataaagaaaattatatatacataattttttccatagaaaaaaattttagaaggctgtatagctctattaacagtagttaccaagagtgtaggagtatgccatagaagagactttaactgtattatttggattttttaaaaagaattatgccctactttgcaattaaaacaaatttaaaacatttttggtgtaattcctcttagtgtttgtttttttccctaggcataagtttatttacttatttttttaaacagtagtaatctatagaaaggaacaattgtgttcttaaaatttttcactcagtggaaggattcattcaaaggaatatttgaatgcaaattggagttagaatcaatctaggttataattccagatctactgaaaattttatcttgacataattcagccctgtataaaagttagaacaattacaaagtttatatgctcattactcaaattttaacatttttccatagttgtattatctttcttttttcctcttcttcctttcttccctctgttccctctctttctccccttctgtatatattttaaatatatttatatagattttaaacatatttttaaatacttaaatatatttatgttcaaatatatagaattttttcctgaaccattttagggtaaatttgagacatgatgcctcctttagtcttatatacttaagtgcatgtttcctgaaacaaaagtggtatcctacataattatagttaccaaaatcaagaaattaacattgatataatatggttatgcagatattgccaataattgcctttatagctctcattctacaaaaaataatcttgaatcatatgttgaattcaattgccatgtctttctaataatctttaatcaggaggcacatcatattgatttgtcctagtcctagtaatgttaattttgatcacctggttacagtagtgtttaccaactttcttcttcattataaagttatttttccttctttataattaataggaatcttgtcgtatgattctttgagattatgtgaatatctggttgctcctcaaactttggcccaccaattttggcatccatttagggttcttacttgaatacattattaatgatttatggtagttttctaattctgacattcctttttcattttagttggctttttactataaggaggaaatttctttctccctcgtgaattctgtcttactcaatgggttataatcttttactatcatcatttattttgaaatgcttaaatgattctagattgggcccatgaaagcactttcaggccggcttttaaattcttttgacatgtctccatcaatttttgaggacttgctgggacaacaagatattccagtctcgtcatatactttcctacctctagaagcagctctctagggagctctggttcttcttagtggaaaatagtattaactttcctttatttttaattcttttatttacctttgttcttcatgcagtatttttcttttccttatcctgtcctgatccattctatttttgcatgaataccgtactgttttaatcatttaggttttgtattttggttaattatttatcttattaaatatttctgtgtatttgacactagtgagaaaccactcttgcttgtcccctggaaccttatgatctcctgtttctttttgatctgtttgaatgttcttctcattcttcttttgaattcttcctggatgagatttttaaagggtagagttccctaggattctctttttgctctggaaaaccaggcattgtcactgctcaggtattgctggaggagaatctacactgtaggagtccctacaaactttagagacggtttgacaatatatatcaaacttacaaatgtatcttctcgtttctggaagtggatcctataggtaaacttaggaatgtttgttatgtgatatatacaaggtgattcctacaactattgtgtgtaacagcaaacgatttgaatagtatcaacagtaatccaaaaagtttgttaacatttttctccctttttctattcatatctgcatgaggctggattttcttcatatatgccaagacaacatacagcatcagagtagggaaaagcccaaatgtccattaataggaaattggctaagtaaatcatggtacagcaatacaatggaatattacatagtcgaaaaagaatggtaggatgaggtccattcagtgacaagaaaaaaaaaagaatcggaagaatagtatttatatggaaaatcatggaaaaacctcaatttatgtaaaggagaggagataagatgttatagttgtatttgcttatattgtcataaactctggaatgaaaaacaactaatattttatccagaaagcagggttaaacaggcagatggatgggtgtgatgagactttttactgtatacctttttaacgtttgatttttgacatacacatgtacaatctgtttaattcagttttaaaaaatgatttccagtataacttaaacctagttttgacacagcacacacttatactttgtacctctaaaccattggcctacagcacagtattcttaacacagtatggaaagccttttgtctgtctctataggatgatactctgcaacttccagcttcatcctttacattctagtgacactgaatttctggtagtagttctccacatgtggtactgttttatatttgtgtatgctttacctgtatcttcttcatatcttttaagaatcagtttgtgtcatcttctctgggaagctggcctcaacctttgcaaggcttagttgagtgattcagtcataatactctgtataattgtctattattgctcttatattgcattgtaatcattagcttttttattgtacttagacacagataaccaaagatttgctttagtgtatttttttcactgtattcccagtagaaaagcattaatgtatgttatttgatgtctttttctgcagggtagttgccctgcctcaaacagcttatagtctttaatggagacatgcaggaatgcaactaacataagagagagtgtactaagtgaggtaataggcaaggtcatacttttaaaggaagccagtctttgaaatgaatcttaaagatggtcccagagtccagatggaaacattctaacagggcctatttaggagccccagataatgtaggggtagcttcagtataaaggatacatgcctcaaggtgagtcagggagaaaaggaaaaacagggacagattgtgagaggtctaacattccagtctaaggaatttgaatttgaatattatcttgtgggtgaagtaggattctttaatgcttttgaacgaggaatcagtatctgtactttcaggatgattttatgctttgtgtaatgtcttccaaaaaagatgagagatggggcacctgttaatatattttatattataaagtacagtgttgaatatgggatcaaaaaaggaacagccagccacatttccaaatcccatgtttttgaccagatagtcccttcaacctagaattatgtctcattcaagcagtgtgattctattcatctcaagttgtcataagaaagacaacttatatgttacttccactagtgatccctgataaattccttccaaatgttattaataactgtatcctgttttgactgcattgtatttatttctgttacaatttttctcataccctacctgttttacagtgcaggggtccccaacacccatgctgtggaccagtaccagtccatggcctgttaggactgccccctgccaggccacacggcaggaggtgtgcattaccacctgagctccacctcttgtcagattagctgtggtgttagattctcatagggatgcaaaccctattgtgaactgtgcacgtgacagatctaggttgcactctccttatgagaatttaatgataaatgtaatgcacttgcatcatccccaaaccatcttcactccccaccgcccccgtctccccccaatcccatggaaaaattgtcttccatgaagccggtccctggtgccaaaaaggttgaggactgctgttaaagtgtttgccttaatcacaaccacaattgcttcctcctggaaacccttgttttactttatttaacccactcgggtaacacttattacattgtattactgtctgatggttttctgtttatttcaccaaacatttcttaggtgccagacctcaaggaagtcattctttgtcagttcatgtgtttgactatactacttgattattattagatatacgaattccttaagggcaccttatctttttttattgcacttagcacaactcatgatacatttaggcactcagacatatcagagacatcagcggaacagtactggttaaaagttgagtttaaattctggccctatcactatctcttggatccactgtagggaggttatttagtctgtgtaagctataattttttcttctgtaaaatgggggaaataatagtttccatctgaattagtctgttcaagctgccataacaaaatttcatagtctaggtgttttctcacagttctggaggctggatgtttgagataaggtgccagcatgatggggttctggtgagggctctctttctggcttcttgctgtgcctcacataatggagagtgagcaagctcttttgggtctcttctgataagggcactactcttatgagggtgagggccccaccctcctgaacttcatctaactctaatcttttcccaaaggcctcatttcaaatatcacactagggggttagcgtttcaacatacggattttgttacagtctttagtggagacaagcaggattaattaatttatggaaagcatgcagcagtgtgcctctaacataaaaaatgtcttatttaacctgtcatcatcatcatcattttgacttggcctaaaatttcgcatatgggctagtggagaaaaattagaactaatttggtgattttgctcttcattgatggaaagtatgtgataacattcattaagaagggcaatgtaggaagaaagagacagttgtaggcatgctgtggagagatgcttccttcactgtatcagtagagaagaagatggttgtcaacctcaggtttatggatgaatcctcagtatgctgtaaatagaagaaaagagatgctttagtgttctttatatctatgtggcctttaaaatgcagtcctttaatttgtttttattcaaatctttattttttattttcttttctctgatttaattgatagatcgggtttttcagtgagcctgggaaagcagaagtaccatttttatgtctataaataatactaaatttattttgctggattttgtaaagttctgtattaaacattatggatcttaaatatattttggtattttaaaattagagtataatcagtttctgttctctagcctttggatttagactttttcttctctaagttaatgagtccaggactgattttgttagcctttctggagctgttaagaattcctattctttcgtttttggtagtcattgtctccacatttgctttatggagtcctctttggtggatcccacaggtggggaggagacacaggattcataagatggccggtgggtgagtgacttagaatttgggttagaactggccgggcgcagtggctcatgcccgtaatcccagccctttgggaggccgaggtgggcagatcacaaggtcaggagattgagaccatcctggctaataaggtaaaaccccatctctactaaaaatacaaaaaattagctgggcgtggtggcaggtgcctgtagtcccagctacttgggtggctgaggcaggagcatggtgtgaacccaggaggcagagcttgcagtgagccgagattgagccattgcattccagcccaggagacagtgtgagactctgtctcaaaacaaacaaacaaacaaacaaataataggaacaaggacgggtgcggtagctcacgcctgtaatgccaacactctgggaatttgaggcaggaggattgcttgagttcagaagtgtgagaccatactggggaacatgacgaaacctcgtctttacaaaaaatacaaaaattagctaggcgtggtggcacacacctgtagtcctagctactcaggtggctgaggtgggaggatccattgagcctgggaggtcgaggctgcagaaagccatatttgcaccaatgcattccagcctgggtgacagagcaagaccctgtctcaataataataataattggaatacaatgtgaaatttggacattacattgtcttggtgaaatctgtaaatacaatgtaatggttttgagttttttccttatgtgaattttattaataatttatatggcagagctatcatgccatctgtatgtactaggatgttaccaaaatacatgcagttgacagtttgggaaagcatagagcaaatagtatatcctaagtagatcttttctttggctgtagtggttaaaaagatatccttaaattgtggtttggggcttttcttttttttaaacaacaaaaatttcaactcttaataaatactattttacttgtgataagaaggcaggtatgcttctggaaccacagaaatcaaacttgagagaaaaaatacaaacaattatagagagacagtctctgattaacatgaacataaaataaccatcaggtgacaaaccttttcacaagaaaaatgatctgtgcccaagatcaattttatagacattaactcaaagctgtgattttatacacaaagcagtattgtagcaatggtataaacacaggaaaaattcttgtgaaaggagtggagcctgcaaatgtggaactatgtggaaaagggaaaagtttgtagtatgtagaactatggcaggtgtttatatttcacagtgtaaaaaataaacttaaattgatatactggtttactaatgaatttatgaattttcaatgaatttatgtagagcttattctgttagatgggactaatagtaagaaatactacaaagtaggaaaagtttgtctctaggacccttttgtgaccttttttttcttgctctttcacactcctcatgtaatggtcaccatccatagatccttctctgttcactctgttcaaaagagatctccaagacctgtaggctttgttaagttatcttaaaaatgatgaataaacacactagagtattgatggattgtttcacatttaattgggactcttgaaagtccaaacagaattttcttatggtaaaattcaaacattgacgtctgttaggggagatatttatagagaagagaactttttgagtctgctccttaatttacaacctgttgtcagttgggaaggaaattaacattgttaaatgcttatatgctagtgtctgggtgtctgtgctaggtcatacacagtataatttgattctcacaatgagcttgtgagtatgacattcttattctcattttataaaacttttttttgtggggggcgatggggtctcactgtgttgcccaggctggggcacagtcactattcacaggtgtggtcatggctcactgcagcctggaactcctgggctcaagctatcttcccacctctccctccccagtagctgggactacagcttattcaagttttataagagataaactgaaagaggcatagaaagatgaagtgaccttcctaaagaggtcacagtggaggtaaatcattaaaatcaggatttcagatttcaaagcgtctacttttaccaccaagccagtatttcatagtcattttactcttctgttttactcatactcggtgaacatgacaatatctttaattaccctccagaattcctttacatgtctctaaagagatgattcttcagtttctttttgttttatatatatatatatatattttttatatatatatgtttttattatactttaagttctagggtacatgtgcacaacgtgcaggtttgttacatatgtatacatgtgccatgttggtgtgctgcacccattaactcgccatttacattagatatatctcctaatgctatccctcccccctccccccaccccacaacagcccctggtgtgtgatgttccccttcctgtgtccaagtgttctcattgttcatttcccacctatgagtgagaacatgcggtgtttggttttctgtcctggtgatagtttgctgagaatgatggtttccagcttcatccatgtccctacaaaggacatgaactcatccttttttatggctgcatagtattccatggtgtatatgtgccacattttcttaatccagtctgtcattgttggacatttggattggttccaagtctttgctattgtgagtagtgcctcaataaacatatgtgtgcatgtgtctttatagcagcatgatttatattcctttggggatatacccagtaatgggatggctgggtcaaatggtatttctagttctagatctctgaggaatcgccacactgtcttccacaatggttgaaccagtttacagtgccaccaacagtgtaaaagtgttcctgtttctccacatcctctccagcacctgttgtttcctgactttttaatgatcgccattctaactgatgtgagatgatatctcattgtggttttgatttgcagttctctgatggccagtgatgaagagcattttttcatatgtcttttggctgcgtaactgtcttcttttgagaagtgtctgttcatatcctttgcctgtttttttgatggggttgtttttttcttgtaaatttgtttgagttctttgtagattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtctttgcctatgcctatgtcctgaatggtattgcccaggttttcttctagggtttttatggttttaggtctaacatttaagtctttaatccatcttgaattaatttttgtatgagttgtaaggaatggatccagtttcagctttctacatatggctagctagttttcccagcaccatttgttaaatagggaatcctttccccatttcttgtttttgtcaggtttgtcaaagatcagatggttgtagatgtgtggtattatttctgagggctctgttctgttccattggtctgtatctctgttttggtaccagtaccatgctgttttggttactatagccttgtagtatagtttgaagtcaggtagcatggcatccagtttctttttgaatcaccacatgagaccattctgcttgtcattgattagtcttacttgaaccttttgtggtatttttagctaagagtatatagaaatgccttgttagcagagatgactgacaactacaatattcagttctaaatatattgttaggtttttgttttgttttgttttttgcagatagctaactctgaagtttgtacttagagcaagtaagtattggcaagttatgtgtgaataatgtttggaattattacagcaagaattaacaaatttcttgttatcaacactttagaatagatgtattcagtattataagcagtcttaaaatatccattcaacaaagagttacaaagtacttacatgtgccagggctatgttaggttctgcacagaatagaacatggaaaacacatggtctgtgccctcaatgagaaggtagtttaggagggaggcaaacatgatgtaattaatagaatacactctaataatcatagtaatggaggtgtgtagtaggaagagtgggagcaataggaaaggaatagttaactgcatttgagggactctgggaaagattcagagaagaggttgtagtttcaactgaggcttaaatattttgactacaagaacattcgtggtctgcttatacattttacatatacaacatttgcacaaacagcatttccctcacatgtacatatgaatgcagtatttagcttgaacatctagcctcttcctttttccctgaaatcatgcattatcatgtggattctcctccccccatatatctttttagaagacttctctcagagcttctcagttgtttccctttagttctctgctctccagcttttaaatttctctggcttttggaagcaggcagactctgtttctacagtctttaaaacagtaatgaatgaagaatgacaacggtggtgggaaatgtagaagagaacagagtaatggaactaggtccctgaatatttgatcatttttgctgtcccaaaaatgttttttttttttttctatttagaataatctccaggcttaaaagtgtgactaggtatctctcaaacacaaaatgaagttaagaaacagctgtctggaaaggaacattgtattctgtggtatactattttctggcacattttggttgtaaggctttttggtgatacaaaggattccactctgattgagcttacatatacatgcctatctctgtcttctcatatacatgcagcttctcccagacaggcacattggtggatgttaaagcaattagttttacttgaaaaaaagtatgatactatggcaagagctctggattggaattaggagactgaaattcaggtcctaccttgacctatgattaatttgttctctttgagttagtcagttaacctctcttaggtttcagttttcctgtttattaaataatgggataggataatgccctctaaggcttttcctaccccagaaattctatcattttactattgatggagttggctgttcaactcacaaatctttattgagtgcttctcaccttcaggcactgtgctaggtgcagtcaaaaagagacatagaggagagaagtagatcaatggaatataattgagaatccggaatttaaaccatacatatatggctaattggtattcaacaaggatggcaaggcgattcagtgtggaagaatagtcttcaagaaatgatgatgggacaacccgatttccacatataaaagaatgaatttggactccttacctcacaccatgtgtaaaaattaatgcaatgtgtattaaacacctaaattataagaactaaaactcttagaagaaaacataggggtgaatctttgtaattttggattgggcaatggtttattacatttgacaccaaaagcacaagcagtcaatgaaaaagaaagtatacttcatcaaaataaaaaacttgtatgtcaaaggccgctgtcaagaaagtgagaaggtcttcaggaaacaacaatttttaagaaagtgaaaagaatagagtatgggagaaaatatttgtaaatcatgaatctgataagggcctagtatccagaatatattaaaaattcttatatctcaacaatgaaaagacaacccaattaagaaatctgaatagacaatatgaatattttctccaaagaagataatcaaatggccaataatacatgaaaagatgctcaacgtcattagccatcagagaagtgcaaattaaaatcatgtgagatatcaactcacctattaggatgtctgtaaacaatgataaacagtgttggtgaggatatggagaaattggaatccccatacgctgctggtaggtttgtaaaatggtacagctgctttggaaaacagcagttcctcaaaaacttaaaacatagagttgtaggtctcagcagtctacacctgggtgtatttctaaaggcatcaaagtcatatggttgtacaaaacttgtatgtgaatgtttgtagtagtagtattcgtaattgcctcccaaaccacaaatgtccaatcaactgtagagtggataagcaaattatgattattcataaaatggagcattattcagacagaaaagaaatgaaataaccttgaaaagctcggctaagtgaaaaaaactacacacaaaaggctacatattgtatgattcattaatatgaaatatccaaaataggaaaatccttagggacagaaagtggtttcatggtcaggagatgaggggatgagggaatggagaatgactgctaatgagttctggatttatatttggggcgatgaaaagttctggaattagtagtggtagttgcactgccttgtgaatgtaataaaaactatggcttgtatactttaaaatggcgatttttatggtatgtgaactatcgctctctttttttttttttttttgtggcggatcactgtcttgcccggactggagtacacaggcgtgatctttgctcactgcaacctctgcctcctcggttcaagtgattctcctgcctcagcctcctgagtaggtgggattacaggcgcatgcctctacacccagctcatttttgtatttttagtagagatggagtttcaccatgttggtcaggttagtatcgaactcctgacctgtgatctgcccacctctgcctcccaaagtgctgggattacaggcgtgagccaccacgcccggcctatatctcagttttttaaaagttgtggcacctaactaaaatgaactgtttttgatagggatagagaagggttctgtaggagtatacagaatgacattttgacctactgtgtgaagttgacagcaaactcctgaaataagtaatatttcaacagagacctgaaaaatgaattggagttactcatgtgaaaaaactgttagcaatggaaatgaggaaacatgtaagaatatatcagttaaaattaacagctgaaagccaattttagctgtaacaggtataagctcctacttgtgtcactatgtaagattttgtcaaagactttttgccttaagtaatgtaattatccatggagaaccatagcaatataatatttgttataaaatatatatattatatatatgtatgtatatctcctagcttctggggaaaacagggcatttattttttattttttgattctaaatatttttaaattatagtttatggcattttataattttaaatattcttgaagccagaactaaattctagagtttgtttatgctttatttttttccccctctctatatattttataaggcaattttctaagctttgatcctatggaaattttaccgttttcattacttttgacagtttgagattagtttcagaaccctgtaagcaaatagtaaatataattagggaaaattaaaatatttctgtttcctggtaggcaataagacattaagaaaaaaattcagacttataccaaagtagaggcaagtataatcagcacccatgtaatcatcaccagcttcaaaaattttcaactcatgaccaatcttattttatctatatatccacttactcctttacccactgggttattttgaagcaaatctcagatactgtatcatatgtaaattttttatctctaaatgacaaatctttcaaaaaatatatactattgggtatttttttaacttgaaaatacttctttcttgtgaagtattaattaaaaagttatctattagtggaaatactctatatagttttttatttgcttatatatccattctaataaatattaggtatgtttataaaaataataaaattgaggttatgagaatgtggttcatatattagtctatgctcatctttgtgattaattatgatcaacgaaaccataggcatgataaaactcttctctatagccactgattatctccttttatcataaccaatggccttaactctgttatgccttctgggtgtgtctatcatttaatttattgattgccccctcctcattgaaacattcatctcccatggcttccctgatgtttggctttcctgtttcattgctgcattggactgtgctcttttactgacatactttcttttgatacctacataatgtgactataacccatccttactctgttcttgagccttttctgccctctgcaaattcttagctcttctgctgtcatggctacaaatcttctttgtgtatcagtgaattccaggtacttattaaaataacaaatcaaagaacttctctttagtgttgtagttgaaaaaaacttccccatgggtatgccattgtcatcataagttcagatttttaaaaactgagattatcttctttttcattaatatcaatttcctttcagctttcctctactgacaaatcaccagactagaaacattcatatcttctacctacttcagtcccctgtgcacgtgctattatcttctactgttaattattccttcaaaatacatgctatttatgttttcatttattgcctattctaggcattttcttcttctaggaaacttttcttcactactctagttgcctaaatgttcatctctgtgattccataaagtctatgtgttctccacaatcaagataatattttatgtgtcttttcctcatttgaattcaagctcttgagtggctgagattggagattgggggttgtttatgtttgtgccatagaacatgagacattgtaatgtttgttaaatgttaattgaactcctaatctctttacctgtattactgcaatatctacctaaggtcttgcctttccctggcagaacattgtgtataaagtaatcttaattctttgtgaagccaatgaagacagtagattctctattaaagtaccctgtacatttccatcataggactaattgcaatttaaaattattattaattttcttttttattttctttctccccctgggataccctctgtaatggtagtcttacacacagtagggccttagtaaatgtttattgaatatgaatggatgcccctcctcaccagttgagagcagtgcacatatatgtaatacaaattatttaacagtgattacaaaccttaagcctttgctctatttgctaccagactgattttctaaaatagtgtttttaaaagttcactcaaacttactctgtgccagacttacaataagttttgagaatacaggcacaaataaagacataattcctgcattttatggaatttggaaataaagaggaagaaatgcttaaacctctttggacaggccaagaaaagctttgtagaggacacctgatatctttaaggttcttttcagccaaaaaattgtataattcacaggtgcccttttctgtggcagtaggtaaaaaccttggtagctgcaaagagaagacagctgccagcagggtatttttggctgttcctgaggctgccctcattctgattaacttgaacgtttacttcggcctgaggagtaactttgtaacttaaatctaatttcttactaaatagagattatttttagattatccattattttgttagcagagataattgaaaggagaatttagtaatgttttctgtgactttactgaagccagttcaaactttattgtttaatttttgtttggttaacaagggaatcaggagacattagcacttcctactaataatacatcatataacttatttatcctgttaattttctctttcaatcccgctagaatgtaaactctataagaagggatttttgttcttcgctcaataaatatttgtgaaatgaatacttaggaagtcattggtagccttaccagggtagtttaaataaagtggtggagatggaagctggtttacatggttgagggttgcctgggtttgcggttcaaaatcaaacagtaatagtagtatttttttttcttttccttttgaaagtttggtggtaaggaagatatttatgaaaattctcttcttagtcacttctatttctttttactgctggtaacttataaaggcttttaaaattaacaagtcctcttgtttctttttaaaatttaaataagttttatacacattaaatgtattactgtaagccatataatctcaaatacttaggactttttagatttttagaataagtaaaacttttaggtatttttctctttaccctaaacacagccgtgaaatgatgtatcaataagtggttttggattattttttaacatcaataaatatgcaccaaaagtaaatatatgtataaatgaatttacattattcagaattctagaattagacatctgtctaatgaatgctgttctaaatgttgctaaatgattaatagtaattaaaaggttaaatacaagctggagaaagctttgaattttgaaatgtttgcaacagctagtaatctgactgatgcagacgtttttgtcaaagttgaaaaagttagagctaattaatttcttgggagacatatgatgagattgtaggtgtgataacatatttgagtaacatatggtagttatggggcacctttctaatgactgagcagccagttaaatatagacttttttggttttatttattttattaccattctttgttactgtgtatttttaaaccaattttgttttctgtaatagaggtcagtactcgggattttaacaatttatatttaaaatgttaataggaatatggtacttctctttgaaactgaaataaattttagtgaaagttttcttaaaaatacagctatttcctaccaacgtatttgtgtattatacttttaagattaaatcaaatgtatagggaattgtactctcagtacacagtgtttcactgagattactattgaatgagtacttaaaaaatgttacttttgatacacggcacaaatgtatttttttcccataaggattcattatttgcattttgactaattttcttccagccccttttactttatagagttttatttcagtttctgaatattaataatgacaaatgacaacagattaaaagggaattaaaattatttttatatctgttattaaaatagtatcttaacaccttggtagagaaaattttgacatgagaattttgcaaatagaggcataaagtagcgacttagatgtttttatttttaaagtttggaattttaccaaaatttatatgattgtaatctgttgtataagccccaaattttctgtcattcagaaatatcggcagtgaaatccgagttcagggtaaaaatgtttctgttgtgctgcagagccagccactggagggtgttcatgttaacttcgtagtctcagtattctgctgattagattgatgaaaaagtgaagactgtccatttacaagtcttttgaaattaaagcaaaagtactattcgtgtctgaaatggaaataaacagaaaaggagttttaaaccttaaaggaaatatgatatttaaattctaaaattagtaagcaaataactttcttttgctttttactcaaagacactggtcagtaataactgtaattttgaatatacttacaaaattatatgcagttatgaggttctgataagtacacaaacatcccaaatttatttactaaacttttttgacattgttctaatcgttttcatttaaatttgagtatgctatagaattttgatgtgtacatctgctctgtgactccttccttattttaaatctgttgcaaaattttccccaatcagttggcatgcttttaagccagtagtgataaacagatatccatgaagggctggtagagtcttttgtcctgaatgggttttgagctcaagcctaaagtaaatattaaggtgaacttccaagtgattcacagtaaagcactagcttctcattcattgaatataattgataaagtttgtattattacatagttatgataggattttaaagacagcaggattctctgaaatatagcttaccaattggaaaattactttagtgtgatgtattctgaggctgtaaagtttatatcatttttaattgataaaattgttctaagttcttattagaatcttgagaaacaaaaattctactgagtaggctgtttattcactttttaaaaatgtatgcgaatttcagtagaataaaatgatgatttagaaattggttttagtttattagttaacagtagtaaaataaactttatattgtttttctttattagagtaataagccgtacaattttgtatagctagtaggcaatacttaatggagaatgaggggataatttttcattcagtagaaaaatttgatatttgatttcatagttgagtaattatacttagaaatatcaattttttgctttcataagttgttaaaatattttctactcagataagtctgtctttatgtcataaagtaagtaaatgacagatatcagatccataagccaacattaaaattcactataatatacttggccctaatcctgaaagctctggttcgttctagaaatgtttctggaacagtgagtacatgattttgggagattagaagatttacattttaaatacagtgtcaatgatctttaccttgccatgcataaattgtgttgccagatgtgcttaggtcaatgttttaaccattcacatatcctgtttattttatgaaattatttcatgagtcttgaagtgggacttatgattgaaacgaagggtttgagagaaagtatgttaatagtcttattaatagtacggaaaacagtccgtttggagcatgatgcgctctgtcacatagaaacagtttttggatgctttcatagccatctgtagagggtggatcattgattatacatcagtcagataaaaaagataattttgacattatctcttcttcctgaaataccttgcttctgaaaaatgtgtgttagcttgatcaaattattacaaaggagtttcaaagggggtatttaataaacatattacatagcaaatttattgtctatgatttttagtattttctgttgacataaatttaggaacagatgatcagcaatctaaacagaataaatgattatttttcccctctaggaatgaaagataactttaataaacataatttaagtatccatttcacatgatttagtcactaaatacatgccagaaattcttagacactcagaattcctaagaagatattaaacgtattcttcagaaatttgggggtaactgtagatgtttttattcatttacagttgccaggtatcctgaccaaaatgtgttattttgacgtttagaaattgtcctagcatcccaatttcttatgaggtactcagtttggattagtgacagtgcaacgttgagacaagagagattccaggataaaggaatcaaaattctgtgcctttttgcttcagtaagaaaatacttattatatttcttaaaatgtgtacatattttttaaagtacattcatctttccttaaaaaatttaacatcattaagttaatagtatctcttcccagctaacagttacttcttattaaatatccaacgtggtgctatgggctttgcttgtagttgtcatttaatgtgtttaaatggttaagggtaaagtaactcatgtgagtgggatcatacaatatttttccctttgtgactggcctatttcatttagcttaatgtctttagggttcacccattttgtaccatgtgtcaaaatttctttttttaagactgagtaatgttccattgtatgtatatgccacatattgtttatccatttatccattgatggtcttttagtttttatttgtgcgaaaatgcattcattttttccatatttttaaaggatgtttttactgagtaagacagttctaggtcagggtttattttcttttactcactgaagataagcattcctctgtctaaattatgatatttagcttgtccattgagtctttatttttggacatcgtatttttcagttctcaaaatttgtttctcttccaaattagacatgtctcttgtatagttttatatttcactgaggaaaatttcaagtttggcttctgttttcttgtacatagagtaaatgtagttgtttcatttacactctgtgtctgatactttcagtatttgaagtccctgctctggtgtcttggcttattagatgctggttataaatactggctgtgctggttattattcatgttagttatgttacataaaggggccacagatactgacccattgctctaggtgaaatacagggctgggttcttgcaagtctctggtcacgtcttcatcagctgatcaattacataacctggttttatgtgtgtttctgtttgaggacatcttatttaatattatttattaattaacattgaactcatggccatgaacactataactcatgcctgaatgaagcttatttaaacaaacatttattctccataaggcatatcatagccttcttttgctgagaaacactaggtgagacttcaacactatacatgagggccattaaactgaaatcaccaacaggaagcacaaaaatgtgaaaaacatggcactaaatactgtgaaaaggacattgtttgtaataggagagctgaaggaagaaggctgagtgacaccttgttcagcctcatgtgagaacatgggcatcagtttattcaaatttttttgctgctctatgcctgcaaatgacccctaaagcacccagattttttatcacaaataattttaggtgagtaggtgaatttgcaaatacagaatccatgaataatgaagattaaatatgttagctgggcatagtatttgaaaattatttgtagaaatatgaagccttgggttgggcatggtggctcccatggtaatcccagcactttgggaggctgaagctggaggatcacttgagactaggagttcaagactagcctgggcaacatagcaatatcctgtctccatgacaaaaaaaaaaaaaaaaaaaaaagccagatatagaggtacatgcctgtagtcccagctatttgagaggctgagataggaggatgcttgagcccaggaggttgaggctgcagtgggcaaaggccacaccaccgtactcctgtctgggcgacagagtgagaccctgtctctaaaaagacaaaatgaagccttgagtaaagttatcttcatttaatatctgctggatgccttggatagcaatctaggagtagcctaacccaagtttaaagcctaaagtttcctggtccactcaggtgacatgaatctagggtgcagatctgtgcaagatttagtttattttttggttccccattgacattaacgatcagccatttgtgatttcagcttaatgtggcaattgacttatcagagtcctaattttgtcttacattttaaattgttctcagtggagtattcatctgaattattcaatctgatatttacagaagcagaaccttccttttatccttcttaattttaatttctcctgccttgtgattttcgtattaccatctcctctttttccttcttctttcctaggtttgtgaagcatttactacagttgttataagattaaataactgttctcatttaagtacatttcttaaacttacactaagatgtgaccttcagattgctttaataatgtaagaaataagttcattttaaaaagaaatctggatgttggaacaagaccttgaatttttattttttttttctttttaattcataatattattcattacccatcatgttattttgggaaggtatagcataaaatatgatttagtaatttagctttcacctaagtttttattgtactttatgatataggactggctgtcatgaaaaagttaaatttgatggacattctctcatcaaatttgtccttgtattattttattttatttttaatttaatttaatttaatttaattttattttttggtgagacagggttttactctgttgctcaggctggagtgcagtgcagtggtccgatcatagctcactgcagcctcgacctcctgggctcaagctctcctcccacctcagtttcctgagtatctgggactactggtgcacaccaccacgcccagctaatttttgtagttttttatagagacgaggttttggcattttgcccaggctggtcttgaactcctggacccaagtgatcctcctgccttggcctcccaaagtgctgggattacaggcatgagccacctccctttattctgtttttcagggagcagccccactgatcctacttaacttaagtcagaatgatttggctcttctgctcagaaacctcctgtagcgtcccatatcagtaaaagccgaaagtcctttcaggaatctataggactctagatgaggtgtccccaacccccagcctgtggacaagtactggtccctgacctgttaggacctgggacacacagcaagaggtgagcgagcattaccacctaagctccgcctcctgtcagatcagatgcgaggttagattctcataggagtgcgaaccctattgtgaactctgcatgcgagggatctaggttgcacgctccttactaactctaactaatgaatctaatgaaatctaatgcctgatgatctgagtggaacagtttcagcccgacaccttctccccctacctcttccaaggtctatggaaaaattgtcttccatgaaactggtccctggtgccagaaaggttggggactgctgctctagatgatctggctcctcattacctctctgatctcagtttctgctacttcctgcttcatgctcttattgcagcttttttgtcttcctggaacatgtcaggcattttccatcttaaagccttgctattccctatgtcaagaaaactctttcccacaggtatctatatcgagcttcctcacatcgttttaattttccttaaaagttgccgtctcaatgagacttcccttggttactttagtcttccccaaagtattatattccctcctttgctatatttttctcctagcatttttcgtactatataaccttttttctcccccatggaaatataaactccgtgaaagcagtgatttttgtctaccatcctcccagtgcctgtcagagagtctggcacttaatatttgtcaagtgaataacaaatgcatgaaatttattaccataacctatttaagagctttaagtgttaattagatagctgggtgtggtggctcatgcccgtgatcccagcactttgggaggccgaggcgggtggatcacctgaggtcaggagttagaaaacagtctggccaacatggcgaaactccgtctctactgaaaatacaaaaaaattagctggatgtggtggcgtgtacctgtagtcccagctactcgggaggctgaagcaccagaatcgcttgaacctgagaggcggaggttgcagtgagccgagattgcgccactatacttcagcctgggtgaaagagcaagattccatatgaaaaaaaaaaaagtattaattagataaatctgtatcaaaaagtaagtagagactgcaagtgtaagaactttgacattgcatttatttttattttgaaataatttcaaacttaaagaaaagttgtaagaataatgctttttcttctttatctttttttctgagatggagtttcgctctttgctgcctgggctggagtgcagtggcacgatcttggctcactgcagcctccgcctcccgggttcaagcgattctcctgtctcagcctcctgagtagcagggattacaggcacctgataccacgcccagctaatttttgtatttttagtagagatggggtttcaccatgttggccaggctggtcttgaagtcctgacctcaggtgatccacccgcctcagcctcccaaagtgctgggtttacaggcatgagccagtgcactgagcacataatgctttttctaatgaaccatttgagagtgagatgctcctttactgttgattactttggtgcatttttgtagcattgacatgctcttatgtaaaaagagtataactattaaagcaagatattaatagtgatatatcaatcactaccatctgatcatcagaccccattcagattttgccaattctttcgataatgtctttcattgcaaaattctaacccaggatctgtgcatttgattgtcagggctctttactctcttcatgtggaatggcttcatagtctttccttttatggcttttatgcttttaaagattacatgccagttattttgtagagcatcccataattagagtttgtctaatgtttcttcctgattagatgtaggttatacatttttggcagcaatgtcacaaaagtgatgttttgttcttattgtattctgaattgatactcaattttggtttattccattattactgatgttaactttgatcacctgaaggtagtgactactagttttctccactgtagaggtactcttttgtcctttgttattattttctaaggaggtaatttgagaccatgtaaatattatgtttctctttgactcattagttttagcatttattgatgtttcttgcctaacttagttgtgactaagatgaatgtcaagtggtgactttctaatttgttgtttcttcaacattcattagttgggattctcttataaggaaactctccattcatagattcattatttatttttatcaatatgggctcatggattcttgttttattcaacaaatgagtcatagtgttttcgtattatgtattttgatatccagattgtctcagatgtggccagcgggattcccttcaaacttctgtgccctttaacatgtccccatcattctctgagcaccttcttactctctggcacagtaagatggtcccagctccgcttgtgatatccctgcttcagccctggaatcagcagttttccagagactcttgattcttttttgtgtggagaatgatatttagaaccctaaatctgggtatcaattgtgttccctgtattgagtgtcactgttgtcaagctctttcattaaaaataaaattaggaaataattgtatgacatactcacttattcttacgatttctgcatctgtatattaaaaactgaatttgtattgacatttcaatttctatctcacaccaaagagtccattctagcttcatcctttttatatttgtaacttccagtgagaaacaggggttcagttatctacaatatatgacttatatggttcatcttctgtatataaccaatctctcaatcatgctggccactacttcttgtggtcacttccttgattgggcttgacccttttctcctagcttccccctacagtaccagcagattcttacttcctttggccatgcctaaatacttaagaaaagaaaggccttcacattttaatgcatactttggggattcccatatcccaccaaagcttatgctttgatctttaggtggaattgctttatgataaaagggttcttttactgttcattttggatgatgtggatgagtcttagagttttattctggtctttacaaatatgatttgctattttctaaacttatctaatgactaacttaaggcttgttatgataagattataagaaaacactttggggaatcttgagagttttctttgtaattataatttataattctgtaacatagagaacatgattaacatgaagctctaaatgtatccaatagttttgctttcttatcagtgaatctatcagtatactagtagtaactggagaatttcaaagatatgcttacactttaaaccctcaatttccagtgcttcaggtgggtttgcacatatgacaagacaggcaaggagtaagaaggagccagtataagaattaaaaaggagaccgggcacggcgacttatgcctgtaatcctagcactttggtggccgaggcgggcagatcacttgggctcaggagttcgagaccaccctgggcaacatggctaaaccctgtctctactaaaaaaaaaaaaaaaaaaattaaccaggcgtggtgtcgcccgcctgtaatccccactgctctggaggctgaggcatgagaattgcttgaacccaggaggcggaggtggcagtgagccaagattgtgccactgcactccagcctgggggacacagcgagactctgtctccaaaaaaaccaataataattaaaaaggacttgagtgatacatttattaatttggcaaatatttattgatgatttcctacatatcaagctgctctgctggaagactgtaagtcaaaatagggttcttgacttcatggaatggtttcctcacttcagcatttttgaacccgatcattcttcctcgtcatagcaggctgtcctgtgcgctataagatgattagcagcatccctggcttctgcccgtgaggtcagctgtctccagccttcttggcaccgggggctgctttcatggaacacagtttttctgtgaacctgggtggtgtgtgggaggggggacggttttgggatgaaactgttgcacttcagaccatcaggtattagttagattctcaaaggaccatgcaacctagatccctcgcatgcacagttcacaatagggttcgcactcctgtgagaatctgttgccacagctgatctgataggaggtggagctcaggtggtaatgctcgctcacctgctgctcacctcttgctgcgtggcctggttcctaacagccaccatccgcggcccaggggtggggaccctgcacttggtaacagcacctcctatctctccatccctcagcacattggcagtaaccaagaatgtctctatgtgttgccaaatgtccagtgagggtggggagcacatcactactcctggttttgagtaccactgctcacagtaaaatcaaatgcagatacaggcattctacagctaatcattcagtgtaattatcaactgtggtaaatgctaattatggaaagtacagagggccatgagactgtaaccaagaaaataatgactccataataaatttggagttcagtcaaacaaatcaaagtttcccttgagtgtatagtaggtatttgatgtcagaaaagaaacttaagacatggtcttttactttaaggataagctggctgtgtatcttccaaaccagtaccctgttgagagtgaaagcgtgctctataataaggaaactgggaaaataaatagagatgaggcaaattgtacataatctacttccaggctttcattatctacccagagaataagaccagtatatgaaacacacagagaataattcaagacagtatatacattaagcgctaacctatgtcacattattagaagagagggttcattgttacttctccatctttgctttatagaaggcttcatgggaaaagatgggattctagcccttcaatttagttctggaggtttgccataaaatatctcaatgttcctattcagttattttacactctactacctaagcccctaacctgttcaagagttgtgtttgacatagcagacaatagagaacaactggagagtcttgatgaggaatatattatgatgaaatggttacaactcctagaagaaacattcatttctctaccaaccttgatcagcattgaggtacaaaagaacagtattatacaactatcagatgtacatactgaaaggacatttctttcttaaaccaaattctagaagttttttattgaaaacagatttcctagggtcatttgtgtgtatatatatctaaggggacattgttggcttgtttctctttcaatttttaggtcaattttgaagatactagattttgagaaactatgtttaggggaaaggggaagaaactgtaggaaagtgaaaaatcgtacgcttttaggttagtgctaatctgcttacgtaggaactttctgcatccaaataccttgctttatattccctagctttctttttaaaatgttgcttttactttaattttttacactgcttaagaccccatagattatacatttatttaagttcatagtcatggaacttaattacttttaaaaaggtttaggcatgttctttcacttactccttagaagcagttcgcattctttgtgttgcctgtgaaatcggatggtgatatagggcttaaattttgaaatatgggacatttggagaacttaaggcaaatcaaaatggcataacatgatggaggaagcatgaagaccttgtgactggtagaaacaacaagaggatgtaggaaaagactatgtattgggaaagggggtagaaactatgccaaaattccatttgcccacttcagatgtctgcttgggacgaagtctgtgcctgggaaaagggatgaaaactttaacttcctttccccccacactttcatcccaagagcctagaattagagctgatttaatggtactaactagtactgttaaactaactagtactgttaatagacctttatgacagcatcctcagagttaactatttatataattgttctctggagcaaagcattcagagttcccagaagctacagtgaatttcacaccacttataaaccaagggactacctgcaaagtgtttctgttattttaaaatctaaagtctatttgaatttgaaaaaataaaatgaaaagttgaaaataccaaatctaagacttgtgtgtaattgaaatgaggttgttttagaaaattaaatttggcaagtgattaatgcttaataaggagtaattgttttatctattttagggaaaaattaatttaacaaacctattattatgtgaaatttaggtaatgaacatgggcagtacataatttccgtaacatttatagcatcgaccacaaaaaggctgaattagtgtcatcaaatacaaagaatgttcatttcagaatcaaagctgttcggaaagcagtgctcatggttactataattaattcaacatttcaggactatttaaaattgttatgtcatatcactttagtagatatacctttcagatgcatatatgcctgattttggataagtgtattttttgtacttttcagtttaaaaatttttttcttagttaaaaatgttctctcatttaatgatttttggttttgtatcaaaagcaaagaaactttcagttatctcttaaataataaaacagaggtcgcccaacctgcactgttttggaccctgtatacagcattaacccagctcaacagctggctgtgattggctagccaatcagagtaccaattctgtagtgtcctccacctttccctgaagctagtagagttttggttgagtggggtataaatgtgaatagcagattagctaattaaaatggtcctagatagttgtaggctccagtgctgaagttcctggaggataatccaacctccctaaactctcttgataccgaagaactcacctggaatagctacagcctacttttctgtccccctccccaccttccctgcaagctctcttcccctgtgggctgggtcctgtttcagctcttccatgcatgtctcaggaactgttcctgtagacaaaggtccattcagcactagaatgctttttccaggctgcatttctaaatctgagtccctgtgtatcttccagatcaaagtgcccctctccccacaacaatggactagatttgccagggcctcatagcagaatatcctgtctgactctctcttcactagactaaggagaaaaaataacaaaacaaaaatgaagaatttattttaaaagatgaatatagcattcccccctcccctaaaaagaaatgagcaactattacttacacaaaatgtagatacaactgtattccttgtaggattacttattaaagctttcttgatacgtaaatctaaatccaagcgtttggcatgaatgtctgcttcatttatcattgccttggatatgctttaaagagtctgtcacagctggtctacaaatggatttttgcacacaccaaaacttgccttgtggcaaatgttttataaaagttgtatagaggcttcaaatattgttcttcatgattctttgctgctaattttccagaagtccttctctttcagagtctttttttttttgagaagcatttaagaaaattatgttgagtttggtgtaaattagagttgtgacaaattatagagcagttttcacaagtaaaattgggccagttagctcagaattagaaaattaatctttttccaaagcattatctcactttctgtgtgtttgtagtgtttatagactgatagtatcagtaccaacagctaaaacaaaagtcagttttttttcttttaaaaaacattatttctttttaatgaacagttattgaagtattggccttaattggctaggtgtggtggctcatacctgtaatcccagcactttgggaggccgaggcgggcagatcaccggaggtcaggagtttgaggtcagcctggccaacacagtgaaactccgtctctactaaaaataccaaaattagccaggtgtgatggcaggcacctgtagtcccagctactcgagaagctgaagcaggagaatcacttgaacccaggaggcagagtttgcagtgaactgagattgtgccactgcactccagcctgggcgacaaagggagactctgtctcaaaaaaaaaaaaaaaagattagccttaatcaacaagcatttactaataacttaccggtaaagagtagtatattcagatttaaaacattttgaagaaatgcccagaagtggaggacaaaggcattgagcttgctgtccttgtaaaataccgtgtgtgcgtgcgtgcgtgtgtgtgtgtgtgtgtgtgtgtgtatacgtgcatgcatgtgagaggggagagaaggtgggagaaggaggcatacagtagttgcaagttaacataatagagaatttttaaaaccttaggacacatctaaagatgatacaaaatgtatgttaatgcaagataaaatttggtttattagggacagtgaattatgatttgaaataattggggcaaatttaaccaagtagggttaaagcattactttgaaggaaaggagggtattaagcagtacataattttgagctaaattcataggcaaatcaatttctatttagaaactgaagcactttctttataaaagcatgacttcgcctctttatttgctcaagtatatatgaggccatattgcatttagcctatatgagaaggagaagaaagcagagaaggagttatgagggagattggaagagaataaaaagatcacttcactttagatgccaagcaagagcaattattacagcattatttcaggattcaaggacaacaaggcctgtaaagaggccactgataacctcattggtgactttgtggagatcagtagtagtgatggtaaatagcaaattggcaggagttgaagagtgaatggatactgaagaaatggagacagtaatcatagatttttcttctgagttattttttgataaaaggaaagaaaatagattacagcaagccaaagaaagatgatttttggatgggatgttttgagcatattcataggttgaaggaatggagtcaaaatacagagggaaattcagaaagatccaagagagagattcatcatttgacataatcaaatcttagatgacagtaaagatgggacacaagaaagaggggttagttcttgaaaactagaatgtatatgacttcctttgttataagtaaagggggtattctgaatgtttgaagtagagagctgggaagttgaagttattcacgtttaatggtttccctgctttctaggaagtagggatattataaaatgagaaagatggggttgggggagaggggtttgaagagggataaagaagatgtggcatgattcctttagaaaacaatcatgatcaagtcaactagagatgaatgaaataatttcccaggtttgcatgaattatgatagatttatttggtttagtttcgtgatttagtatagcagtactcagaagagttccacataaaatggattatatcatatacctaggatggagactgataagatgtgtataatgaaagaaaaagtggattagaaaaatatagaatgatcagggattccatagaatgagacaagtagaagggaacttttcaactgagaaaatagggagagaatgaaggactagaagtggtaaggaaaaggaaggaggaagttcagtagaactgaggaaattataatattagcttaaaatattaaagtattcatgcaacagtgtgtgagggcctgccatatgctaggtactgttcatttgtatttacaacagatgaagtaccaagtagtacttcaatggagttgccactagatgtcactctgattcgtatggtaaggctaaccttgacacgtactcaagattggggctttgaaagtcagacctgtataaacaggcaatttttaatagcctatgcagatcaattattatccagaaatcttattcatataactaaactacttttgagagaatattctcatgagaacaaaacctctcaaatttgaaaacttcaagttattaatactgtgtttgcattattgatttatttttattatcttaatcacactaaatagtatttctcagtgaactttaacattttctgaaattctacattaaagtttgtgaatttattttctttatattgttttatttacttatctgctgaattggttctggttttatagggactaatgaatttttataagcactaataaagctgcttctttctaagtggtgaagattgtgcatgtgaacaccaaagttgtgagtatagttttacactgtgtggccttcctatcaactagaaggaagaacactgtctatccaactcttgtttttttttttaagtcccattcttgttttctgttcaatcagtatagctttgcctctttatcttcatgttgaaataaagggtcatgtttagaaagcttgtcagaattcctgcctatccacaattttttacaacttggttctttcaaaactctgaacaattttggatagctatgcaatataaatattaaaacacaaaaaaccagacacaccagcaaaccatgttgatttccactgaatcatataaacaatacccaggcatgctatatgttttaaaagatatatttatgtttgtgtatcttttaattttttcttcatttgacaggggaaagatgtgagattatacagcattgctagaaccgttgggccttagtataaaacaatttacaggtcattatggttgaaaaagcatagcatcacattttttgcatgtgctatgcctaggtatatttcagtgcttgcttcagacatcgtttcattactgactcttaccgatccttgttattcattatggtgttaagtaatttttagccatgtttgcaagaaacctatactatgtcttaagtgaactgtcttacatttatcccttttgattttttttgtgtttatggataaagtcagtttacaataagtttaatgtggttttctatggtaattcccaatgtgatactaagagtttcatttgcaaaggtacctatttactaagcatgttgttaggtgacattttggtctgttcattgaagatatctccctttaatctcttcattgtgtcttgggaaagaagtcattttgctttggacaagtgaacgtgaacatgctgcatttactgggctgtactgggtagaatacaagtacaagagagaaggtcagttacaacttagcagcaatggcaatgtaattttactttccccaaattttgttgaagcagtcattaagaattacactctataataaaaaaagcatgaaaatatgatgcagaaatctccgttaatgaaattcctcttgaaattatcctctaattcccttttaattctcaaattcactttgccgtataactttcaaaatgaaacttctgacatttttgtttgttcttggaaaaagtgttcatttctttgcagttttacggtgaaaataatatcctatatttctttttaggaatatattcctttgttgtgctaggaacagtaagtttatttagataatagccatctacactctctatctctaatccccaaaggccttaacctccattaggaataaatgtagatttttgtttgcttgaaatagcttcctgggcatgtaaaaacccctttgacatcattatttaggggctcccatcctcccaatggaatcacagcctaatacaaaaactttgcagctggtgagctcccaaagccccttttgatgattgttgttaaactcagcatggcagcttgcagttgttcctttcctgtactgccccccaccccccatgttcatgttcttcatgacaataagaattctccagaggtaaaacacagggctgaaaatttctgatgtctccttcatcctctgtttcttctcattcatttccattctaagcatatttataaagtttagtggagattatcaagggaaagattcgttctctctctgtctctaataaactaatttctttaaaaacaaacaattgaatatgaaagcattgaatatgcagaggttatgagacccctcatcttttctgtagagtatgttagtttcaggtacattagaaatcagaggtcctggctgtgacttagttcaaacttggaagtttcttatgtcatactgtgttctttattgataaagtgaggggacaaataacccaagcaagtggtaattaaatgattcattaactcagtgacacactaattgaccagaaattttctctaaagtttttgttctaactttaactggctgtatcaagtataggcttatgttggtattatttaggggaaaaaacatttatcactcaagataaagcatgtttagctcattgaaatgtaaagacagaatacattttaatagaacaattacatatgatatgatttagatattatgaaaataacaaccataattgagaaagatctaaaaagacctgggactgataggcaagttagaaatggacgttaaattattgaaaaaaacatacggagacaaacatgttagaaaataaagtactccctatgtttgagtttagtaaaataagcattaaaatagggctaaatggaaacagaaacaaagcaaagtaaaaaatcatcgaatgaacctgaaagatctttttgattccacatagggaatttgtttttttgaagtttttgatacctgcattaaagctgaattttagagttaatgcagattttgctacattaatttttttgaagttctgaatgcattgagttttggaaactattttcaggatgaatactacgggtactgcagatgctcactttatataattatgtgtcttgaattaattaaatccaacttcaaaggcatgtatcggaaattcctttgcataataaaacctccattcctagtgccagtgataaaatgagcagcagaatggtttagcaggggtgtccagtcttttgacttccctgggacacattggaagaggaattgtcttgggccacacgatgagctaaaaaaaaatcaaaataaatcctataatgttttaagctcgtgaattgtgttgaggcgcattcaaagctgttctgggctgcatgtggcctgagggtcacaggttggacaagcttggtttaaagggaatagggacaaattctcattccagagagctgagtactgactaatatcatctattaccacatacttttgtgaccctgggcaaatcacttttcctgtttttgtaaaataaggaggattgaccaaaatcatctctaaatccatacatgtttttagtatgctctgatcattttaaaataaataattttgacatcatatctcgttttcttaaaaattgatatgcccaatactcttattttatttttgagacaggatctccctctgttgcccaggctggagtgcagtggcatgatcatagctcactgcaacctcaacctcctgggctcaagtaatccttccacctcagcctcttgagtagctgggactgtacaggtgcacaccaccacgccgggctaatttttaaattttccgtagaggacgggcttaccatattgcccaggctggtcttgaactcctgggctcaagtgatcctcttgcctcagcctccccaccccaaaaaaatcctgctaggattacaggcctgagccactgcccccagcctacttttattttagaactgagagcttcagtaagatcataacaggaaaatttaaaatctcccccattacttgtaaaagaacatctttttgagaaattaaaacaattttttttttttaatgagccaaggactcatgaatacagtgatcacaaatgagatcccctcatggtgatgagaatagccatttcagaaattaccactgaacatagtaaagaatactggaactaatagttggtggtgtaaaatgtgatcaatcaagagagtctatttctgttatgtataataattttttttttttttttttttttgagacggagtctcgctctgtcacccaggctggagtgcaggggcgcgatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccacccgcctcggcctcccaaagtgctgggattacaggcgtgagccaccgcgcccggccaataattttttaaggtaaactttttcttaaagtatgagatacataaaagtgaaagaatcataagaatacggctctgtaaatattcatgaagtaagcacaccatgtaacacctatatttaaaaaacaatattaccactaccttataagccttcccttcctctacccttacagtcactatgtcccaccaagcaaacaggatgacttctacagcatatattagttttgcctgcttttgagtatgaaatcatatggcggctttttcaaaattttatttgtgagatttattgatgttgttgtttgtactaacagttcattcaggcccattgctgtattatatttccactgcatgactagaccctagtttatctgttctatttttggatttgttttgtttttacattttggctgtatgtctttgggtgtgcatacatacacatttctgttggctatgtacctagaagtggggctgctggatcatagaacgtgcatatgttcaacttttgtagatgctgctagatgctttccttaagtgtttattctttatattccagcagcagtttgtaagtttcatttgttctatatcttcaccaacacttggtgatattgttggtagagatgggcctcttcctatggttgctgaggctggtcttaaactcctgggtgtaagcaatccttccaaagtgctgggattacaggcatgacaggtgtagcatcaaccttggccagtaatgtggttttaatttgtattcccctgataactaatgaagtagaactctttttcatatatttactattcatttggagtactaaaaaaattttatgacacttgcattttaaaatattaaactttcctatgttaagaagggctgttgtaaattagttattttctaaaacatttggcataatcattcagtctatctctgtatttgataagttgtgaaattctttgaaaatatttttttccttaataaaactatgtatttcaaaccatggaattgatttcaaatgctaccttctgagtgttattaagactatttattcatagtatttttgaaaacaagactagaaaaaatgaagtgttttaaacaaacagtggtttttccttccagggaagtcttctccaggaaatttctttgccaggatggtcaagtcccttatatacaaagtttttcttccagggtaaaattattaggcattgtagagggtataattaaaagttgatctgcctaattttaggtttaccggccaattacaaccttatcattgaacacagagtttggaagattcttgagcagtattttagagctgtttttgagatggagaccaacttttctatgtgctcctacattttcgagccttccgtgcacttcctttggatctatgtgactaatttctggccagtgaattgggagtgaaaatagtatgtgtcactttggcctgagtcagttaagagctacctccttctgacctcttctgttgcagtggtgaacatgtacatgttctaaagtttatgtaataagctagtgtttgttgttgcagtcaatgttaagtaacctaacagagtttcattttcgtaaatggtctacacattaaaaaaaaaaaaagataccctggagcccctgaagtatttttatgcccataattttttgtgaggagagtgctgcttttaaaaaagactagggtttggagaatattcttatgaggagaaatcggtttatgatgggaaaatgaaaaaggacaaacgtttgttttatcattctaccaaatgagaagaaaactttcacaaaaagaaatgtttaaggtttctgattatcagagttttatttatttattgagatggagtctcgctctgtcgcccaggctggagtgcagtggtgccgtctcgactcactgcaacctccacctcctgggttcaagtgattatcctgcctcagcctcccaagtagctggaattacagacacccagcaccatgcccggctaatttttgtatttttagtagcgacggggtttcgccatattggccaggctggtcttgaactcctgaccttaggtgatcgcctgcctcagcttcccaaagtgctgggattacaggtgtgaaccaccatgcctgacctctgagtatatttattatttacataaaatccgattctttttataacattaaaatgattttaactagttttgcttttttaaaaaaattttcaatttagaaaggtggtaactatcagagaggcatatgacacagacatagtggccccttggtatccacaggggattggttctaggtcccttgtggataccaaattccaaggatgctcaagtcccttatatacaatggtgtaacatttgcatatattgttctattgttattttttactgttttttttttttttttttaattttctatctgtagttgtttgaatctgtggatgagaaactcatgggttcagaatggcctatcacaaactgaggattatggaaaaatactgtagtttacaggtatttttttgaatactgttaatacacagattactcatagtctaattggaataaaaatattgagaaaaataaagtccttttcatgtttaatttctaattctttgcacaaaagtaattttttggaaaagctgtttcttggtttcattttagaattcccagcaaccaaaagtaagcctgagtttgtaccaaggtaggaagtattttatgttttatcatgtctgctagtcttgttctattaaattacttaagcaactttttattataggaaatttggaaatgtgagatgtttagcgcaaggaaatgatcttaaatggaacaaagctggttaagaaattgaaatgaataaaaagcatgttatgaaaatatgcaacactctcattgacctaattaaaatagcttatataagattattgttggactatgtcttataaacttacaagggaaatcttgattccctctctttaactccttatagttattgccaagattaatattcttacatgtatatttttacaaatatgtatgatagaatggtcactgtaaaaaagttctatttttaaaaacattggcatgagaaaaaggtgaatgcttcttaataaagtattggaataattatttattagtgttactggaaatgggtgattcagtgtcactttttgggtaatgtggatttgttttgagagagaaacagagaaacaaggaaacaaaaatcaacaaagactaacaaaatttctgcccagaatacaggtacgtgcttgcatgaaacaaaggtcctatcatgaaaatactaaaagtctttgaagaactaggctggagtttatactgttagtgttctttattgacgatatatggaacatacagttatatatgtgatgaagttaacattaatgatataaatttcccagatgtagggctaacacttcttcaaaaatcagatttccaggtatttcatagcttgaacaaatatttgatgagacccctcccctgaaattttataccctagaacttaataaacatgcctggaaattttatgtagatgaaggattggggtttctagaggtcatggcataagtcattctttcctacctggcctttgtacaataccagatacaaaatgaagagtaaagatagaggccagaacgtacctactaatgataaaagtccaagtggaggtctgagtttgagagccaaatgacctgctgattgaattgcagaaccaggccaactttttcaagcactcttcaggtaatataaataagacagtgccatagagcagggatctttatggtttttgttgcaattgtagctactctgtgattgtgatgcaagaaaacagccatagacaacaggtaagctaatgagtgttccaataaaactttatttagaaaaataggcatcagccttttgtagtttgctgatctcttgcatagaggaaaaagacacatttgcattttctgcagcctactagtttcaacaggaagaaaaggggcccagcagaatcctgcataccaaggatttttcctcaccagtttttcaccagattaaaatactccatcttaccagaattagagggagtaaagggagagaaagaaacctgaaataatactaatgagctctccttgtaagaaggggggcaaacgcttttctcacaagtcccttgacactagaatttactctgttactcaggtatactgcctttccagtggactcaaaagaacctataaaacacaaagtattactttgtactgcattttccaaacttgagagtctaagtgttttggtgctaattttggcgtagtttctctcattttttggttagtgatagtaaaaccatgtaatgagctcccaggaagacccttctcttccggccacatgtgttgacatgaggacatgcctttggcctattttgggcagctaagattactctgtggattgattcatattttttgagtgcctacaaaatatgaggcattttgataaatgctggggatacaataatgagcaatagtgatccagttcttaccctcacaagagcttgtgctgtgtaacagaaagggctctaaaaagaaaaagtgatttctaatttgaaacctgagggactagcagcacatgccaaaggggacaaagttcagcatgttccgggatttggggaaagcattgtttatctggggaacagagtgtaaggggaaaatggagatagatagctgaggctggaaaaggaggagggagcctaggttgcaaaacctgtgtaagcacttgggttttgtcagatcagcaggacgtggttgaggggctttaaagccataagatgatgtgaatgatctctgtttttgaatatgttcagtctaggttagaagaggcaaaaattgaagacctacatttgtactgttcaacaaagtagccatgggccaaagtggctgttgagcacttgaaaggtaactagtgtgatgaggagtgagttttacatttttgttaattttgatttaaaaatttaacttaaaattttaaacaatatgttttcctttaactttagtattttgattggactacatttcacataagttattgaaaatttagagtgcgaattgacctatattataggtgtaaaattcacactggattttgagttcaagatataaaaaacaagaatgtaaaatatctcaattttttctatggttatatgttgaaatgatcatattttggatatacttggttaaatatattattcagttaaattttactctttctttttgctcttttatgtatggcttttagaaaatttaaaattacatgtatgtgtcacattatgtgtcttattggactactccggccagattccagttcagaggctctcataggaatctagatgagagatcaccatgatctgtgctagggttgtggcaaaagcataaggtttgagagtgatctaggaaataaaacataggatttgccatttgattaaatgagagatggtgaattcgttataaagaaggaaaagggagcctccaagcacaaaaatacaagaaaatgtatggtagcggaatggcagattcagacatgtaaacaagcaaaaacaatgcatgttattttttattgacaaactaaaataatgtagttaaaacaatattcttctaccattggattttagcatttttaatgtttgctttttagtatatactacctaattgcttctttagagttacatagttttgcatttcttagattgtaactgaacactaaattttacagtgtgtaatggtttaccatctttatttccgtgtcattatctgttcatcctcaacgagtactaagtgggaagtgggactggagacatttatgtatacttttgagcacataaattctctaaacattttcaaatttgataatataaaatttatttacattttctttaagatgaagcttattccttcttaaaagaacaagtactttatttacatgtgaaggtttactagacacctccctaaagttgaagccctaacagtatctgatgaatgttaaacgtttaatactttcccccattgtcctcctaagaaataagatgcatttctagcttcattttccagtctcttaagcttatgaaagtagtcgagacagtttgttgaccccaaagagaccttttagtctctggcttgttagacaacagggtctgtagtcttcattggcattcagatcacaggcagccactgggctcagtgcaaagccaagcacagctttaggatttagacaaagccaccctggcaaaggaacccagttgtcagggtagctggctgtattgtaaagaactgttgcataatggagagaccaagtagaactattaggatgcaaatgtgaaaaaaatggtggagctaacctgcaaaaacaaacatttcttttttggtgaagagtctagtcattgttgctttcttctgttttaacttctctgggccagggatgtagtcggtgcaatttgagtatattagttatcttcagtcataatgccatcctatattactttaaaatgaacagttaatttgtaggaagagaccacagtacttcaatgttttggaatcttttcataatttacaagtgcatcctactttagtctagatcaattttatatgtgatttttattctagattagatgggaaatcctttttgctcctgattttatttcatctgatttataacaaaatattgttctaatcattgccatccaatgacttctccctgtggattctcatagttgtcctatttattgtagaatttttggctcaagaggaaagctactgaaatccttaaaacaagaattgctttattttactaatatcttaaggaagtctaccctgtcccttttctccttttcactttcttttgtttgttcatccctgtattgagtgctcactttttcttttgctttctacttcttcattagttcttttctttctacttttcatctttcttagcaaaacattgtagaacccacactttgataaatgctgtggtagggaaagggaatactagtaagaagaagaagaaggaataacagaaggggctcctaacctggatttaggagtcagggaataacaattacacccatgccttactgagctgttactacacgccaagcactattttaggtgttttacctgaattaatctcatttaattctcatagcaaccttatgaggaaagcgctatcacccccattttgcagatgagtatgaggcacagagaaataaagtgacttgtccaaactcacattttgtgtatgatagagccaagaaaggctttctagaagttttgagcttgaagctgagatccgaaggtagagtaagagttgcctggtacactgtgaatggaagcaggttatgggaagagggaccagcaaaagtgtgacagaaaggactcttgcacctttctggaagtgaaagtagattagtagggtttgagggattctgtgagaaagggactagtgagaaatgatgctggaaagattgctctatgttcagataatttacatatgttatttgtgtgtgacggttcatttattcagcaaatacttgtgtctatgaaatgccagttgcatggctgttatctgttgggaaggtggaaagaaaatagcaatataggggtggcatacatctggatgaagttacgtggactttgaggtgttttaaagtagatgaatcttaagcaaagtcttagtacgtctgttttgtttcaaatcagcatatgccttgactttctcattttgttaggcttccatttctttatcttcgaacttagtacttgcaaggctcctaatttctttaagattgctgtataataccattcacttcattcttgttttggtttgcctttgaaatagctttaagaacaaaatacctctatagctgttatttttctgacttttaaacctttattggtagggccattcttttttctaattcttgcttctcattttcttccaggactatgattccttcagccttctttagttcctttctttctagtaaattccattaacagtgggcatcaagtacagccatttaaggccttttatgtttttcttgaccccaggtttttggaatctgaatgttgatttatcactaagacaatgattggtaattgtaatttctaacattgattactcactatggtatgtgccaggcactatgctaattggtttatataaaataacctaagctttagaacaactttctgtggtaggtgttaccaaattattatcatccagttttctagtgaaatgggagtttcagagggattgttatccaggttacactgataataagtggcagagccaggatttgaatccatgtatttgactacaaagcatatactttttacccccatctcaagctttctgtctagcacttgcattttcttatttttacagattaaaaaaagtatgtggcagatggtttaggctaaatataaccaaagctaaatgcatctccccctaaattacttaccactgtacttaatatttatttaggatgtattttgtgtttagcactagcacaaggaagaataattttactttttaataatatttgaaatacatactttgaacttcaaattcattctcccattctatttattcttccatggcattgtctcaaatacctgtcattggcttctctcctctacagtttgacccatcagttgggtttacatttgtttcccacaggtgattgtggtgagcatgcacccacttttgcagctatctaataaaaagatggaaatagttggacaactcatatcaactatgagaatgactggtgatgactgatagtaagagctggctactcatgctaacgtttgttgctaggtatgttacagtagtctctaataaaaatggtggaaaatgttatgagaggaaacgcaacgaaatatttttctgggtataaagtaatgttacaaattgcttttggtatgagtagccagttaaagtttcaaatatcatacttagatgatatttttagaaacatgttgaaaaatagtcatgtggtgcagaatgatgtttcagtcaatgatggactgcatatatgacagcgatcccataagattataatggaactaaaaaattcttattgcctagtgatgtaacatcatagcacaatgcattacgtttttatggtgatggtggtgtaaaccaacctattgcattgccagttttgtacaaaagtgtagcacatacaattatatacagtacatagtacttgataatgataataaatgaccgtgttactggtttatgtatttattatactgttgtcatttcagagtgtactctctctgctttattttcttttttaaaggttaactgtaaaacagtctcatgcaggtccttcaggaggtgttacagaagaaggcgttgttattggagatggcagccccatgcacattattgcccccaaaagccctccactgggacaagatgtggaggaggacaatgatattgatgatcctgaccccgtgtaggtctaggctaatatgtatgtttatatctaagtttttaacaaaaaaggtaaaaaaaatttaagtagaaaaaagcttatggaataaggatataaagaaaatacttttgtacagctgtacagtgtatttgtgctttaagctgtgttactgcaagagtcaaaaagctacaaaattaaacagtttatgaagtaaaaaagttatagtaagctgaatttattattgaagaaagaaaaatattttgttattgtagcctaagtgtacggtgtttatgaagtccacagtagtctacagtaatatactagaccttcatattcactcaccagtgattcacccagagtcacttctagtcctacaagccccattcgtggtaagtgccctatagaggtgtgccacttttttttttaccctgtgtactgtatttttactgtaccttctctatgtttagatttgtctagatacacagataccattgtgttagaactgcgtattcagtacagtaacatgttcagatttgtagcctaaaaactaggtgtttctatgatgttcactcagtgaggaaattgcctaatgatgcatttctcagaatgtatccccatcattaagcaatgcatgactgtaatggagtaatgtgacctggtattctttttcctttttatagttcacactgtatatttttaaacaatacttcagtgtttcagtttatttgtgaactttgatttgtgcactcatttacacattcatacatacattgattcactccttcataaatactttattgatgaaatattacttactggaagtgccagtgaggtacaggagatacagcagtacacagtgctgaaatagtcacagccctcatggacttgacagtgtgtttatcattggattggatttaagagaattagctaatttttttctgttgagagttcatgccatatttgacttttggattttctgagatttatattaatacatttgaaaattttggttttagaattaggctaatggttacagttgtacctcagtttattgtgctttgtttaattgcactttgcacatattgcattttgtacaaattgaaggtttgtggcaactctgttgagcaagtctatctgtgtcattttttccaacagcatatgctcacttgattagcatttttagcaataatgtttttaattaagatacgtactttttaaaagacataatgctattgcacatttaatagactatagtgtagtgtaaatataacttttatatgagctgggaaaccagaatttcatataacttgttttattgccatatttattgtagaggtctgtaactgaacccaaaaggtctctgagatataacttgtatatagattttgatttggtcactacatatgtttatgattgttagcttatacttattggcattctgaaattttccttttttcacttaatattgtttttgtgctctgtccgtgtgcaatgtagttacagctgtagctaaagctattggtaggttatgccttttagctgctgtatagtattccatttgaatatgtagcactactttttatttattctttaattgatagacttttagaatatttccccttttcctcttctagtcagttaatactacaataattgaggtctcttatgagtcaaaactttaaacagctttgaaagagagctatcttttgtctcattaatgtaattttaaaatagaagtatttgaattttgcctttagtatttttgatatttggagaaagttccagttgacttagtttaaatggagtctagtttgtgtgcttttcataccttaccagtaaaagtcctgaactggtcattttacttggagtgtatgaattggcatagcacagtactgaacaggtaaaaggaaacaaagtataggaaagcagctaattatagtaattgcagctggtttcaaagtacttctaacagtttgtgcataatgcttacttgaaagcatcaaatgggtgctagttgtgaaatagaacacctgtttgttgttgagcatgtgtttatgcagatgattgttgttgtcaaagcaccttgatgtagagtagtcctgtttacatttacattctccccaaaggattaacagtgttctctcaataaatttgcagtctattctcctctcaaaggctgctgtttggagggtggtgtgaaagaggcaacaagtgcttgctaatcacttgaatatacataattagctgcagtctggtgcactggattctttgtagaaccataacaatactgattggcaaatgcacataacaatagatgtgtcaccatatagtccttgagagtgctggttgtttgttcattggtatttattacttatttttctcaacatgagttaaatttttattatcagtacacaaactcttttcctgttcttttaaatgaaccagtgtgttatataacaactccgtcatcactaagaagcagtgttgtaaatttctagactacctagagtctgagggtattatttaaaaacacatttgctgtatttagtaattccaaagattgagaaacgtccagtcagccaccatctcttccctttggtaggctcagcaagggagtggagaagctttttaatggaagaaagaggcagctttaggtatgctgtggttggaaggctgttggcatgggaaagctggaagtgtgggtatcttgtgtgactggtctggggaacatcttagctttttctgtttggtccttggttgtcattgcccaagtcctgaccgttctgggctcttggctgcagagcttgtggtttgccatcctgcgttggttgcaaaggttgtggctcagagttctgtggttatacatgatctcactgttgtccattttatattcagcctctcagtgggtagtgttgttaagatgaggcgaaatttatttagaaaaaatatgtaaatctatatgaggaacaatattaagtaaataatgtagatggcatgtgaatatgacacaaattgtgaaggtggtaaatgaaattaggaagaaaggaaaaaccgttacatggtaattacatatgaggcatttcactgagtgttttcccattttatttcattttatcctcttcaaagctctataagtacaatatcataatcctgaaattataaatgaagattctgagggttagtgaagtacattggtccatggttgcacagctaataaacaggagctggaattccaacccagagcttactgacttgagcttactgacttttgactctaaaaagaggcacaaactattagtttacaaatgtgatcattccatgaactgagatctttcagtgcgtcacttctagtgccttctatttctcttcacagaacactctttttggataaagagggtttaaaaaataatctctctattgatttttaaatagctgcggtggctagcttccaagtctgcaactatgtacttccttgtttcaagctggcctcactatgtgtgtagaggacgccttggcttatcctagttactgttgctgtactgagaccatccagtaagagtgactcagagcttgcccattacctcttcttgccccttagttcttgctgtatatcaaagcaagtgttttctaaattcttgcagactctttgttctctattgccttattattggtgatattgcatgccatttatcttaaacgtatggatggtagaaaacatgagctgctacaacaacataatatatatctacagcaggctattatatatattttttgctttcattttggcatgtggtagatacttacatataagagtttatgctatgagcagaaataatcgaaatgtcacgggatccttcaggtgtcactctgccagccgggaaccattgtggcctgtggcgcccctgcttgagtttcactcactcccactgtgctcgttccacccactcagcccggcaggctgcactcagttcgcccaacccggatcccacgcctgatgagggcaaaccaggctcagagcactgaagggtgtgtgagagagctaacacagggtccggccagctgtggtggggcaggcagctctgggtgctggcagaggtgccggctccttgccaggctgcagctggagcaggcgtaccacacgtagtttctggtgcaggtgctggtgtctggaaaagggggatgcggtggcacctaaaaacttggggacgccagcaactgcagagcctcaaggagtgggtcaggcgtgctctctcattctctccacccgcggctcggcgagcagggggagcaggtttcagcttgttcagtcccaccacctcaccccagccggcggctcccaggctggcccagctccactgccacttcctgtcacatggggcagctgcccaatgcaggcagaaggcaggaaggctatagtgttacagccctggcttgggaaatcctgatgtctcggcccccagaagtgtcactgcttttcactcctgcagtccagcaaatgggagcatgtcaccaccacagtttggtgagttggccaggaaagtgttgcagcccttttcatgcccactgttgggtgggtcccgaattctggtcctttgtccaggaagaatgaggttacgtggacaactggaaggtgagcaaggtggagaagttttactgagtagcagaacagctcagcagagaggagacccaaagcgggcagctcctaagggtagtccttacttaccttgagtccagctgaagctggggtttttatgggctcaaaatggaggaagtgtgtgctgattggtccctgggcaggaggaagtgcgtgctgagtggtccatgggtggacctggaaaaaacaccatttcattggctgaaaggcgtaaaggaaattctccctccaggttgtggattccagctagaaggagcagccaggttttcaggcttcatgctgtgtgtgccctgaaggttgggtttcactggggacctgtcccaatctgcctaggaatttgtctgcctcctgccactatcacaattttatttctgaaatacacaaatatttaaagctgttaggaaggtgtcagtagagagacttggaaaatacaggcaagatgaaagtaaattattctggtaataaagtgacccattcttattagggaaaatgaaaaatatacataaagaagaacactgtaatctatcatttattgtccagagatattactaatattttatgtctccttaatcttttgtctatgcacatatttttatttttaaaatacaacatttggaattttatatcttgctttttttctcttaatattatgaacgttttcccatatcattaaggacttttaatagcattttataattatttacctaacagttctccctgatcattagacagttaagatagatttcagatctttttttaaggtagatttttatgagtgaaattactggctcaaaggatatggttactttcatgtctctttataatctatgaggtacttgatttttttcctggaaaggctgtacccatttatgttctcaccatattctcatgctttaaactcagtgcatatgctcttattttcactagtattttgaattccacccttttaatcttttcaaaatctcaaatcattacctctcttgtattaccagtctctccctctctgctttatcattcacaccggcatataaaggtgcaatagtatcttccatcctaaaaagaaaagccccctcttgacatattgcttcccattctgctactgcctctatttctgcttctcttttaataaaattttattgcatggtttgtccacactggcatctttcatattctcaccttgtagttaattttctgccctaaactctagtttatttggatttcttactcctctgaagagtctagtaaaaatcattgacatccgcgtgaacatttttctctttctttttctccatctcttaatatcattcagcacaagtagcaactcaattcttgaaacccaaccttggtttctcctaactcattggctcttcctttctgatcttgtatcagttcttgatacactacctgatgcctacttattggagggccatgtgactccatggaggactcctttccctaaggaaaaactaagtttccctgaagtcctttttgtctctaataactttttacctcttctgggatgtctggcatatgactcttgccttagagtccatagactgcaaatgagtttgtgcttttaatgacacgtactttaaaactcattgatcttagttttattaagtctttagatttttgaaaattttctttcaagtggttattctttgaaatcgtgaagaactgacagcatatgaccagacagtttttctacaaaagcattgggattgcctgtcctgtcctatctgttcccataaagttttaggtgaaatacaaaggtttatgatctaaattcacaattgctagtatgatgcattagcacaccataagttcacagtactctttgcactatattcctgaatgattaaaacttacagctggcatagtatcaagtgctggctgcccaagtgtctccctcacaacctatagatagagtttattgcctgtcacagaaagggagtacaccacctggttagaactttggcggtttcttggagggaagaaagcaaggatagtatgtactgagaatcaaagtttggttgaggttgagtgaatactgggtgtgtgtgtgtgtttgattaaaattggatgatgaccattatgcaacagcaagggattcaaaaaatcttacatactgttggggctttctattgaatcgttgatgcgtgtttcaggagtttgctgtgatgaacaatcaaaccgtttgccagggtgaggctctccctgaatagtcaagtcatgttaacgtacactgtgagttgtttagggagttgatagttttagtcttcaagttgtatgtggtttctgttaaactattaatgtcataggactacaacatactacttcaagctcttaaaatggctttcccttatttttgagagatgtagctgagtgctgcttatagtcaggtcaattcttataaaacaccaacatccctctatgcctaaatatcaaatcagtgttataattatttttttaaactaagattatatcaaattttttagtttgatacttacaaaatagttatgatgcttttttttcttggttctctttttttctttgctagaaagactttgaactataaggatggaggttccttttctgcagacttaagaaagaggatgtgaaacttggtgtcatgagttctaaatacctcaagttattgttgcaagaatagggttttcagttttgcaatttcagcctataaattacaatgaagagtaagagtccttataataataaacttttggggctgggagcagtggctgacacctgtaatcctggcaatttgggaggctgaggtgggaggatcatttgaggccaagagttctagaccttcctgggcaacatagcaagaccctatctccacaaaaagtgaacaaaattagccacgcatggtagtgcatgcctgaagtcccagctacttgggaggattgcttgagtcaggaggtcaaggctgtgttgagctgagattgtaccatcgcactccagcctgggcaacagagcaagaccctgtctcaatcaatcaatcaatcaatcaactaacttacttttggtattgtatgctgatttatgaaggttgaacctaggattaaatgttgtcttttgtctgccctttatttttcttcccttaacagatgccatgttgagctgccttgtcctgattttgacccacaatgtgtattcagcctcagcacttattatgtaggttaggctccttttaaatgttaatgtttcacatttatgcttgtgtgaattgctcattttctgtcataacctgggggtatggaaggaatctgttgaagaccaaggaggtgggctttaccacaatactgacatctcttctcagctcaggcagggagccttggctaggccacctattgccactgcctaagtagaaggtgattggcagaatcttatctgctttgctttgacttttcattgccagagtttgttgaaggatgccagatgtttgggaaaacaagtttctttttgctttctatccctattcttgccaaattcttacctgttttttcatgaggatgccctggcttgcaagaaaaagcaagaaaaataaaaacataagtttgattcttaatttgagcattctgacccattttcagctttatatatccttggtccatttttcttcctgttattttgacaactctcatggctgtgggactgagtgcttgttcatagataaatgttaactttcttttgggttgaaaaagagaatattggttgctaagttgagcaaccacagactgagattttcagaaaattgacaacttcttttgagaatttacctgttgtaagttatagaaactgaacttaaatattaccaaacaaccatattaaatatttgccatattttagattgttccctgcattaattgagttcactttataggtgtaaaatatttttatatttagtaagcagatcaaataatattaaccccacaactttttcccacacgttaaaaaacacctgactcttcatccagataatttttccagatttcaccactggaatttacttatacatcctttaatacctaaataatcagtcttgttctgatattatctgcctttcgtaaataattgaaatggatttggcttacatattggggcgtgggttaacctccagttggaattctaaatttatcaaacttaagatctgttaaaatgcccagcaacagaataattaaaacagatttgaaaagatgagtagcacccaccagcatactagacattaatgttggaggtatgaaattccagacattaatgttggaggcatgaaattccagagctgcctgcactaggcctttatgagaactaaccttttaaaaaggccagtagctttcctagtcttctacgaagtgccagatagatgagtgaatgtgtataaacacctttctgtgtgtactttttagctattactttgaaaattgtaacaacatatatattgcttatccattttgaatcaactgtgacatcttttagccatgtatatgtggcatatgtattgttttcattaaatcgtcgaaattatataagccagttaccacttttcactaattttttttggcaatggtattttggaagaattaaatatatttgaactgtatattgaagtagtcaaagtgaccttcaaaaggaatgtaatgatcttaaatataatattttatcttatttagttgtcacaaggaccttatttctgtggttatgcccccgacccttaacccttgcaaatctccgtatgcagtgagcagtgttactgctggagtatattattcttgtctctgaagtagagacacaaaaaaggctgagttctgttctgttattctgctagattggtcacatattcctggagagtggtgttataattttttttcctgcatctttgcagatagcacagtgcccccatggaatacttcactcactctagtcactggtgaagtcctactcatcaacccttcaagttatagctcaagtttcacctcttgtatcttgtcttcccttgtcaccatttgaaagtaaactcttccttctgaaactgtcaacactttccagaacttttcttactgcccttattgcagtttcatttctttttctctttttttttttctttaaagacaaggctcgctctgtctctgaggctggaatgcagtggccttatcatagctcactgcatcctcaaactcctgggctcaagctaacctcccgagtagctagaactacgggcatgcatcatcatgccaggctaatttaatttttttttttttttggtctagacaaggtcttgctatgttgccgaggctggtcctggactcctggcctcaagtgatcctcctacctcagcctcccaaagttctgggattataggtgtgagccactgtgcccaaccctacttttgtttcttgtgtacctgatttttcttctatattgtaggatattttataacaatagttgccttttcttcatcttttttccctcagaaactggaaagtattttgttggccagagatctgaatgatttaagaatgattttagtttaaaattcagttttttctcccaggagatactgagctcttaaattagtatttcttaaagggagggcaatagtccacctgtattagaacccccttaatccttggtaaaagtgtagttttccagaaaatgaaattagaacttgtgggtctggatcccagaagatggatgcatttgtattaagtgccatggtaagtcatatttacacaaaaactgaagattcattcccttaaattattatggaaataaataaacattaagataccataagtcttataatgtaggaaaaaattccttacttttgcatttgaaaaaaatatgcttttgaaaactaaattccttattgattctctgtttttggtcttgattactgatttgctcacctaatagttctctaatgtatgtaggtttaaggaactaaaaatagagatattactgactgaactagttagtatgtaaagtagaaaatggtacaactgcatactcagtaacgggtagttttacctttttctggattcttttttttttttttcccctcaatttttctagattttggcctaccttgtattatcttgtttgtttggtgttaactttttcttttgaggactgcagggatgacagtcttgttttcctctcctgtatcacacagcattgttacagtggctcagaaaagcatttctgaatactttgaggattatttatgtttgttataaaatgaaatttgttgtttctgactcggaaaataaggatataaatttcataggaatgcattttaaatgaagtttcttgagagagacagctttaacttgaattttgcagcagcatctaaaacgaagccaatgaaaacacctttttttccccagacagatattactctgtctctcaggctggagtgcactggtgcattatggctcactgtatcctccacttcctgtgctcaagtgatcttccacctcagactcccaagtagctggaactgctggcaggttccactatgcttggctaatttttttttgtattttttgtagagacaggatctctacccaagtctcaaactcatatgatgtcctcaagccctcccaccttggcctcccaaagtgctgagattacatgcatgaatcacagtgcttggcgtcagtggaaacactttactcttgattgtgccattttccataggggttggtggctggattgtactttctagttgtgaaagtaatggtgaggtaatggctttgagtctagggatcagatccttcaatcagtagtaatataagtgagaagtattaatatgacatagtgaattatctataatttctagagaacatttaacttgcattcttagatctggagatggaggaccggttgattcagactacattggcttcaaagtgataaattctatattcacctctactaggacatatagaaaaagaaaatagctttgaaagtatggctctttctttcttctttttctgaatagtgacaggcatctatgaatagtgatgaattcaggaaaactcctaggctagacgttatcttgacagttggtggacagatgctcctgatttgagtgtgagactgaggtattcagaaagcacttcaaaacactctcctatgccagctaacattattttcgttatattgtgattgagtttttagttgctttgtaataatccctcagataaagggcctggtgtgagctgggaaaaatgtttatgatttattttgagcataacagcatatagtcatttttataaattgtttttcagaccttattattacttgtaaactaatgtattaaaacacatattaacatattaacaatttcacattgaacattttaaatgaaaataataaatgttaatgtttaaatgaaaagtggccttgataattttgaaaatgggtgcccagacttactgcatttcttgagaaagattaattgcttcctagacagggttcttacggtgatagttgtttttacattgctcatgtctaatataatatttgaggtataatttgccatggtatttctttttctgagttagttgatgttttattgaagacatgaatcattatgtgattctctccatttaggaaaaaattttccatctttttcagtggggattgggcaggtcattctcatccagggttctctagtttagaatttgttcttcttagtctgaaggaagttgttgactttttatgtgtattataagggccttctttaacttcgtgctttggtctgggggtgtgatgattactagaaatggtgaagttatgtgatgggggaaatgccttttataaaacaaattttggcaattatgttgttttccccttagcattttattcatatgcatgtactcagaagcatgcacagaatatttagacatgttaacatttagatggagctgctttgatggaactttatattatagagtaaatttaggttgttgctattttaatgtatatctttttctctgaagttttatagtataatgtttcttttttatgataaccagttcaaatgtaagcataatataataaaaccttaagctcgcagtctagtccttgcaacacgaatatatatagcagatgtgtcaaaatatatgaattgttcttaatgttaaacttttgttcgtgagaataacgtaacacctgctgtgacctgctaagctgtgtaaattttaatgactgtaaaactgaaatgtattcatagccaaaatgtgtttggaaattatttggaatgtcttatgcttggctcctttagagattttgttatataatatgtagaaatttaaatctgctataaaagttgaaaattattataacgtctatgttacttaaaagttatctagaaaattataatacctaggttacttatatcttttcttaaaaaagttatctgtagggtaatctcacctctgatgtgccttgcctggaagcaacaggagtgttatctaatactacacaaatttgtttccttttagcagtggcattcttttaattctacaaatattttgataccttctaaaagtaggtaggattacattggcatagtaaatttcccagggttattaactcctttttctctccattatgtaaaaaatagtaagaaaatataagaattataagggtactactagtttatatttggtagtatagtagtggaaagggaatgatccctttcctccccatcataagggttatggccaacactcctataacaaaatacagagtaataagagaaaagcataacaaatctgtttaattatagttttacatgacacaggagccttcagagtgaagaccccaaacatatgggacaactatccatttttcagtgcttaggttcagtgaaaaatggacagctatgtagaaataggactggacaaaaaggttatgatctaatattaatagactgcatataaaaactcaccaagacctgtctgttcagattcttcttggcctctctcttgtaatgtttcttcctcccaggtatgggacaggacccctctgatgagggtcttatgacctatattattgggacaagggtaggtcagagaatttctagacagaatttctgtctaggccagttcctagacagaaaggtgaggggaaggttagagtagtaattgtagtttttatggctggctttggagaagagagatctagtctttattatctgctttggtgaggaggaattctggtgtctgtacttgctttgggggagaatgaggggcaagagacaggagggcaggagaagatgagagagatccaggttctgaggctgcttctgataccttccagtgcaaagtactttgtgtgctgaagtgccatattttggagtattgttttctgagctccagcattagccctatttgccagtagaatatggtgtggcaagtactttaaaagaatgctttacatgcttattttctcaagagtatataccgtgagcttttcggaatagttggaccatctgggaatacgtaaaaaataaaaggaaaaggacaagagattattgcattttgattggctccaaattgtattaacccttaatatttatctactttataattttaagatactaatatttgaggagatctctttattcgaattactggtttaagataatattatgatattaacaagtctctttttttctcctcacatcttttagaccagagcagacaggccaagtcaggctgagatcctatttatgataaaaatcatagaactctatgtagtattgataaaacacatgaagattatattatacttagcttttaattatattttgacatttgctcatgtttgatttagaacttttttttttttttttttttttactatgtcttttggtctcatcaaaaagattttaagatcctttttattttggcaaaaatatatgtaacatgaaatttaccattttaaccatttttaaccatttttatttttattttatttttaattttttttgagtttgagttttgttcttgttgcccaggctggagtgcaatggcacggtcttggctcactgcaccctcacctcctgggttcaagtgattctcctgcctcagcctcccgagttgctgggattacaggcatgtgccaccattctccgggcaattttgtatttttagtagagatggggtcaggctggtcttgacctcctgatctcaggtgatctgcccaccacagccttccagagtgctgggattacaggtgtgaggcaccgcgcccggccaccatttttagatatacagttgctttcatttcttatgtctctctcttaacaccaaggttattaagtaagtatttaagaacatacaagagatgttcagtgtagcagagattggccaaatccgtttgcgcgtaatacacctactctgccctagcaccaatctagactgttttttgcagctgtcttggagttaggtgtggccatacgactgagttctggccactcacatgtgagcagaattaacgcatgcctcctctaggcttgggtcatgaacatctgtgttcagtgttctttctctcttcccttctgatggcagtcatgaaaccaaggagatggaagagcctctaaaagggaggattctaggtccttcagtcactgccattgaaaggaaacattgttttgaccttacatgagccagaaacaaaactttcattgtagtaaagcactaagttgtcatgatttacctctctcagcagccagcattaccttcactgatacactcaacagtgatttgagtatgtaatttagtttactcaaaatatacttctcatttcttagcaattggaattggtagtcaggaaaactaaagttgaactgaggagtgagaaattggggtgtgactccagttggaggaagacttggtgtggaactcgatgagatgaataaaagatagaacaatttggaatgttttgttagggaattgatacaaaaaacttaaagttagcagagagttatgtgaataaattagagtaattttgggagttgtaggagtaggggggcattatgaaataagaaaagtctctgagagttgggataggatttaaacactatcggtttttttaaaaaggaattttgccacattccacatgcagcttgcaaatgtttttgcaatgactgtcttgacatatgtgatactcagaaaaaggtggaatgtttaaatgaatagaactgcataccttatatatcttgtttgctgggagttagattcattacttgaataatttccctaatgagtcattcccttaggggaattatccctaagggaattatccccttagggaatgacttatcccatgaaaataattggattatggcttgttttgtgcatatatgaaatccagtttgttggacttctacaacacctaaatataggtgaaatttaccttgtgttttggacatgcaaaatattggatagaatatttaaaaagaaaaaattcatcaattcattttgctagcatttactcttcataattgaagctgaggctgggtgcggtggctcatgcctgtaatcccagcactttgggaggccgaggcgggcagatcacgaggtcaggagatcgagaccatcctggctaacacggtgaaaccccgtctctactgaaaaaaaaaatacaaaaaagaaaattatccaggcgtggtggtgagggcctgtaatcccagctgtaagggtagcagcctcgggaggctgaggcaggagaatcacttgaatccaggaggcagagatcgcagtgagccaagatcatgccactgcactccagccttggcgacagagagagactgtctgaaaaaaaacaaaacaaaacagtagataggtaaaatgtttgtggctttagatagcttttttttaaaaaaaactttaaagtgaagatttaataattataaattaaaaatacactacatgactcacttgatgtttccaattttcatctcctatgtaagtaacgatacagagaatgcatacaatcgttggcttgtggacatccatgtccccagttgtgtgtatgttggaaatggttataagacatggggattttcttacctcctgttcataattgcttcagctacagatcagattcccttctaaacaaatggtaagagaccacctcagctgagccttgggtggtgttttaggagcaattgctactctacttgaaaaggaaaggtcctctgttttcttatgcatagcatccaatgtaaaatgaatgtagctctcttctttgaccttactcttatttgcatactttaatgggtgtaatcatagaaatgttgcatattcagcataactggattctaacttataatttattttaaaaataaaagtactgttaaaaggaatttgagattccaggatttcttacaagtataatgtacaatgtatgttttatgatcgaaattagctggacttgaagtcaaaagaactagttcaataacatgtgtcttaacttgaaatcttggtttcctaatctgtaaaatcaccaatatactagaatcttggtgttaaaagtaacctatggggcagtttgataccacctttaactcagaactcaaatttcttttataacatctttgatatgtggccgtccaatgatagggtgctcagtgtctcattctttaatcaggtgcttatagctttgaaactcttgagcatagaatactgatggtaatattaatatctgacttgtctctcatatgaagtaaggagaatgaaagcaaatattaaagtagcaagtagtagttatacagtgcttttttaactaatgacatgtgggaactagttaccatttgtattaataattttttaaaatgataaactaaattttaaatctctgacaatgaccattggaacccagcctgtttatcaggtggagtctgccagtgcttccagtatttttgatactacctagtccttgaaaattaaaaatcttgacccacaatttaaaagccactgggtatgactcttgggaagacatttcgattacctagtatactaaaagactttaatacaaattgaaattatatggaagttacttaaacatttctaaagtaacactaaaccacattctttaatgtattatgtgtcatgggtagcattgcctggaagaggtagcagcaagctgagtttatgaaggaaaaaaacttctgagtgagctaaggagctggtgggtagagtgtggaagatggagcagacagactgagatccatccaggcctgggaggggaatgggagagagaccagggacagaagccagacttgacacaatccctgaagaagataaaagaaagtgatttaatcaccttccagatcttacttgcaaaagggctacctgtattctttggatgaagtgttagtattattagaatgacccatttttacttgtgttagcttcagtggatctttgttccttgtaactgaaagagttctaatagagcactaaggttaaagacaagtatcaggggtaaatatttggctgaggcctgcttctgaatactattctagacatgacctctcctcttttcgttcttttttccacaacatcattataaaatatgaagtaatcctttttaatttcttgtctttctgaatttaaaattctatgttaggtattctcattgcttgatttgtgtttattatagaaatgaagagtttgttttaaactatgcattactcgaatttctgctgaggaagtccatatccatatgttaggttttttgcatcccaaagtcttggattaggttttgccatcattgttagtgtatcaatagaccactgcattattttcttagtggtatgtcagtctttgacttaatatttgcaagtatttaataataccccatacattataaattaaattgtatttggtacctgctagatcttatgagaaattattcacatttaataagaaaacagcaacttgttacttttgtggcagatatgagctcttaaaagatgcaacgtaggtaaataaaaatgagaatgtttaccagacccactaggatcatttggttctgtaattcttatttatgaacattttcttacagctttgttctaatttaattatccctattcccctttaggtaaaggatatcagaattgtgattatatgaagaagaattcttcttaaaaatcatgtattcttggcaaatatttcttattagaagcttttaaaacagtcttaatttttccttacagacaaatttttctgcagtgttgtcattgatataatcaaaatggtttcaggtagttcagaaattgttgacagacttaactaagaaaaacttttgatcaaatggtgtaacaacacctttcctggacaaagccatcattattctgttaaattttcagatcttatattcacatcccatttaccctaagtattatcactaaatggagtattcagtgtacacacatatcctcaacttgattttcctaaatggaaacaatttttttttctccactaagaatggctttttattcatatgtgataaaaagataagtcatttggtaacacctttgaacctgttttcaaaataatgaaaagtttctcttctaaaaatactttttttctttccctcgtttatttaacaagaagagttattatgtaatgtttttctgcagatttttagaaaaagaatgatctctctccactttgtagagaatgatcccattttttgtttaacaccagatagtatcatgacattgttaatacagtaggattcacccagtttgaaagtatgcagaatcagacttctgttgttggtcacatatttctcaatcaaaacatctgtctatgtcgaaaccaaagtcggcccagtataatgaacttttaagacccatgttaatatttaaaaatatttggtaaactgtaaagcagtatacaaaagtgaatatttttatccaaggtgtaaattggtcatatggcccaataccagtagcataaagggaagccactatactagtagtgggtgaccaagtttatttctgttaagccaaaatggagatttattgtagaaaattattagtggtactttctggatgaagccattccttcttaatgtaattatgcccaatttcctgggtggagtcacagtctttcttctaaagacagattacttcaagctttagtagggactcttagttctgtcttgaactaacaataccttaaaatattctgcttcttcatgtccccaaaatattgatcagaaggatacttgtggtcaaatggatgctgtagaaattcaaaccagtgattttactccacttgaaatttaaaggattcatatgagttctagttgagtatgtcagttttagaacatagtttatattgagtaaacacagaatattttacctaaaagggtcacacagatgtcattacagtgaatttacttctgattaaactaatcttgttccctatatattttgatatatattgtgccatgataaccagtgtactattagtgttattaaagtctttcttcaaatagtagatttttatagaattttgaagtagacaaaataagtcaatttatgtttagatttaaaaaaaatgtgaaagcttttctatattctcctccccgtgccagataggtgcttggcacagagtacttaataactatttaataaatgacagaatttcttttcctaaaatttttaggacatatgcaaggaaatttctcttgcatctaggtttactgatgtatatgaggaagagttacatctgcttcagtgaaatacaaaattaaaccaggtgatctttctgaaaaattattcttatggtgacatatcagaaatcttatcaacagctatagtttattctgttggaattttcaaaatacactgtgccttaacttagaaacactccaatgaacttgtattcattagtgttttgttgagttaaagaaaaaatatctgtacaaagtggacacattgtttaattttgttttgcattttactagattgcagtgcaaggccaataaattaaacctaggcagttctcttgctaattacacacaacttatcttgagtatcagatattcaaatccattttatgaatatggtagagagaataacaactgtaaaacaaagcagtgtgcatgtaagtgactgttagcgtgcatttcagaaaggataaatgctcaccatatggtacaattactgtgtccaagttttcaaattagcttctctcatcctccttattactgtctttaaaaagagaggaaaaaacccaacatgatttatctactctgcagcagaactcttgacgcaaaacagcagcccagttctgtccagtttttttttcccttagcataatagaggctgtcggacttttttatactaattactgtgtgagcctcagatgaacccccttcaattcacagggctttgttaagggaggagctgtcaatgtgtctgcccgtttgcagctgtgctgtggctttagcttgcttaacattatgctgctttttagacttgacagaagggattttttttttttttttttttttttttttattaaggcaaagcagccttgtagcgaaatggtttaagcagctgcattgtagggaagcacaaagaagttattattgtgtctgtttaggggggtaggatggagggggagatattcggctgctgttgatgccgattgttgacttgccatctgccagatagggagaagaaaaaaatgacagctccagcagggtgttcaagaggttgtttggagagacgcataaacatgtgcagatgtcgaactgaataatggctagaacttgagacggtttatgatgctgctgatgtttgtgcatatacagaatgaatgtatgtgtggatttggttaaccaagggtacatactaattatcattgttttcctgcatcccccctcccttatttcgttaattagtttaggggtttaatacttcctcttctctcccttattcatgtctagttttagaaagcaacttctttaaatggcaatacaaagtttcttatttctccgtgttgatggtagataacctgtttggctaatgttaggtgtgtactgctaactgccaagaggagcttttgatgaaggaatcagtcaggtgatttggtgtgatcttaatgcatacatgaacgttttaacactagtcggcacataaactattttaaactgaatcgatttgtttcatagcctaccactaggggtgaggtagagagtacccagtttattttgtaagtaattccataatactttgaacttaaatgtcgttagttgtgaaacaaagttatatagtaacctggcctttttgatcagtacatactctttttctcatggttgtcatggattctataaatgacaagcgtgcatttttatcaagcattaatgagttggttgtatatttccttctgatacattcttgacattaggtgttagagatttgatatatctggaatgttttcaaatgctgtgataacatttatatttagatggaagtgagcatgtttacttaaatgtctggtttattactttcaccttaaataattgagaagaaacagtgaccttaggtaaaaattttccatattacttattttctagaacaccaaaaatttttgtaacatttcagaaccaatcaatatgaatggaataactagaaaacaaaaaagagaagctctgacttttctccttttttcttttttccgcccaatgtggacttaacatttcaaaaaaaaatatgtgtggagaattaaaaagtgcttatgttgacttttggaactcatgccttcctaaaacatttaaggttttgttgcataattatcaagcagaaattgcccaaagcatggttgaaaggccaacgtactgacagagcttcgtgtccagagtaatgtctttctgaaagaattaaaggaaggttatctgttattttctgcttttcataaagaaatagaggtcaggtctatctagaaaaaactttctctctcaccgtcagtttttactcaagtgactctaatccgtgtttgctgaaaaggcatagaaaatcatcagccaccttgacttttcctttgtctcatgtatttatttcttttatataggtggccgtgaatatatccatatttgtgtgtaggattatgtccatgtatttacagtttcatagtcaatcctaatatccctaccaagtttggaggcgagcagtatgccattttttaagtagaaggtgtttgttattaaagtgagagggtatggtttgtcagtggtcaggatattaatgagtgactgggaaaagcaagcttataccaacttttatacacaagcaaacttgcaggtctatgctttattaatgatatgttacttctgattctttcagagccatttgctaaatcttagtagtacaggcaagtatacatattaaggtgattgaaatattaaaggcagaatgtctttgaagttacaaagaccagatttaaatatcacttaacttagatgagtgaatttactcatagtcacttaaactatttaaatgtgaatttcttcatcttttgaaagaaggaaacaatacttgctattcaaggatcttgtgaaaacaaaatgagataatatatttagaatgtcttgaatgaattcagtagtagctgttagtatttttattaggtgttatgtgcaagtctagagctctgtagctattacaattggagtatttatataatgctctgactatcatagaataagaataccaagctgtagaggctgtttgagagaatggtcacagatagaaggttgtttcttggaaccttatgtttatttagggatatatgattgttttataaatgtggagggaaataaattatttaaagaaaatataaagaaaacagttggataaaagtatttcggatgtatggtattagtggttatttagtgatgatgatttcaaattttgttcttttgtttgtttgtttttgagatggagtctcactccgtcacccaggctggagtgcaatggcatggtctgagctccctgcaacctccacctcctgggttcaagggtttcaagcgattctcctgcctcagcctcccgagtagctgggactacaggcacgtgccaccacacctggctaatttttgtatttttagtagagacggggtttcactttgttggccaggcttgtctgtaactcctgaccttgtgaaccacccgccttggcctcccaaagtgctgggattacaggcgtgagccactgtgcctggccagctgatttcacattttgttctacaaaattatttttcatacttaaaaaagtaacctcagtttattttggagctgaacttttctctgctacggccagtacttaagctgtatttgggttattatctttaaaatgagactttggaacacctagctaaaaataatatttcttctcctcatggaggtttaaagcattatttgattgtcacaactctttattttgcagatgaagaaactaattaagctcacatagggatgaaagtgctgagataagcagaagtgttttcttagagaagtaaagaggatatggctttggtcgacatgaggaagtcagtaaacctaaaagtatgattaattcccatacagatgtaggtggtggttctttacatttttcttttcaaattgttttcatccggcattccacgctagtaaatattactgaataattttggatgatgagtcaagggttgttgtacctgggagagccacctaatttagtatttaagagtctttcataggacggggtatagtgactaagaacttctattttggtttaaaagaataaattggttacactagaaaaataacgctcacttttgaatggagtgctagtagcttcatataaggatattttaatgtttaatggcacatggtgatggatgccagtatttctagacagatagttaagtgttacagtctaaatttataaacaaataatttttgttgttttttataaaaaacaacttacagtaccaaagaagtggaaatatccatagcctatgaaatatatcacaaatgaggatgaaactgtaaggacattttcacaaataaatgaaaccgtacttggtatattttcaggataattcagaaaacttcagaaacttctagctttaatgtatatttgaattgtgcctcatcaaaatactgcatgaatagcaatttttaaaaatattggccagtatgttgaaaacagagtatttcactgtctgacatattgtttaaggcatcttgctaaatgttttggcttaaattttttaatgtgttttagttcaaaaaaatctgattaaagatgtgggtaaacgtggtagcactttttagaacagaagatgattaagatacaaaggcaggaaaagcataaatcgtgaagtttgtctatttttttggccaagcaagtcacttatttgcttgagactggaacacagcatcaaagttcataattttatacttctaaggaagaacgcatagaacagcagttgttgtttcctggcatctttttgaagagatatttaaacgtaagtatatatatttattatagaaaagaattttataaaatgaccttcattcccttccctgaatttgtagtatgttcaactgttaagctagttccttttaccttttgatttagtaaagaaggattttaaatagaatttaaatttttatgatcttaaaatatccatgatattatatactttaaaaagaataagactgtttagtagttcaaattttaaaaatctaatttattcaaagttatgctaaataatggcatagttcctgagtggagaactactatactttgaattatagaagcaaggacttttttgaaaaagtaaatacaaaacctaaataaaacacatttttactaaatggcaatcagtgtcatccacgtgagatcttgctgtgtcaaagtaaatttgctgtttacctgcttgtaataatttttatcttccttcaatagaagctctttttttttttcttttaatgctaggttttgtttttttttttctatatgggagaagtggtgggacctggaaagttggatagttactaattaacttgtatgtaaaactctgacataaagattagcactttttatattcttaaagtaaaggtctatcataccactggattatatagggtaagttactcagtgttttgtatataaaaaaaaaactttgataagtgaatgctagaaaacttttcctttctgtgaaatagcaaaaggaataaaacacccagtgtacattgattgacttagattctagaatggataatccttatgctatgtaaagattcttagtgtaagaatcagttatgaaaactcagtgagtgcttcaactccacattgccaatttgtcatttgcattatatttcattaataaatgagtgatttgtaacaaacgagtgtattggtattggctgcttttaagaagacactttggaactgaattgttatcctcctcaaattactttgtctttactgaaagattgtatatttagatgtcctgcagtttttaaaaacaaattattctacagagagcaaaacaggaacttagattatttatgcaatgtaaaattcttatatacttttttattttattgtattttggatgacttcagtgatactgatgattccatgcattttccttcctgatgccttggttttaagaaaatctttcctttcaaagtcactggaaacatttgaaaacagcattattatgcttactgaggtacagataatgatgaggaaagaaatatgtacgtataatgagcaaatatgcccatttcattttaagaaatttgtttttattagtatgataggtaaagattgttttctgaaatttctatgtgttaggtaatactgccctcagagggccaaggtaagtaaattcatttttaacattgagaagcagcttttctatttatattatctataagctttctttggggagtactcaaaattatttatttgagtaattgaatagtgtttgatttgtggttgcatttctttgatttgttgtgttcttttaaaatgtttgtgcccttcaattcgacgatatcatttaaacatgttcagttctagtctaagaaaatgttaacatgactggccataaattgtcaaattagatgggttcatagagagtataagaaaattacctggaaaagttaagatgattttacttggcgggtgcgttttagtttttgtgtctttgatagcagatattctagtattcaaaattatttgaagccacactttttaatatagagcagtattcattaaaatggaagcatagattcccttcagttttaaaaacttaagcataatcacatctttcaaatataatatgaatcaagagtaatttactttgctgtatatgcagtggctatgtataaatatactagaagttgaaatacacttattcctgtgcacttataaaagcatacgtttttaaagtagaggtaaagacctgatattgatgtgtgacttaacacttctttgaattcagaatattggggattagatgatgattaatttttgtaataagaaaggaagagtggggaaggcctgatgtcaaaataatgaggtgttcagcatcatgctgtatatccatgtaacaaacctgcacatgtaccttctgaatctaaaattaaaaaaacccagaataatgagttgtgtccttttttctttttgtatggagtaactttcttataatttgaaagaaacattgcaatgtttagtagtaaattcagtggaaggcttttgatttttttgccctatagttagttgttattgaattaagaaagatgatttctgtgacagttggtattgtcagtctttcactagagatttcaatgagttaaacataagcgacactcagttcattattcttagtaatgagggatgaagacaggacataagcaaagtgaataacaaaaatagaaattttatccacaaaaaatcaatacctcctttgctcagctaatgtgcaatagtgatagtctagacaaattaaagaaattccattttattttaaacactctagttacttttgtgtagtctaacatattgtacatattaggtactcactaaatctcctttgattggtttccttagccttactctgagatgttttattcagttaacaaatgcttacataatgcttgcagtgagctagatgttgttctacatgctttacaaactttaatttatttctccattattattgtccccattttccagaagaggaagctgagacccagagagattaaacagcattcactgtctctcacacagctagtgagtgacagaactggcatttgaacccaggcagtccagcttgagagtgtgcgctcccaaccactctttgaatcttaactctgtcctttactagcttgtcccagtgtctcagagcctcagcatggctctctgtgaaaagtgagaatactgcagcaccagtctcagtgttgctgtgaagagggctctgtaagtgaagcctgagcacagtgcctggctgaggacattcatgtttccttttcttccttgctcttacctcttcttcctttcaccacttaacatgctgtggtacaagactcaatcagtacattgtctaaggagaacaaaggagggaagagaggagttatgaagggcatggattcatcctcagaatagtggagctctcggtttgatgcagtgccattttagggtccatactactagacttttcttagaggaaaaactccttggtaagagtctaagataaagtcctattagtttttattctgtagagcattgatgttagtataggagtgggatgggtgggttgaaccacctgagagttttttcagatggcacagaccacctcctgatgagcaagcactacagcctgccttctctgcaaactcccagttagtgctgtagtgaggcaccattattgttatttgtcatatccatcaggcatgttctaacagaaaagtggattgaaccatacgaggttgtgttatagagagacttctctgtttgagagagcttttctgacaggagtatagtctttatttcaaatggtggtaggtttatttagtcattgaattaatggttattgcccacctctgtggtagtttcttgcgttatggactcactgcttccatatttggtattcattaaggttatttactgcagtgtatatgccatgtatgatattatatttagataatataaggtggtaaaatgggaaatatttacaataaggaagttttaaagtttctgatgaaattatatttttaaattggtctatatttataatagtttaaaattctatgactactttttgaaaatggtgcaagaatgactttgtgttaaatccggtgtgtggaactggaaactctgctctaatgcagtaaacagatttttaaaaagaaagctctgctttcacagcctacaagggtgcagatgtaagcaaaataataacttagctcacacttaacccagcaggaggctgcgtacagattgagtaattctccacaacatacctactgctatgtaaactaaagtcaccgtttattcttcattaaattgccaggatgctttctgttggctagtccgtgtggatgctttgttctctgtgtctccacccaatgcccctgtgccttccttactcaccttgcttttctcttagagtaaaactgggtactgtaactctattaagatgttattgtgtttaagagaataatttaaaagcatcactttggttaaaaatgtaatgtttcctaaaaacaagtggaacaaggatttgattagtcaatttaccgaatatcatgaaacaaataccagaatacttaagggtagatgataattatgcagttttctggaaaacaaaagaaaattgtaaagcagataaaagtactaacaaaccaaccatactgagatcttagagaagttgccattctaacatcttgtggttggtattcaatgcataggtatttttctcatcatctcatcagcttcaaagcaaaacatggaccccagctttctttaggaagccgatatgaaaactatacttcataatattgcttctcggacttttggctaagatgaagtgaaaactgtacttaatgtaaaaatgacaagttcatgcattatgcattagaatgagagtttcttgactataatatacttttcaaaataatcatgagggaacatatgtggcaaagcagaggaatgtgggtacatctggaaagcctttaagacatctcggaagcacaacacaaaatcacgaaaattgtaaacaccttccgtgtggccagctgcagtggcaacattgaccagtccaagagcagacaaacatctcagtgacccagagtttaccgggtgaaataaccataaagagaaattcaggtgtttaaaaatctgaccttattaatcaatattatgcagaaatcagtgagaaagacaagaatgggcaataatcttaaaacctgaaacgtaaagatgtgttatttattattctagatgaaagggtagtaaagctattgccttgcttttgcttgtgttattgtgaggcttcaaggaggaatgcaggatgatgcagtgcctcatcttggaatcaacatagcagcaaatcgaagaatcctacgctgatattcttcccagtcccttccccacagttagacgtcaaaccaacaaatatcatcgactacctttttctgaatccacatgagatgctatttagaaatgccaaagaataggggctattgccatccccagtatgacattctggatcactaagaatggttaaagaaatgggagaaattttcacttaaaattttaattagtcaactcatccccttttcttctccacctctcacagctgcctactagacttaaagctccacgagggctgggactatgcttgtatcatttattaaagctccatgagggctgggactatgcttgtatcatttattgctgccttcttagtacttgtacatattttgacactcaccgagtatttttgattgaataactgttagcccgtttttcttaaatctaagtaaagatgtttaaagtggcttttttgatctaggtggtcttgagcagcagcaccttaaaatgagtgagctgggcaggagttcataatgcttagacattgctcaattttcacagactatcaacacacatccaaagctggttgatgacaagtggtcaaagacattgcatagacatcagaatagaatttaacacttttcagttgcctgagggcaaggaaagaacatgtttcaagactcaataaaagataaatgataacctaaaaattcaggtttttaggagttggaaaatctaatcaatatatgtatttaataagtacctataatatgcaaaatcactttaaaaagttacatttcatattgtccctgtgcagttgaaaacttacgctagtttattgcaatgtagataatatgaacaaaattcttcaggatatttttctttttcttttttttttttttttttgagatggagtcttgctgtgttgctgagattggagtgcagtggtgcaatctcggctcactgcaacctcccgcttcctgggttcaaacaattctcctgcctcagcctcccgagtagctgggattataagggccccgccaccacgcccggctaatttttatatttttagtagagacggtcttgccatgttggccaggctggtctctgactcctggcctcaagtgatccgcctgcctcagcctcccaaagtgctgggattacaggagtgagcaaccacgcctggcccaggattatttttaagacatcaataaaacatggttatgataagttgagtgagaagcacatttctttgattctctaagagacatgaataggcttccactcagaactaattgtactcctctgtataaaactgtaatcagtaattttaaatactgcaaatgtcttattatatttattgtcatgcatttcttcagcaactataattgattactgatatttaagatgtatcacataattatggactatacagtattttttgtgctaatatttatttatgaaatccattagtagaaaagattttgccatattcttttaggtagttcatatgtgaaaatttggtgtctgtcaacaggcaactaaatatttactacattgtgaatgatgaaattaaatagattttatgctgaaattaacattgtatctgtttttgtcttaggtaaaaattggctcatgaagacttttatttaaggagtattgccaaagatagtttcttgaagcatgtacatttatttttactgaaaactgcctttttctggtttaaagctgctctttgaaaattcataaaatgtttatatttttatggtactgtacatttgtgtgtatcatttataaaaattcagaagaatctgacttctgctcttttctttggaagactagtttacccctctgatatcctgatattcaaaagaactaaaagtattagtcaaattaatactgtgtttagatgttggataacctcttcatttccttacataaaatacatgttttatatacctgacactagccaaagagacttaaaaaattcatcgttgcctcatttatgtaaatacttctgaataagtgcagtactgattagtagaacatttaatgtgtggtttgtagttggattataaattatattatcataagtggtattagtattagtatcacttgctaacaaccaaatcaaatacttgaaatatgtcaggtaatgttctaagggctttttacattatgtccttacaaaaaccctttggtggataaaaactatgatttctgtttttcagatgaggaccctgagatgtaaagaggttaggttcatgcatctaataaatgatgtgattaggattcaaacccaagctgtgtgactccagagtccttgctcttaaccattacattgttctgcctggagcattttaatgatgaggttgagtgggaaagaaactgaaggctaatttgagaagtttgttgacctcgtattgatcacaacaatttgttgtaccttttgttacacaacatagcattggtttaaattaaaatttcttttattctgaaaatgtgaccacatgcttttcacattgacagtatggccagcttttttttttttttttttgcataaattctatggctctctccctctgtaaataataaagattgcgaaagaggttattttttcattaacgcatgcattaagtatagatgtaatctatacatttttttcttcagagatgtataaggacaaataatcatacatggtaaaaactttgtgactttgcttgtgattaaacatgaaaattaaatatttaaaatacagcattctgaggaaagctgagcttatacttgttttagctttatgataaaacagtaacatctattcctgacatacatgtgaggatgctcccaccgtcttccttatgcagtgattagctttgaagactatgttacaacaagtttgagtgagcattggtatcttaaaaagctagcacctgtatcggaaaattagaatttttgtttgttatgcaactcttgataattagggtcttttttttttttttttgcattttttcttaggtaagaagcatatttttaaaatggtgattgtgttgtttctaattaaattctaaatgaactaaatgaatttcaaatgaattttatgggatttgtgaaaaatagtgctatggttttatagatttcttttcaattggattgtatctatatttgtttagttacatctcagtgaatctacccgattgtgtttttagcatagtccatgacagttgaaggtagagatgagtatttctgcagtattctcaaccagtacccagctcacttcacatctttctacctttcatgaagttagaattagaactaggttctggaacacaatgtagccttaaaaaggtatcagatattcatcaacatgatctatttgtgaggtcacaaggctgaattatttctgaagatcttttccatttgcatgtctgaacaaatctagatattccttagttattctagatgaaagactatttgcacattttaatcaatcactgtttagtccagagatgtacacttctagcttctgccttggcgcttacgacttcagcttttacacttacgacttaagcttttaaaaaatcaaaatgtgattctcagtagagtgttgatgaataatgaaataaaatgtttatatatggactaatttaggttgaagattattaagtaaaaatacagtttgttgttatcaggtgaatggtaggaagtgaacactgtcaactttttggtgagctctggtttgagagtatataattcatgataaagatgatttatttgaatatcctatccagatcttttaggtggaaagtgagcatgagtctaaactcataccaggtcccatctcaggttgttattaaagactaagcctggccgggcgcagtggctcacgcctgtaatcccaccactttgggatgccaaggcaggtggatcatgaggtcaagggatcgagaccatcctggccaacatggtgaaaccctgtctctactaaaaatacaaaaaatgggtgggtgtggtggtgcgcacctgtaatcccagctactcgggaggctgaggcaggagaatcgcttgaacctgggaggcagaggttgcagtgagccaagattgcaccactacactccagcctggtgacagagcaagactgtgtctcaaaaaaaaaaaaaaaatagactaagcctgaggtccaaaataatgcagtatttttactcagctgtggaaattcaggatgttttctatggtcaaaatttactcaaaatcattgagatcgtttgttttaactacagggaataagttattaagtgaagtaagaaaggtggcaaaggtccagaatctgaagttattaggactaagtaaaaccatgaattctagcaaacagtttcttccaccctcataatttacaagtaggattctctaccatttacagtagtaatgtggattttcctctttgcattcagaaggtgctaactgaatctgtacatgtcctatgccaagaactcaatgagtaagtagtagtttttagctctgttagcaagccattggtcatagtgtttaggagctgtatttcctaggactgctgtcacaaattaataaaaagtgggtggcataaaacaacagaaatttattctgccacaattctggaggccagaagttagaaatcaaggtgtcagcaggttcacactcactgagaaggctccaggggagaacccacttgttgtctcttcttgcttctggtggctctaggtgctccttggcttttggcccatagttccaatctttgcttctgtggccacgttcccccttccttttctctgtgtgttcagtttactcttaaaaggacatttgtaattggatttagggcttacctagataattctccaggggaaaagtccatcttctcagaatccttaattgttaatcacatgtgttgccatataaagtaatagtcattcttttttaccataaggtaatattcacaggttcctgggattagggtgcgtacatcattcgagggtccaccactcacctcactaccagaagccagtataccagaatccttgctgggaaatgtatttgttttggtattgataacagcatacttcaacataggtatagcttccagcaaaagagtgtgagaaagaagtggaagcacccatgaagattatatatatatatatatatatatatatatatatatatatatatatatagtggaagaggttgggttggaagtcttaaccagttgtgactgcagtgcttgctgaaggtttatcttgacgatacatttactatttggatgtatattggtgggtgtccattgaacaatctctttgggatacttggtacatcataaatgcttcttttttgacaagactttccattttaaccaggttgtgttttaaattggttaaaacctatgggccataaacataaaagtatgatgcaatttgggtttgatgcatcatgtgtaaacttagatgcaaattctgtgtttaaaataaaagattgacttttagcagtccgtcttaaaaggattggtggcagggagtgtactttgttctgggtacttagcctcataaaagctaggactttctgtccatattttagaacaacctgacaacacgtgccttatctgaactcacactgcctcaacttctgagctagagatgaaagtgttcagttccttttcgaacagctaggcacctgaaatctggtataatactggaattaagctctattaagttgtctttttttttttttttggtccagcctctgtaacaaattaataatgaatgcattctaagcatcttctcagaaagttaattcatattataggtgaaaaatgacaagaaaatagatttagtagtctttattggaagtttgagatctacttctggcttagtatcacagtataattgttgattaaccaaatcaatttaaaattatttaaaaagtttgtgagaaataatacttttttaaggaagaagggaaattctttaaaatttttcttctatgtgagtgagtacatcactatcttggtatactgtattacgtttgaaggatgcataatacatttatttttaaatagctttttggcaaccagaagtcctgctatagatcatagaaaatattttaaaagtttaaaaatctgcttaataaaaaagatacaagatttatataatgatgtttttgtgtttttcatctgaggatgtacatagagggaaattatgcttagaaatgaaaatttgatttcttttaattttacatttcttgaataagtgtattcagtactattttaaaagaagaagaaatggtgttattccgtgttttcttttgtatttttcaaatggatctgattcattttatttttggtataattattaaactattgtgatttacctttacagagttacagcatattgtaccagtataaatctcttattgctgtacaacaacatttgaagtctaaatatgtcattaattggagaattaatacctaatgattttgaattttatataggaataaatgaaatggaaaaataaaataagagcaattaaggaattattttatttttcaacgtgggaattgtgtattaggcattctagttttataaattgccttattaagtcatgtgcttattaatattagggccgtcttttttcagtaaaataaagtgaagagcatcacttttttttcttttttctttaaatttcttttttgcccttacatacttatgtggaggatactgatctacgtatcctctatttattcatttgtttaataaatcatgattgagcattaagtggtgggcaccagcttgggcatgtagagtattatcacctcaaggaaaacaactgacagtatatgctgtcactgatggaaattgagcttttaagcaaagattaaatttgggaaaacagatctctcgttatgagcttgtcagctttccaatgtttacttttttcatgagactggtattgataacaaatgtgattgtataatgaaatgtgtcaacattaggaagatcagcatagcacgataagccagggttttctatgtgaccaatgcataatgttataaaattatagacagtgttaaagattcattcaaagtccagtatagatcaatggattttcacataatagtacagaaagttcattgttaaaagtttcaagttctacattgcaactaaccttttagaaactaacccttgttgaattctggtgtagtatcaaagaatgatatccataactatctgaatatttttccctttttcagcttcatatctctttgagccagattttttccccctaaatttaaaccaaaacaacatactgcagcaggatgttgaaggcaggaacagctaagaaaattaagctgtcttctattaagccagacattaaatagatttgtaaaaatggaaagcagtgctggtctttgcatttttctttctttaaagaaaatagttattttttataaaaatatgttatttgttatatgtaataaatttattttcaagtgaagtaaaacatttataaaatctattttcaatttcgaataaagtaaacatagataaaaatctacataatttgttggtgctctaagtaatatttaaggatataaagagattctaagaagtttaagaattgctgattcagaggaatgattccacatctgaaatacatgttggggtgagattgccctttatagtaaaagatttggattacattttatggtaagagactggactttacagtaagcagtaaggagtcacaggatattttgagcagaaaagtgataaagtggtacacacaagattaatctggaggtgatagatacattaggatggaagtggggaatgtgtagagtggggaaaaacagtattaacagaagagtagatataacgtattaagggttcagttgattgggctcaatcagagagacttgtgatggcagtattgacctaactgtgataaggaggggaaccttcagatgttgggtttgagtttgggtcacaagaagaagctgatttgtagggaaaattgaactgtttgcaatttttttgtacttctttgcctaagcatttgagatttaatcagcaggtagaaataaccagtagagaactgaatcaataccagatagccttctagctcttgtagcatcatggagcacctctgttgcttaaaattagaagttgtcctttagtaggtaagcaaattgtaatgtagttgctaaaaatgtgtattttggtggctaggtggtaccttatgttaagttctaataaagtatacatttattgactattatgttcttgacactgtaccatatattaatagttactatgtttgtgtatgtgtgagtttgcgtatcgttgaaagccctgttaacccatgttctttcgttttcttaagtacagcattgcaaaaaggttatttttctatgaagaacaataaaatgttgcttaaacaagttacagtcaagatttattaatgaaaatagacttttttctttcttttttgaaaaaaaaaagacacaattagtggaagagaaacatctatttcttgcctctcttatgataaatgtttttaatggaaattcattgatactgtgtggatgatttaccaaggctttttaaaacagctgaaaatatgctctaacaaccatctgataaaatgaaaaactgaacaaaatgtgtactcagatgattctctgaaggaataatggtgcaaatgaattatcaaagtgtgaaatcattaaaaacaaaacatgtttgggtttttattgaatcttaattgtaggcttatgtattttcttttgtaagctaagttaaaagaaaattgagtaactaaatttttggaggccagtgttgtaggacatatattgtaccataatttattttttgcataaaagctgctgttcatttttttcagcattaacatgcgtgctttcctcatgtaggagaatatataaaaaactggaggccaagatacttccttttgaagacagatggctcattcataggatataaagagaaacctcaagatgtggatttaccttatcccctcaacaacttttcagtggcaagtaagttaattataattgttgattcatcttgtatttatttatttttatgattttatgtgtcagatatcttaggctatatgagaaacctgtgaaaaagtttgggtttatatttaatagagaaattttcagctttgatagaatttcagtcccttagcatagaggttatcgataacatttggtcttatacaatgcaatagagtttaatatttttatgtagaacttgaatgtgataaatataattccccaaatacatacttcaagtttttgtttataacataaaaacaaggacctttgaacttggttgttagatttagcatgattataagatgttgtggtacttaatgcactttaatcagtttcctgtcataatcttagctcttttgattgtgtgatgagaaacaggtgatttatattagaaatcatcttctggggagattttatgttcgtagttaaatttttcttccttacaaatatctaacaaaaatgtttaaaacttacttagaaattttgtatttgcatgaacatagcacaaaataaactgaaagatgacaatgatgataatgacaatgattattattgttatgttattaccaggctcttccaactcttcaaatatattgattaatcaattagagaatctttgtgttaatttagaagtaaagtgttttaaattacgctaagttaaacttgcctaagatctagctcgtctgtattattaagctaaaatctttaacgagacaatatccttaattttgattttggttatatgttatctattagccatatttgggaaaaaaagatacaagggaaatttgaagctaaaaaatgcaataatataacaaaaaattcaagaaaataagtctttgaatgttacaaatttcattttaccattataaaagccgtgatctttttttactcctattgtttaattcaggttagcccttattagtgggttagaatggctactgtattttttttaagaaaaagataaaacaataaaccaaagggttaaaagatttgtgaagtcatttgaacgatatggatactaacttaaaaaaaaaagctttctctgtttatattagtggattcttaatatagatattttttaaatgagatcactatgaagtgtgtgtgttagttaaggaaaacatcttttttcccaccaaaatgctcattagataataatggttttctttcaatagaaaattattttttaaaccctattgtcaactgaaataatatattgtattttgtattgacttaagaacagattttcattttaaagactttttgagtgaacatttgctttaaagtgatagaaattagcttttagaacataagcagcatacattatctaaatgccctacctaaagccagtgtagctttttagtttatccattttaccagcaaatgttattggtttttctgaaataatttataaaagtacagaattcttgtatctgctgatcaaaatgcagcattttttgaccttatgaaatttcacaccccaacgagttttaaagacatactgtatgtcacagtctgccaacatctgctccaacacttccactggcagaggctgaaataaatgctgcactcttggggaaggatcctatttagtgactgacagtcagcttatttatccatgaaataaatactatctgacatctgtaatcttgtataatcaagtagctgtaggtagttgactcaaactaacaagtaagttgtaggttggctccttagttttaaaaagtattagtaacatggatcttactctaaataaatttttagaaattgattattactaaagcttgacttaccgcaatcttcaattctgtaataacagttatgtgaggaaagaatgagtctactgaaatggatactagctgaagaagtagttcaaattccaacctggccgcaagctgcaagtaataggaccttgggcagattattctctgaaactctgatctttatgtagtttcttcatcagcatgttagaaacatttggattcagtggatttgtaaggccctttttgtccctgacattctgtgattctgtggggtggactttgagcaggtccttgaagagtgagtaggagttaagcaaattaaaacagagaagaagaatattccaggcagagggcaatgaagaatgtctttatgaggaattaaggaaggaacaattggtgcaagagagggttacttcaccattgctttttcctttgccctagccccctttagtacatttttaaaaagataattttacaaggtatttctaaggtatgttgggaaatgttatatatatatatatatatatatatatatatatatatatatatatatatatcaaattgtagctaccaaagggatatatatatccctcatttttctgataattaaagatattacttcatatttaatcaatatgggttttaatgaaattttaccaaaataggctttttatttatatgaaaagaacagagtatgagaactgtaaaggggtttgagaacttccaatcttaattaaattttgaattgcttccctcctgatttaaatttttcaaaaagatagtgttatactcattgtttccacttcgtatcccactgcagtctagcttcctcccttactcacttgattgaaactacttataataaattattgagtgaccacttaattgctaatgtaggggaaaagaaatatcttttcttaccatttcaggttcatggctgaggctcctataacaaaaggaagattaacaagagaaaaacacacaaatttaagtaataaaacttttatgtgacaatgcagcctttggaattgaagacccaaaaaaacacataaatttttttttttttagacagtctcactctgtcccccgggctggagtgcaatggcatgatcttggctcactgcaacctccgccttccgggttcaagtgattctcctgcctcagcctcccaagtagctgggatcataggcgcacaccaccatgcctggctaatttttgtattttttttttagtagagatggggtttcaccatgttggccaggctggtctcaaactcgtgacctcaggtgatccacctgccttagcctcccaaagtgctggaattacaggcatgagccaccatgcctggccaaacttgtgtatttttatgtttagggatgatgaagaggtggatagtcataaggactaagggcttataatggtaataaactgaagggaacttagtaaggcttgtttgtcagattcttttctctgtccctgtgtcttcaggaataaggatattccttccctctgggtatagtatgggcatctctcatatggggatcttatgacctatttcaggggaaggtcaaaaaattcttgctaagttttatgacctgtctcacgtgagaaggatgagaggaaggtaagaatggccttcctgcttttgctgttttctcaaatgctaaggtgctatcttttgggagatcatgtcatgaaccctgtcagtaagtctagtagacatctttcagttcttatttttcctggatttatatctgggctgcattttatactgttgatcaccatctcctttttgaccactcccactgtgttctgggatatacctctttcctgttcccccctaccccttaggctaatgcacagttctggtatttaacagggttctggttgaagacccttcacactttgtactttctcttgggcggacacgttgacttttggggtttcagttgcaaccttgtgtgcagcttactcccacacttaaatctctaggctaggcctctctcctgagcattaggttactctgttcaattggctgctggacatctctacctagatattttttgaccaggtacgtcctaagataaactcaagataattttgtctatttcttcctttgtactcagtatctgagttctgtctctgcctgatcaaaaacatggatcctttccatgccttttttttctccttcacatctttaccccactcccaatccatttctagtcctgctgattctgcatatttcttgaacctatgatccttttctataatcaccccagaatgaggcctcatcatatctgctgtagattcttaactagcttctctgtttctagtttgtaccactcatactctttcttcacgcgggtatcaaagtggtctttctaaaattatatcataactatgccattcccctgtgaaagccctgccttggatcatcattgcctactggataaagttcagctttcttaatacatcatagatctcttcaatctggcctctactttcaactcttgcaggatctctcttctgctctacaattatgtatcagcaatactgaactgtttataattccctgtacaacctatgctgcttttccactctgaggctttgtttatgctgttcccttcgattggaatgtcctttggtcctctatttgcctggatacttttctaagacttaattcagattttaattcccatccctattccttgctaaattagtcctctctgcccttcttaaatctattatcttctgctgttaacacattgtttcttggttatcttgttcctgtgcatgtctcattcactgatcagtaagttattttaggggaaagagcttagtcttatttatcttatatctcctagtgcttgtattttatgacttaactttttaagtgaacatctgaaacatctagtcgagatttctctttttttaggtgagaaaaatgaagcctttagaaattcagtgatctttttaaggttgccttactaggtagtagtagttaagtatcaagaataaaactcaagtgtctcgactatcacataaatattactcccctcccccacccctatattataacatttcccctagatttatggtgatgagacctgatttggggccccatttccagcacttaaattactaggtatcctttgacatggagaatggaaactccacaaggcctgtagaatgtggatagcaatatttgacgttcacccttctttgggtggatcacataagaactattaatatataggtgccaatgtagtgctgtagaaatgtaagtaaaaataaggtttttcaagcatagtacatctctaatcacaattatggtttgatggatttctaaggattgtagattgagatatatacaagaaacatgcactttaaaaaataatataggatacatacattgtctcagggctgcattttattttactttgagtaaaacagtttgtctgtccaggagtcatggtcttgctaacattttgacaatttgtatgaacctctcttgagtttactagcttgctcagttccagagtgggagtagttcccacatggaggacgtgtgcatttgcccctatgtcttgggcttatcctacttctgatcaattccttcttattctctgtggtgggatgggagaagtgccagcctgtgtcctaagaagcctctcctagaattctaccttattctatgctgcaaatattgtcccaccctgacaatatgcttttcttctctgaaacctttcttcagtcccttcttaaaaaataggttatttctgcatttataagcacaattttaaaagatgaaatatttactcttttttttcttttttctttaagttttttgttttttaagacaagatctcactctgtcacccaggctggagtacagtggcacaattacagctctctgtagcctcaatctcccaagcttaagtgatcctcccacctcagcatcctgagtattggggactacagctgcatgccacctcatctggccagttttttgtagagacagggtttcaccattttgttcaggctggtcttgaactgggctcatcaagtgatccacaccttggcctcccaaagtgctagaattataggcatgagctactgtgcatgaccaaagtatttactctctaaccgacttttctctctctctttgcaagtaagggaattatgggacttaaacctactaacaaacatctttatctcatcccagatgcttgggtggctaaggtggaaggatcgtttgagaccggcctgggcaacatagaaggaccctgtctctttaaaaaaaaaaaaaaaaaaaaaatctttgaataaatattatatacagagattttaaatatgtagaaaaatcagttgattcctattaatacttctagtggacatacatggggatagagaaaaagcttatgacttgattcttagtcttgtgtaacagataatacaacctagaataataaccttgtaattctagaaaaactacagactatgtaaatatatactatataaatgtacatgaattatgagagatcataataattcaccttcgaagtgttgattgatcattatacccatacctgatagtgaaaggaatatataataaaatttttatatgtaagaatttgtcattgactatggaagacattcacatagaacatatagcagtgggaggaaaaataggattaattgccaaaatgaattctgtagaaagtagctgctgtagaagttgagagaagcaataggtaagtgttggcgaggttgactgagaatttactcaggagatggggttaacatgagccctgaagaagaggatttgattatgtttttgtaagacagaggacagtctcaggttaacaacataagcaaacaaatgaaggcaagtattaaggagtagcttgttttgtgaatggtataggcaatatcctagatggatggagaatttatgctggaggaaaaaaaaaagctcagattagagagttagtaatcagattatggaaagtcttaaatatcaatgtgatgaaatttttgaacatccggtttccaaatcagtattcaatttttttaaaaggatgtacctggttatagtgtgcagtggaggggatacatccttaaacaaacaggctgcgagtcagtcagcaagatacagtttagtcctcatccttttcagtcttactgctaccatcctagctcagtgcttcatcacttcctttctggattatgttaagtctcctgatcaagttcttaccttcaaatattatcttttctggaatatttggaaacaatgcataaaatagattcatctccaaaaaaagttcctttgcaaataccgttctccttgcttagaaaaatttcagatgttctccatttttgacaaggaaaagctgaattattttttaatatatatccacaattaaacacttgcccaaataataactgtgtttatagcctatatcttttcattcttttttttctgttactctttaatgttctatacattttctttttgacatacattgctatattctggtcaggtttaattacatacaaaattcctaaccctgtgtttgtttttaatgatttttagatcatttaatcattttatcacttgaagatttggtgctttcttttttttcttgatttactttatttaaaaaacatttttaattgatacatattagatgtacatattttcgggtacatgtgattatttgatacattcatataatgaaatcaaggtaattgataaatccatcaccttagatacttgtttttttctttatgctatcaaatttttagacaaatggaaagttatatctgttaacaggtgtatcccactgtaaggaatagctgccttatcttaagaagtgaattaccgtaaatttaatcaaattttgcttctcgcttctattttcataggtagtgttatgttcagatatttgcagaatttaaccttaaaccaagtttagaattgggaatggagaaaacctttgtaaaaattattttaaaatgagatcatttttaagaaaactataatgtaacaatgtcacatatttccttcttcaggctccaattcaaatcatactccaatttgaaaagaacaaaaattccacaaaacgttcattctttcctactttttccttacgttgtacaacaaatgtggaaagaaaaaaaaaacagaaaaagtgtatcccatcttaatgaaaatgactgcggcagtcaagagtttcaaatccagctgccaggggtgaaagcaaccctctgcatctctgaaagatttcatcagtgttatctcctttataatcataacttttcatgtgtatcatctgagtttcttattaaataatctcactattttaatagttccttcattataacactacaggtgatctgatcagatttctgttttagagcctgcttcctcttctttagtagcttccacgatctcccagccttttcctgatttgtattcccaagccaatcattttagttacagtctttactttctgagcctcttttatcagaatataaggaatgggggggcttatttagaatcaaagggaatggtaaacttgtagaagacagtgaccatgcatactcattttaaaaatgtcccacagcatttattacaatatctggtatactggaacatcattggacttgtagtcagaagacctgactttgggactaggttctactgctttactagctatgtgatcttgggcaaatcacataacttctctgattttcattttgctcatctttgaacaatggagctaatgataccttcttcacaggcttacagtgaggatcaagtgagatcatatagccgagtggtgtggctcacgcctgtaatcccagaactttgggaggctgaggtgggtggatcacttgaggtcaggaatttgagagcagcctggccaacatgatgaaacccccatctctactaaaaatacaaagattagctgggcttggtggggcacacctatagtcccagctactgggctgaagcaggagaattgcttgaacccgggaggtggaagttgcagtgagccaagaccatgccactgtactcaagccttggcgacagagcaagactttgtctcaaaaaaaaaaaaaaaaaaaaaaaaaaaaaaaaaatatatatatatatatatatatgaaaacaatttgtatgttgtaaaatgctatccaaatagtattaacgtaagatagaaggtacttagtaatgtttgctgaattaactggcaatcattcctcctttagctaaattacattggagtgaggaggaaaccactttactgagctttctttaaagagtcttaaaggttttagagaacttgcttacaacagtctgttgcagttgaggccaaatactattgtttggttggaggaaaatttctagtttcatttcatgcctaggactttgattagtcagggctattctttcttaatgactaaacagagtgaggtacattcccaaaccctgcttatggcctccttctggccaaaaaagaagacatcactatggctaaagaagtaacacctaattctgtgaagaaagtcaatggtagcttgatggggatagcattgaacctataaattactttgggcagtatggccattttcacgatattgatcctttctatccatgagcatggaatgtttttccatttgtttgtgtcctctcttatttccttgagcagtggtttgtagccttccgtgaagaggtccttcacatcccttgtaagttgtattcctaggtattttgttctctttgtagcaattgtgaataggagttcactcatgatttggctctctgtttgtctgttattgttgtataggaatgcttgtgatttttgcacattgattttgtatcctgagactttactgaagttgcttatcagcttaaggagattggggctgagaagaaggggttttctaaatatacaatcatggcatctgcaaacagagataatttgacttcctctcttcctatttgaatcccctttatttctttatcttgcctgatttccctagccagaacttccaatactatgttgaataggagtggtgagagagggcatccttgtcttgtgctggttttcaaagggaatgccaagaaagagcccatatagccaaaacaatcctaagccaaaagaacaaagctggaggcatcacgctacctgacttcatactatactacaaggctacagtaacaaaaacagcgtgctactggtaccaaaacagacatgtagaccaatggaacacaacagaggcctcagaaataacaccacacatctacagtcatctgatctttgacaaacctgacaaaaacaagcaatggggaaaggattctcttatttaataaatggtgttgggaaaactggctagccatatgcagaaaactgaaactggaccccttccttacactttatgcacaaattaactcaagatggattaaagacttaaatgtgagaccaaaaaccataaaaaccctaaaactgtaaaaccataaaaaccctggaagaaaacctaggcaataatattcaggacataggtatgggcaaagacttcatgtctaaaacaccaaaagcaatggcaacaaaagccaaaattgacaaacgggatttaattaaactaaagagattctgcacagcaaaagaaactatcattagagtgaacaggcagcctacagaatgggagaaaattttcgcaatctatccacctgtcaaagggctaatatccagaatctacaaggaacttaaacaaatctacaggaaaaaagtaccccatcaaaaagtgggcaaaggatatgaacaaacactatgcaaaagaagacatttatgtggccaaccaacatatgaaaaaaagctcatcatcactggtcattagagaaatgcaaatcaaaacacaatgagataccatcccacgccagttagaatggtgatcattaaaaagtcaggaaacaacagatgctgaagaggatgtggagaaataggaatgcttttacactattggtgggagtgtaaattagttcaaccgttgtggaagacagtgtggcgattcctcaaggatctagaactagaaataccatttgacccagcaattccattactgggtatacacccaaaggattataaatcattttgctataaagacacatgcacacgtatgtttattgcagccctattcacaatagcaaagacttggaaccaacccaaatgaccatcagtgatagactggatgaagaaaatgtggcacatacataccatggaatactatgcagccataagaaaggatgagttcatgtcctttgcagggacatggatgaatctggaaaccatcattctgagcaaactctcacaggaacagataaccaaacaccgcatgttctcattcataagtgggagttgaacagtgagaacacagggacacagggaggggaacatcacacaccggggcatgttgagagattgggggctaggggagggatagcattaggagaaatacctaatgtagatgacaggttgatgggtgcagcaaaccaccatggcacgtgtatacctatgtaacaaacctgcacgttctgcacatgtaccccagaacttaaaagtataataaaaaaaagtaaaaaacatttatacaaaaaaaagtattcaattaacatatattgattgctaaaaaaaaaataaataagatctaacaccattggatcagagacaagagtttgggtgagggcaaggggaacggggtatagaccaaattcttcaaaccctgggctttggaagacaaagctgctgcaggctgagaaagacctgtgtgactgttgttattccctttttagtcagaagttgttttttcttaaagtaataaaatccttcagtatttttctgactggttgaagaggatcctatccattggaggaaaaattaaaggtactttgcttcctagattactgctttattgagaggtggaggatgcaatggggattgtttttaaaggaaggcaggcaagtagttatcagcttcaatagtttatactgaggacatagaagagattccagcatgaccaccttcctttattcctttctttttccctctttcctttcctctgtatctgccttcccccctttctgtctcactcaactttttcgaaggtcagcaatcaactattacttgttgataggtgcttaagtaagggaataccctacatataattagtatcactcaattatttttaaatacttaggactccttccttgattttcttttctagccatctcaaataacaaccatttgcacctactgtgttttgaagttttctaccttgtgtgtatgtgtttgacttaaagtaacacaatttggaaacataggagtcatcaaaattaatatttaaatatattttttaggaagtctaaattgtaatgaatatttaggaagtttttattgagggttattatgttctcaacattgtaccaggtactgaggggaaaaaagaaggaaataaggaaaccaacctttctttgagcgttactatgtatcaagccctttcacatatgttttctcattttatcttcacaacaacactgtgaggtaagtattatgctccccattttaaaggaactcagagtggttatatgacttgcttaggccactgtttggcaaatggcagagcccacagcatgaacccatgtctaacagagtgaacctagagttttgtgttcattttcttattccacagatacaagatctagcccttggctttaaagaatttatagtctagtagcaaaaatatgccacagacccttgggattggtattttgagatgttttatggctaagttttgaagggagttttgcaattaatacatgcagttacaatttaggaaaaagaggtatcattaaagacagaatcatcaagaaaagcttctttggacattgagattgtttggagaaatagtaagatttcaaaagataaagttactttccaggtaacaagaatagcattaatttgaaaaattatttctgagaaactttggctgaatttcttttcatcttgtcaaagtaagtgggtatgaaatcttcagaaatgaatgaaagctccagatggtatgttatgtccttatccctgtatagagtgaaaaatatcaaatgaggaaaaagaataaatgataggaataaatatggcgtttgaaatacttagcagaatgccctaatcatgtcagacattgttttctcagggccacagttaggcactagctaccctgtttgttagcttacctcgtgttttatttgtagtttctgtagtaacattgctgttcatcttttctcctggtagaatataaaataattttactgacaaataaatactccattttaaaatcctacctacagagtttttaaaatttaagctaaaaaggttataaactgtagcttggaaggtggtacattatctctttatatatttattttttaaaaatttgccttcttgtatgtagggaagttggagtattgtggatgggaagtggagggtggggtaggaggatcaccacctgcagcctgcgtgtgataaggcaactgtagtgtatttactgtataatttttttatgaccttattaaacgtatagattattttggttaagttgaatgtagataactatttgatttacttgttgaattttttttttagtgtgtcattttaaacttaaatttatagtttctagaaagaggattgtgcgtaactagtttttgaaattgtaattagaaagatgattgtttgcccattatatttggtgttttaatctcattttataattaatacatcggaaattaggagggcaattaaggaagtaaaggaagaaaattaacatttttaaagagcctgctttttacaaggtgttttatttgtgtaattgcattttgtcatcacatgaaaaacatgaaataaatattattacttaaaggaaaaaaaactagataatgaatctgagacctagagagactgaaaaacttgcccagaacctcaaagcaagtacgtggcagaactgtgatttgaactctaacacctggtttgaatgcatttaatcatatatggtgttcagagatgacagctctcttcaagtaatacgtcgtcagcacccatagaactttcgtgctatgccacgtatcacccagtgggttaatagtggactctcattgttgtcaggagttgtattatatataatagcgagacttctttctgctagagcaaaggaacaaatatagatgtcgtagatgggtggctgataaatttgatagagttttattatgtaatgttgagccagtcgcttaaccatactgggactcagaattttgtcatctgtagagtgagggagttagagtgaaggatctctaaagtcctttcttctaattctaaattcagtggtttgcctatcagcagcagataattatttcttgaaatattgagtatattgtggagtagtatagtaataaattaccacttgttgagtaccttctgcctcgtattttacatacatatatatatgtacatacatacacatatatgtgtgtgttagtaagatatatttaatgttactaacatctttggaggacaaacagtctattttatagctggagaaactaggttcatggaatttcccagtggcaaggaattctttcagagatggagctgggagataaacctgcagctttcaagtttccagaccagtgctttttccatattcctacttaactaatggatctctgactaccttacagtagggccttgaggtgagaggttttccagtgtgggcaattcagaagatatgggttttccatgcctctagactagtctgtctgtctgtatcatggatcagatcttgtcattcttgactaatacatgaagatgtatttgagaacttttggataattccatttagggaaacagcagcttaatgtagatgattcactagtatgtgaagatttcagcattgcttttccaactaagtcatagaagccataggggagacactgattttttttagaggcagaatcatctgaatatttgcagtaagttatataatcattgcatttttaacaagttgaacttgagggacatgttttgttgcttcctctgagttgatacatgctaaattattggctttctgattttttcacccctatatctttattttaatttaaaagcgtttattatactttgagtaaagttaaatgaggcctaaggccacattgggaggaagaacctttaagccttggaatttaggaaagatacagaggcgttcttttgggttggaaataatacataatcaagcagatgctaatgaaaaaatgaaatgcaggggaagagaaaagagactagggtgcctgtttggaagttttatagaggagagtacattgcccctttattacaataatgtttctgaactataataaggtctttcattgcaagttcagcttttttcattcatttgttttgtgctctgcttcctctgttactaattgtcagcacaatagtcttccaactatgaagtctcagtgtccttttggaccaatttgtcattgtctttctccctcaccccccaacccatgcactcagaatctattactatggttgcatttttagacatttttaatgttttaaaatggcactgcttttgaaacctgccagaatagttcatgataactgaatcatccaaccagcaacagttattgcttccaaaagcacactgataaagtttctgtctctatagggtgttcttataagataattaaaaataaacatgtaataatctttacagcactatttcatatgcattgtttcctttgaacttcacgttagtcctgtgtaacattttgttaaaatatttttgttaaacagtattatttacagatttactgtttgcctcataaattgtttgatatttctatgcctctaggaagttccatctctcttctttacctattgatgggtctttatttttatagacagattattttattatgactaaggaatcagcaaagttggcttagactgacaagcctgaataaattctgatattagactccaggcaactttagttacatgttaattcatgttaggtttttaacattttggccaatgaacactttaaatgtgttctcagccttgttccaataatctgatactgacagaaagacattatttaaatataacttctataaagaagtcctgaagcagtgtaatattacttgacaacttatctgtcacttacagaactttgtcttatgtgatcagagcttgttggtgcttttacatataatgtcaatgaagatggcagttatttttaatgcatgaatactaaataaaagattggtcagttttctctgggagaaaacatatttcagttctctatcacctgtttgtatcaatttattcacataaaactagaaagtgaaatacagttgacccttgagcaatgcaaagtttaggggcttcaacccttgtgtagtcaaacatccttgttctaacttttgactcccccaaacttagctaccaatatcctactgttgcccagaagctttaccaataaacagttaattgatacatattttgtgtattacatgcactatatactgtattcttataatgtaagcaagagaaaatgttattaagaaaatcataaggaagagaaaatatatttgctattcattaagtggaagtggatcataaaggtcttcatcctcattgtcttcttgttgagtaggctgaggaggaggagaaagagaaggcgttagtctttctgtctcgggtggcagagatgaagagatgtggagcgggtggaaggagaaggcaggagagataggcacatttggtgtactattattgaaaaaaatccatgtataagtggaattgtgccgttcagacctgtattttccaagagttgactgtgtataaacgttattagaaagaaagaaaactttacttcctttcataaacaaccaacatccatcctaaaaacagtatgtgatacaaaaagagacatgaatttagagctagaaaacctggatttgagactcagttttaccacattaatggcttgatgattttgaataagtgatttagacattaaatagcttcctttttaaaaaatttgtgaactggaaatgaccatactttagaactcagctgagaggattaagtgaggaataatgtatgtgaaatcttaatgtagtgaatcaactgataatatgctaagataattacttagtagttactatttaaaaaataaattttggagaaagatataatagaaagcaaaattttcctactgatttaaattggcagagatttaagatgagattttccccccattcttctagagatcagtgaaggagctgattcttttactttacttcatatagcttgctatctatcaaaccagattttaaaatgaagtgtttttattgtttttgttgttgttgttgttgctgtagtaaatacccaagaggcctttttatgtctgtggttggaaccatctttcaaagccaggctaacttatttggagttagaattcctgaaggcaaagaaaacacatctataccttccccttaaagtttaaagaagttagagagtgctttccaaagaggtggtattctgataatgactgataggctatctctatatttgactttttttgtttgtttgagacaagagtcttgctctgttgcccaggctggagtggaatggcgcgatctcggctcactgcaacctccgcctcccagattcaagcaattctcctgcctcagcctcccaagcagatgggattacaggcacccgccaccacgcccagctaattttttgtatttttagtagagatggggtttctccatgttgtccaggctggtctcgaactcctgacctcaggtaatccacccgcctcagtctcccaaagtgctgggattacaggcatgagccaccgcacctaccctctatagttgattttaatggaattacttgatttgtttataatcctccacaattcattgtttatttggacagtgctttactctggataagtagacctacctttttatttttctccaagggggaaaaatcctttattctttacatctactcctttcaccttttcctgtggaaaaaaaaatatctcaagtattagagctgttgctccaaaatcaaaaatatgattaggattcaaaaatatctattttttgaaaagtatgttttttgaaaaatatattttttcatatatatgaaatatataaatatacattttatgagaaaaaaataagttgtgagaaattatattgtttctgaaatgtttcctgaagcttttcctagaattcagtctgtatgtgcttagattttgatgaatagaaaagaactatgagaagtattccaaattccctgaaacttaaggagttccactcaaaacagtcaaataaatcacagcatatgatgaagtaccaccatatgggatacaaataagtgtagtagatcttcagggatagagagtatgagttggaataagagaagatcttgagtgactagaatctaagtaaaaaggaagggagtatgtgtcaggtgagagaaacagcatgagttgttaaatcctgaagttaataataatcagataatttttaggggacagtgaagagacatgtttattagcagaaagtacttatagtttggcagtgaggaatacagtttgaaactttttgttttaattaatggggcttccttatgaatagctttgaaagtcaggctaagaaatgtatttgaacattgtcctgcagacaggaaaatatttttgaagagaatgacatacagtttaagaatttgggtaggactcatcttactagtagtatgtaggacaacttagggagaagggtagaaaagggagaccacctaagaggtcatttcagtgatgaggattttgatagtaagttcccgggttgggtgtcagcagtggacaaaaaaaggatgattccaagagtcataacgaacaaactgttaacatgaatgttggtggcttagccatgagggctgaaagagaaggacgagccagagatgactgaggaagtgtttcttgggtgattaggaagatgatatggaaataaaatagaaaaactgtactggtatagtaattttcaacttggaagctgaaacaaacaaaaacaaaacccttttggatatcttgaggatgaggcagtatagggcatcaaaggagatgctagttttgccatatggggatggagcttgatgagaagggccgtgactgaagaagcaggtttgagagtcatcagacatcaggtgtcagtcgatgcagagctactggggagcctatctataattaaatccaaagtccttaccaactcattgaagatctttctaacctcatctcctaccttttttcctaacttacttgactccaattacactgggcttcttgctgtttcacaaatccatctgtggaatccctccagctgtgagtctgcacttaatgttcattctgtgtaacttactcttcccgaaggtaatctgcattggcctctcatttcattagagacacccttttaaattaatctttcgaaaatagtatcacctcccgttcacttcaactcgttgacctgccttatttttcttcatattgtttataagcacctactatgttataaattaattgttttgcttgtttattgtttgactactcatcccctcagtaaaatataagctttatggaaaataggcaccttgttttgttcactgctattcagtgcctaggttactggctgatatactgtgggtacctaacaaatattgtgtaattaatgtctagatttactatgggaaaaaatgtcaaaaataaaagcataacagaaaggtctgagcctttggaaggtaaaggtctgagcctctactttggaagtagaggccctaagaaaaactaatgaatggtatgggatggtagtaaaaccaggcaagtcagtgtcatggaggtcaaggaaaagggactcaaaggatagggagccaagaacatcaaatgctgcaaagaaatgaaaatgagaacaaggaaaatatatctgataaaaaggagactgcagtagagtggtggaaaccagaatttagctaattggttaaggcatgggtaacaaaggccagccttgtagattattttgagtgatttaccagcaaaacgaaggagaggaatggggcagttagcgggaagaggagcagcatttaatacaagtgctttaaagagtgactttgaggctggatgtagtggctcacgcctgtaatcctagcactttgggaagtggaggcgggctgatcacctgaggtcaggagtttgagaccagcctggctaacatggtgaaaccccgtctctactaaaaatacaaaaaattagctgggcgtggtagtatgcgcctgtaatcccagttactcaggaggctgaggcaggagaatggcgtgagcccaggaggcagaggttgcagtgagccgagattgtgccactgcactccatcatggatgacaaagcaaggctccatctcaaaaaaaaagtgactttgaatctgcatcttggtctttgtatatgtttattgtttatttcactgtggtatgtatgcactgataagctactttgaagatacgtgagtagaaattgtctcattggtacagatggaaatctcgaggcatttaagttgtaagttacttctaagtgggacctatgcaattggtacatatggacataaagatggaaataatagacactgcggactccaaaaaggagaagggtgggacaaggaccagaaaactacctattgagtactatgttcattatttgggtgatgagttcactagaagcccatatctcagctttatacaatacacccatgtaacaaacctgcacatctacttcatgaattgaaaatttttttaaaagctgtatcacaatcacatctaataaaactaatctttagtattaccaagtacaaattcatattcagatttcccacttgttgcctaaaactggtttgtttagaccagaatgcattaaggaggaccacgcattgcatttggtttttataaatcttttaagtccctactagtccagcagagtattagactaccttcctcacccctcttttgggtacattcacttattaaagagactacttcatttgtcctgtgaaagttctgtcttatggaattctctgatcgtttctacgaggtgtcatttaacttttcctctacctctgtatttactgtaaaaggaagttagatctaaggattccatcagattcatattcagaatttttatcaagattgtttccttcgtgagtctgtgtacttcatattgcgttatgtcaagaggtacctagtatttggttgaccagctcttagtaatgctatcattgttcactgggttacggtggtgacagtgtcatctcttcattataaactaagtttctctcatgtggttaccagataatctgtggtttgacatgttggcactatgcaatatttagtcttaattagttatttaccaaatgattttaccattggtgatttttgcctgaattaattattttattaggggtagattatcttttaggtattttttaacatgatttcaattagccaaggcacagataaattggggcagtatgttagtcattctgtttatttatttgagaccagccctgtttaggcatagtaccagaaatcaaatagtatggaccttcccctaagggaattttcaatctaatgtacattcttgttgaattgtttaaaaattttgttatcaaatcccagtttcatcatgtttcaaatataaatagcttttcttaaaaatagaccgggcacagtggctcacgcctgtaatcccagcactttggtaggctgaggtgggtggatcacgaggtcaagagaccgagaccatcctgaccaacatgatgaaaccccatccctactaaaaatacaaaacttagctgggcctagtggcgcacgcctgtagtcctcgctactccggaggctgaggcaggagaattgcttgaaacccgggaggcggaggttgcagtgagccgagatcgcgccactgcactccagcctggtgaaagagcaagactctgtctaaaaaaaaaaaaaaaaaaaaaatctcataattatttttcagattttaccatgttatgtaatgaatggttaaatatcctgtgtacatctgagtaatttacttctgtttcatgcattatgactataaataaactgcttattctggtgtatgagtacaatggagttttatgccactattaaatataatgatgtagatctttatttactgaaatggaaaatatccaaaacatataatatcatcaataatggtctcatttttgtttctaaaaagtgcttagaataggtctaaaaatgtatgtattcaaacactaataatggttataactgaatggtaggattatgagtatttttattttgcctatacttatgtatgtatttttctgtattaagcatggatgatttatacagtgaaagtaaatcaagaaatatgtttgaaaaccatcttgcccacacaacaatttgaattcagtaatgtcaccaaactgtatacttaaaatggttaaaatggtacatttcatgttatgtatattttactacatttttaaaaagcccatggctattatactgcaaaaaccaaaatcaaagccaaaaaaccaacatgcctaattccttgagtccactagatgtttgcatgcctcttataattcttttagtaaatgccttatgtcatttttatattttaactattgtctcaaaatgaccacagtacgtttatttggaatttcaagtaggcagaaagtatgccaagaacagttgttccagaagactcttgaggtgtatgtttgtttaattagaggcaggattcggtgggcaaacaagacagagaaatgttgatggggaaaatattggctctgtaagtgtgcttttggtaaatggtagtatctgtagtgaccatattcaaagaagaaaaatgtgttaggagaagttcacattaacatatcgtgacttcaaattcaactcaagttcataaatagtatttcatgttaattccaaagtggtggtttatgataattaaaatgtcacaatttggaatgtggatgatgaagtgaaaaacatcttctagagggaaatgtaatgttagtaatccagtctgactcccattatttattgaaccccttgtattatggaatcaaatgtaagaactttgtcttctctcctatttgcttatgtggagagagatatgttgagtttgggtgataaaacgcaaatggttcagacaaaaataactagcaatgcggagctggattgatgtgagtctgcagatcacttttccattattagtaattgaactttttttaatcattaacttcattggtattggagaatgtgagagccagcagtgaaagaacccaaaggctctcttgccttcctttctgctatccttaccactttctttcccttcagcttctcattctaaaccgcctcccgttactcctacctggagaaacgagatgtcaaggatcagcatcctgctaggggataaccctcattcctgtccatccctatactgtggagagaaccagaggcaaacacattggagccctctcccgctcaaacactgttatcagttgaaacttatcctggatttgcttatatgagaaaaagtgtcatagatgggagaagggccaagcacggggaaggtgtagagaaggtatagaagagggaacagacattcctatggctttgacagatgattactgatttttaaggcatttttcctagcagtgtattctcttcagaagagcatgggattgggattgagatagacttggaataaatccttatataatgactcacagttgtgtgttttggggcaagttatttagcttgcctgagtcttgtaaatttgctcatttagaaaatggaagataataacaccttttaggtttttcctttggattaaatgaataacatttatgcaccactctttgtgcagtgcttggaacgtagtgatcactcaacagttatctgctgctggaatgctctctaccaggacacctgcctcacctaagtcaccttccgctcattggattaaatgaatctcttaaaggttgatgtattgagtcttaaataggtgttatgcttttttgcccctagtgaaaacattaaacaaaagatagaaatgctttttgtccccttcagagaacctccatggtgtatcatatttttaagacctgaaaaataaatttggtttatggtcatcataactcacagccagcattatttcattatgtgatttaataaaaaatggaatctggccggatgcagtggctcacgcctgtaatcccagcgctttgggaggccgaggtgggcggatcatgaggtcaggaaatcgagagaccatcctggctaacacagtgaaaccccgtctctactaaaaatacaaaaaaattagctggatgtggtggtggccacctgtagtcccagctactcaggaggctgaggcaggagaatggcatgaacccgggaggtggagcttgcatgagccgagattgcgccactgcactccagcctgggcaacagagcgagactccgtctcaaaaaaaaaaaaaaaaaaggaatctattattatgccttcgtttttcacattggatgttattttagaaagaataaaattagtgtttaaatggctaaagaggttggttgaaattaaacctttaaacattttaatctaaacagatgatctctaaaaattttttttttggtgtatgtatttcttggtctgacatgttgcagtctctctaattgggtttcaggtttgcagagtaattacagctttgtacagactttgtcatctgtggctcagaatggtgtaaagtaagcagaacatttaaaattcagcttgtggttcatgttgctcagtagagtttaactagtgtataactatctaatataagtaacagtgtaacaaataacactgagaagtagatgttataataagagttagctacctggcattttgtataagcacatttactttactgatgcatattaaatgattctaaaaatcgtagataatcatttggttaatagctttttagaatctctatccaaagtttctacttctgatttttaaaatttaaattgccctaccttgcgttgggaatctttacgtaaccaaaaggcaaatattcttctaaagaagtattggctaatccatttattaaccaccatttcctttaagaatcatgtgtttctgattccttattgcgaacatgcaagaactcaaaagtttttctatttactcgatcactggttttaacatggtaatttagagttttaacttttttgaatttggattcagctttttaaattacatttgttttgtacagcaacaaaccataagacattgtgatattctcttggtagtgatccaactaccacttgaacatcttggtgtagagatgaaatgtgtttgtagagtatttcatactgagacctaaaaaatataggtttatttctattatactgtttatttgtaattacacgtaacattatttttgttggactagagggttcacaggacctgattaaaccctttatagcataaatgaaatactactttataattacatgggtagaatgatcagtagtatggtgtgtaccatgagctcatagagtttcctactcatttttgtgtgcccagcattttgcatagtgcttggcccataactgacatttcatatatgtcatttggttcatgaatacttagcaagtttagtaagaacagtgaagttgtgcataactacttagtcattatgttactattttaatatttttccaaaccactctatacataaatacaggtattttattcttttctaagccattccttttcagtgatctgcttgagaatggtaattatagtaatatcttttattgtttttagcagccttataaattatagtaattgatatttggaatcttataacagcacttcgagtagcttctaaaagtctagtgttgagaagttctttaaattatagcatttaaacttcatttaggtatagtgttgaaaatatgcttttaattcatgatagtgcttttaaagatgataaacctgagggcttagatataaagtactttcaaaaggatcacacagctgattgtgttagagcctggatttgaatttctttctgattgcagagtccattatcttaattaccttatatcaccataatgggaacctgaagtaaaactgaaatagtgaacctcagaccgggcattctttctttgcttctgtgctgtatttctctgtaccccatagtatttctcttgggcacgcccctcatttaagtgtctgtcctccattctttacgtttaaagccagccaatcagttgcccaatcagggtatttattgtatactcctatgtcctgtcactgtcctaggtgctataagaagaactgtgcacacaattcctaacttttaagtaatatagctagtgaattactggctggaaatttaatagggcttttgaaaagaaggatatggggaggaacagttggcttcaaagagaatcagactgatgggcagagtcagtcataggaattggttggctctttattagtataaattagtataatgtctttggtattttaaaacttaagtctttcaaatgaacaatatttttgcttattttttgtggaatatatattttgtgttttttaactttcatatttcaaaaaatgtcatgctgctatacaaagttgaattgtgatataatagattttatgacctattgattctaccaccttttcattgtcttgcacatccccaggttctcactttcctccatacccattttaagtttcttagttgagtatcataatcactcccttgccttgcattctttattcttttctgtcttcttgctttgacaaacttacttggttaaagtacagccttgcttaaattcattactctatgttcctcacctgtacacatgcagctgaatatatctgggtatatctgggagaaaatacacaaccatgatctctgttattagtttaaattcttcattattaaattcaggttggtccttcatccttctcggcagtcatggttggtctccttagcctatttgtactttgattttcccagagtgctatttcatatctttttttcttcaaagcctgatggatccttttgcaacgttattcccgatgactttatatcctaattcactgaaaaaaacagaagcagtgagaaaataatttctaccagcttttacttgcttctgtactcctaattgcatttgggcccttatatcttctcttttattttattactaaactatttatactcctgattagagctacccctttacttgtccagtaaatttaatcccttcttgcttatataggtacattgctttagaaattatcttttggtagcatcaaaattaccttctttgttggattattactatcagaattcatttggaaaatgtttattgagtacctactatgtgtctggcatagttctaagtgctaagaatatatgaatggagcttacaatctagttgaaaagacaataagcaaaaaagatactaaaaaacttcatatcaaatgttagaaaatggtaacatgctatggaaaataaaaaatagagcaggtaagagaagatggagggagagtcctaggtaaggggtgcagattgcagtattaaataggatgtctaagagagcagctgtgcgggtgtgtgaggggggaaagaatgttaggcagagggcaaaaagctctaaagcagaaagagtgtagtgcattgttgaggaaatgcagggaagccagggtggctggcagagcagcctgaaagagagtactaaggaagtaggtcagaaacttcagtggggtcagtgggagggtcagatcacgtaggacacctgctgatcacttaaaggccttactcatctattcttagtgaactgaaacactgcagaacttttttgcagatcttcattttaagaagatttctggctgctgtgttgagaacagactgcagtgaggggcagggaaaagctattctaagttttttggaatcatcaggtgagagacaatgatggcttagtctgaggtagtggaggtggtgagaagttatcagaagctggttatgtttttaaagtagaaacaccaagatttgcaggaggagtgaatgtgatgtcagggaagagaggactccaagggaattcttgggttttcagcttgggcaattgaaaggatggaggtgtcatgtgagatagaggaagccacagtagaggttggcagaagaaggagcagggttgagagaggtcaagagttcacgttcggacatgttcagatgtctcccagagcacagtttctgtctttaacttacatagtcactcagcatctctaaataggaagaatcttgtcttagggcagccgggaggtttaggcattgggcacacagaatctgaagtagaattatagcagtggaaaaccagttacgaatggtctcccacttacagtagttcatggtaacgatgtcttactttaccgtgctcctgacagcagtacacactcaatggagattgtatttcaaattttggatttttgtcttttcctggggtagtgatttgctgtgtgatactccctagtgatgctgggcagcagcagcaaatcacagcttgcagtcagccacgtgatcacaacatgcacagtagatactctacagtgtactgtgttgccagcatttttctggatgctcttagtttttgtgttttctcatctcatcatgtcgacaaaacacccatctatgtgtaatattcaatactttactacaaaacaggctttgtgttggatgatttttgtccaactctaggctaatggaagtgttctgagcatgtttcaagtaggttaggctaatctatgatgttgggtagtctaggtgtattaaatgcatttttgccttataatatttctgacttacgatggttgtattggaatgtaacacagtcataagtcgaggagcacctgtaatgacaaatagtaccagtatcaaaaaggaagatcagtttatgtttcagcctgggtgatggaaaattatgaaagccaggaggaggaatgaattttagggggaaaatactgagtttggttttaggggtggtccagtaattcaaccaggtagaaatattcactatgtgtttagacacgtgtgtcttaaagtagaactgcaaggtgaaaaaagtttggattttgatattggtaaactgagagatgattgctgaaaacatgtaaactgttagaaaactaagcagagacccttgggtgaatgatttctctcagtgtaaagggccaataaagagctaatctggggctggatacggtggatcaagcccgtaatcccagcactttgggaggccgaggcgggcggatcacttgaggtcaggagttcgagatcagcttggccaacatggtgaaaccccatctctactaaaattagaaaaataagctgggcatggtggtgcacgcctgtaatcacagcaacttgggtggctgaggcatgacaatcacttgaacccagcaggcagaggttacggtgagccgagatcgcgccactgcactccagcctgggtgacagagcgagactgtctcaaacaaacaaacaaacaaaaacacagctaatctgagtaaagaattggaactataaagagatagaaatggcagttgatagttgctaatgatggagataggacacagcagataagcactgagaaaagacttgaagttttcaacggagataaattagtttcttccaaaagagcagagtcagcagacaaccctaccctattttttcttggtgtccaataccatttatcctttaaagcccagctcagatgtatgccaaataatagttaatgtttgttgaaagcttataggtctcatattatgctaatattagatgaacttattattaattcctacatcaattctatgatgtagatactgtttcccacttaactgttgaagactagcgagtttaattaatttgtccaagtttgtgtagttaatggtacgaaaaaataattgaatctacgcacaccagtgtcagagaatccatactttaggctcatgtttgttgacatcttcctagttattcagtaacagaatttaatcatgtttagagtgactggctcttggggcagtggatactaagagttacaggcagtttatattgtcaaaaagcttataatctaggtaaggataagtgatatttgtcattttcttaaaatgataagtaatactgtaagatagtctatggtaagtgacacatgagggatatggtaataagtaaagagaatagagaggatgaaatggtcagtctagggcgaggtgttatggaaggtttcatggaaggaataatatttgatctggaccttcaaggatcagtactattgtgactgcaggtgatgcatatggatagaggtaaaataagtgaggaaagtatttcagatagcaagaacagctggagcaaaggcataaataaatgaaagagttaagatgtgtgtttggggaaaattatatagtccagttgaggtggttaatgtggccagaatgggtgaaggattggaaaggaagactaaggtcaggctgtaaataatcttgagtggagaaccatagaaagctgtgagttcgcactgggttttgtttaaaatagaactctgtagttctcaattatttacttcttgttttaaatatatccatatttaaagaaacattttattttattcttagaatgccagttaatgaaaacagaacgaccaaagccaaacacatttataatcagatgtctccagtggactactgttatagagagaacatttcatgtagatactccagaggaaaggtaagaaattcacttgttttcattttgtgaaaaagcaacactcaatctaaagatgtatttgtatctgactttattatttgtaaatatatataaatatatttttttaaatgctatagtctctaaattcttgcttctggcataatacatgaataacagtggcttacaaaataatatttaatatatcagaacctctgggcatgctagaagatatactttcagagaaacagaacatttaaaggttaaaatataaatttaaaaagacatttttggcctggcgcggtggctcacgcctgtaatcccagcactctgggaggctgaggcaggtggatcacaaggtcaggagatcgagactatcctggctgacaaggtgaaaccctgtcgctactaaaaaaacacacacacaaaaaatcagccaggcgtggtggcgggcgcctgtagtcccagctactcaggaggctgaggcaggagaatggcatgaacccaggaggtggagcttgcagtgagccgagattgcgccactgcactccagcctgggcgacagagcgagactctgtctcaaaaaaaaaaaaaaaaaaaaaaaaaaaaagacatttttatagccaaactaccttttttaaaaaattgtataattgattgtattcatacttgaaattccaaggctagtgatagtaaaagatttcaagtaacatgccattctaaattagttgtaagtggctgtctggagcactaagttgctaaggattctgagattgggtctaaggagcgggagagaggattaattagcattgactgtcattattactaaagtgggtagtgacaacactgtagtaaccaactcatcaacttcatcaggtccacatttttatcctcctgatctatcagtttttacaaccacttcccaattctatatctgctcactctgatactgagttaggtccagtgaccacagtcacaaaaccaccatcctgcacatgttattatatttgatcctaatcagcaactttgtgaagttaaatcttattagccttattttccaaatgaatacacaaagttttaacagtcttgtctaaaattttaataaaagcaaaatggtaaagtattattttaataacacttttgatcagtagagtaaatggtaatgtatgattgattaagaaatatagaaaagagttaagcactgataatattttcttttgtgcacttccaatcttactatgtgcagacgtaattaggcctttcatatagatacagttctgggtatgggtccccgaactcttaccctgcctgcacaccctcccctccctgcactgcctccctccccgcacaccctcccctccccaccattgatcctgggccttttctcccttgataattaatactgagctttcaatttgttgatatgtccacccataatccataatcactaagttgggctaattcctatgtatcttttcagatctgagcttaaaatgttatttttcctacaaaacctctgactctaatagactaggcaggttcccctgctaggtacttagatatttttctttgtaccttttctatcaatcatattataactgtaatccttgtttgccattctcactaaacttgaagattcttgacagcaaagatgatggcttccttgctcatttaaaacatcttttgcacatagtccatggcccaacacagtatttattgactggctggatgaatggtacttttcccatgtcaatatatattctttgaaaatgttattcttagtggatttttaacatctgttgaagcacaattcattttgccatttgtgtttacaaagctggatttctgtcagatcttaagactctaaaatcctctgctgttcctgtaataatatactactcttctgaacaatcagttttcatttgcatttataactataagaaaaaacagtattaatacaaatgaaaaacagcatactcatatttgccattggtatgtgcatttctatatacctctagaatctggtgtttggacattctatatgacttgatttttttttctaaatttttattttattttatttattattattatactttaagtttcagggtacatgtgcacaatgtgcaggttagttacatatgtatacatgtgccatgctggtgcgctgcacccactaactcgtcatctagcattagatatatctcccaatgctatccctcccccctccccccaccccacaacagtccccagagtgtgatgttccccttcctgtgtccatgtgttctcattgttcagttcccacctatgagtgagaatatgtggtgtttggttttttgtccttgcgatagtttactgagaatgatgatttccaatttcatccatgtccctacaaaggacatgaactcatcattttttatggctgcatagtattccatggtgtatttatgccacattttcttcatccagtctatcattgttggacatttgggttggttccaagtctttgctattgtgaatagtgccacaataaacatacatgtgcatgtgtctttatagcagcatgatttatagtcctttgggtatatacccagttatgggatggctgggtcaaatggtatttctagttctaggtccctgaggaatggccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagctctttgtcagatgagtaggttgtgaaaattttctcccattttgtaggttgcctgttcactctgatggtagtttcttttgctgtgcagaagctctttagtttaattagatcccatttgtcaattttggcttttgttgccattgctttttgtgttttagacatgaagtccttgcccttgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcgtcatttctgagggccctgttctgttccattgatctatatctctgttttggtaccagtaccatgctgttttggttactgtagccttgtagtgtagtttgaagtcaggtagcatgatgcctccagctttgttcttttggcttaggattgacttggcaatgcaggctcttttttggttccatatgtactttaaagtagttttttccaattctgtgaagaaagtcattggtagcttgatggggatggcattgaatctgtaaattaccttgggcagtatggccgttttcacgatattgattcttcctacccatgagcatggaatgttcttccatttgtttgtatcctcttttatttctttgagcagtgttttgtagttctccttgaagaggtccttcacatcccttgtaagttggattcctaggtattttattctctttgaagcagttgtgaatgggagttcactcatgatttggctctctgtctgttgttggtgtataagaatgcttgtgatttctgtacattgattttgtatcctgagactttgctgaagttgcttatcagcttaaggagattttgggctgagacagtggggttttctagatatacaatcatgtcatctgcaaacagggacaatttgacttcctcttttcctgattgaataccctttatttccttcttctgcctaattgccctggccacaacttccaacactatgttgaacaggagtggtgagagagggcatccctgtcttgtgccagttttcaaagagaatgcttccagtttttgcccattcagtatgatattggctgtgggtttgttatagatagctcttattattttgagatacatcccatcaatacctaatttattgagagttgttagcatgaagggttgttgaattttgtcaaaggccttttctgcatctattgagataatcatgtggtttttttctttggttctgtttatatgctggattacgtttattgatttgcgtatattgaaccagccttgcatcccagggatgaagcccacttgatcatggtggataagctttttgatgtgctgctggattcgatatcaccacagatcccacagaaatacaaactaccctcagagaatactacaaacacctctacgcaaataaactagaaaatctagaagaaatggataaattcctcgacacatacactctcccaagactaaaccaggaagaagttgaatctctgaatagaccaataacaggagctgaaattgtggcaataatcaatagcttaccaacgaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagcctggcagagacacaaccaaaaaagagaattttagaccaatatccttgatgaacattgatacaaaaatcctcaataaaatagtggcaaactgaatctatatgactttagtgtaatatcattgaagacttagagagggttagtgtgagttagaaaaactctctatttttaatattctgcccagtctaaaatttttacctgtcataaactaaatctgtatatctctcacctgtcttatatttatttcagtacatgatataagggtggactctatttttttctcaatggcgagcccatcatctcatctccatttattagataatccatttttttctcactgattgtggataacacatatacatatttgcgcttttaggatttagtctttttttcccctttgacctttctgtactctagcattaacaccacatggccttaattagagaaactataaaatttttaactgttaatatagcaacatatcccttattttttttaacaaaaatgttcttagctacattagtgcattcttttaaaaaattatggtaaaaattacataatgtgaaatcctctttcatttttaagggtataatagagtattgttaactatgtgcatattattgtacagcagatctctagaacgttttcatctggcatgactgaacctctgttcccattgaacagtagctctccattcccatacccccagcccctggaaaccaccgttctactttctgcttctgtgaattcgactactttagacacatcacataagtggaatcatacagtgtttgtcctgttactgtcttacttcccttagtataatgtcttcaaagttaatccatgttacagcatattagaggattttcttcttttttaaggctgaataatattccattgtatgtatataacacaattgccttctttcttttttttttgagacaaggtcttgctctgtcagccaggctgtagtgcagtggtgtgatcatggcttactgcagcctggaactcaggcccaagggatcctcccagcttagcctccccagtagctgggactacagccacacacgcaactaagttaatttttttttttttttttttttgtagagacaaggtttctctgtgttgccagggcttgtctggaactcctggcctcaagcaatactcctccctcggctggaattacaggcatgagccacactgccggccaatacattttctttattcattcatctgctgatggatatttagattgtttccacctcttggctattgcgaatagtgcaacaatgagcatgagagggcagatatttgtttaagttcctcatttcactttgtttgaataaatatccagaaatgtgattgctggttcatttggtagttctacttttaagtttttgaagaatcttcatactgttttctgtagcagctacgttattttacattcccaacaatagtgtacaaggttttaatttctccacatccttgctgacacttacttatttattttttatgttgttgtttttttaaaaacaacagccatactagcaggtgtaaggtgatatttcatcgtggttttgatttgtacttccctgataatttgtaatgctaagcatttttcaaatacctgtgtatcatttgtatgtctactttgaagaaatgtctattcaagtcttttgccaagtttttacttgtgtttctgttttttgttttcgctactgagttataggagttccctatacattttgaatattaagcccttatcagacatatggtttggaaatatattctctcattctgtagttttctgttttgttctgttgtttgctgtgcagaagctttttattttgatatacttctactcatctattactgcttttgtcagcatcaagaaatcatttctaaagaccaaattatgaagcttttctcctgtggttttttcctaggagtttgtagtttcatgtcttatatttattctttgatccattttgagttggttttgtgtgtggtgtaaaataaggctccacttttgttcttttgcatgttgatacccagttttctcagcagcattatatttccacattgtgttagttgtgacgcccttgtcaaagatcatttgactgtatatatatatggttttattacctgggctctctgttctgttccattagtctatatgtctttatgccagtaccaatctgttttaattactgaagctttagaatgcattttgaagtcaggaggtatgaagccctcagctttttgctttctcaagattgtttcagctgtttgggattctttatggtttccatacgaattttaggattttttttttctgtttccgcaaaaatgctgtaggattttgaaaaggattgcattgaatctgtagcttactttgtggtgttgacatcttaacaatattaaacctttcagtgcatgaacatgggatgtctttccatttatttgtgtctcctttcatttctttcagcaatgttttgtagttttcagtgtacaaatctttcaccttcttggttaagtttattcctaaagtactttattcttttttatgcttttgtaaatgggatttgccttagtccctttgggctgctacaacaaactatcataaactgagtagcttataaacaatagaaatttatttcttacagttctggaggccaggtgtttaagttcaaggtgctggcaaattcagtgtctagagagggccctcttcacggttcatagaaggtgtctttcccctgtattgtcacctagtaaaagtgccaaaggaactctctgaggacttttctataaatgcactaatttaatctatgagttctatcatgacctcatgaaggcccacttcctaataccatcacctttggggttaagtaacccaaaacatttattctttgtagacctagtatctgcagacaataacaattttatctcttcatttctgatagttttatgtattatttctgtgtgttttaaagcaatgtttaataattttgatcatagcacatataccttttttcttaatttattggatacaccactaatttactgttaaatatgatttgtatatgtactttattatgctgcacatgaccatccacaatatagacaaaggtcatttttctttcttaacagctaactactttcactgtcacaaccatggccacgacactcacactcacatacagagacacatgtgcatgcgcacacgtatgcctcgcccccaacatgttccagatacattgaactccttgttgtttcccaagtactaatgctatactgtgctcttacattacctgtagctctttccttcttgcccttttgtccctactgctaggaacacctcgtatcctttgcttgtctcttgctcatcctggtaagtaccaattcatttttcacatctacattcaagaattacctttctttttgggtccccatcacaaacttttattattgttagaacaccactgtacttagcgtatacttgtatcattttacccataacattttattatacttccccacaataccaaggctcccccatcagactgtaagttcttcctaagccattccttttttaaactttagtagcacacatgtattagacatttaattaaatatttattagtaagtaactaatcagttggtgaaaattgatttttgtatgaagtagtatatgtacttttaaaagattaatgtacttgtttcataggggtctccattctgtttttcaaattaattacatttttaaacattatttaggaataaaaagattggatgccctctttcaattagtcaggtactttggcctgatacttttttgcaggaattacccccccacacccccccgccacaccctcaccaaatggtgtagggttatagtttaagtatcatgaattatggtgaattatgtaatttgggtcagtagtccagctaactaccactagtgaagctggaaaagacttttgtttgtttttgttttttaaaaagacaccagagagctgataaggctaagatttattgggccaaaactgtattgaagaaagaaacccagacagtgaacctacttttccttttgggttacctgctagttcttgaagtggtattggagatggagagattttgagtagctcccagagctgggagtgatattttggaatctaggatctgccaaagaggagacatggtaaaccactacattttggtattggtagcttaaaggactgtaccctgtaagaaagagtaaactggaaatagatttgctttgagaggattgacatataactataaattatttcagtcctgaaattgagtgaaggtgattcaactttgctagttttctaggagcttgctaaaagcaaatgtaaactcactctaacagaagattatatcttcctagacctcacattacctcagttttcatgtgttgtgtccaggacttgttaaaaaatgagtacacaaaaattcaacactatgtggccaaaataatagaggaaaaaaaaacagacaatagaatcatattcataggaactctagataaaagaactatacattaattagtatgttcaagtatgttaaaattgtttgattctacagagggaaagtataaaaaagaaacaaatggataatagctttcatttgtaatcaaggtaaaattaaaaagaaagagccccatagaaattctaaaattgaaaacaaaacatttggaattatgagttctagcagatggctttaatagcaaactagacctcacattagagaaaattagcgaactcaaaaatacgtcagaacagaacgtttatagtgaaacatgcaaagataagaggatagaaaataaaaataattaagaatagaatgtaagataaaaacaatgcggtgagcatgtcttacatatatataactggagccttagaaggagaggagagaatagagcaaaaagtatttgaaaatataatgattgaaattttttaaaaaatagttaaagataccaaaccatagtttcaaaagtcctataaatctcaagtaggaaaaatatgaagaaaatccctaatctcattagactattaaaaaacaaagatagtgggaaaatccccaatgtagacagagaaaaaaatgtttgctttcagagcagcagcatgtagaccaaaagataatgtcaatatgtgggatggaataataatgaaatataattgaataatgttcccaaataatggaatatttccaaagatgatgaaatgatatccccaaagttctgaaagaaaatgagtgctaagaaacaactattttccatgaataaaagtaaaatgaaaatattttcagtaaaaaattgaaagaggctgggcattgtgtcttatgcctataatcccagcaccttggaaggctgaggcaggaggatcacttgagcccaggagctcaagaccagcctgggcaacatagtgagatcctgtctctactcccttcaccctccaataatttgataagatttgtcactagcacacctataataactaacctagtattctttggacacaataagaataatctcaggaggataagtacagaatggaatgaaaaacaaaatgcttaaataaaccaataaataaaagtaagcattgatttttaaataatttatgttgtgttttaattatataagtgaaaaatatctgaagtaatataaattgagatcctgacaaaaatggagttaattttttgtgaggttgctgtattttctggtaagagttaaaagtatggacattttagactttgcaaagtcaaagttaaatattataatttaagttacaattactaaaaagacagtgagagtatgatggctaccaggctaattggaggagaaatggaattagaaattattctggcatatattacataagtggaccatgtaaagctaaggatatatataaaaataattgcaaaaaaagacgactgaaaagccaacaggaaaattaaaatggaattctgaaaaagtgcaaaataatttaaaaaacaggcaggaaaggagaaaaagataaagatacaggttgaaaataaatagattgaaaaagattgatcatggaaacagtaagcataagaagaatggattgccgtattatatcatttcaaattaaatgtattaccatagattactaggatactttataatgagaaaagtttctgttgaacaggatgatatagcagtcatcaacacatgtaacagaattaaagggataaaaatgggcaatttcacaaccatatttggagatttaaaaattctcagcacttggtagaggagctacacaaaaaactagctaaggcatagaataacattgtcaaccaccttgatatacctagtatttatagaacactacactcaaaagtggcagaagagacgttattttcaagtaagcatggtacattgatcaggatggaacatattcttatcaggataatgcagtcctcataaaatgagttagggaggattccctctttttctattgtttggaatagtttcagaaggaatgggaccagctcctctttgtacctctggtagaattcagctgtgaatccatctggtcctggactttttgtggttggtaggctgttaattgctgcctgaatttcagaacttgttgttggtctattcagggattcaacttctccttggtttagtcttgggaggttgtatgtgtccaggaatttatccatttcttctagattttctagtttatttgcatagagatgtttatagtattctctgatggtagtttgtatttctgtgggattgacggtgatatcccctttatcattttttattgtgtctatttgatttttctctcttctttattagtctggctagaggtctatctattttgttgatcttttcaaaaaaccagctcctggattcattgattttttttttgaagggttttttcatgtctctttctcccactattattgtgtgggagtctaagtctctttgtaggtctctaagaacttgctttatgaatctgggtgctcctgtgttggatgcgtctatatttaggatagttagctctttttgttgcatcgatccctttaccattatgtaatgcctttctttgtctcttatgatctttgttggtttaaagtctgttttatcagagattaggattgcaactcctgcttttttttttttttttttttttgctttctatttgcttggtaaatattccttcttccctttattttgagcctgtgtgtgtctttgcatgagagatggatctcctgaatacagcacattgatggatcttgactctttatccaatttgccagtctgtgtcttgtcattggggcatttagcccatttacatttaaggttagtattgtcacatgtgaatttgatgctttatgatgctagctggttagtttgaccattagttgatgcagtttcttcatagtgttgatggtcttttcaatttagcatgtttttgcagtggctggtatcagttgttcctttgcgtgtttagtgccctgtagtggtgacaaaacctctcagcatttgcttgtctgtaaagcattctatttctccttcacttacgaagcttagtttggctggatatgaaattctgggttgaaaattcttttcttgcctgtaattccagcactatgggaggccaaggcgggtggatcacctgaggtcaggagttcgagatcagcctggccaacatggcaaaaccccaactctaccagaaatacaaaaaaattagccaagcatgggggcagacacctgtactcctagctacttgggattctgaggcagacaatctcttgaacccaggaggcagaggttgcagtgagccaagattgcactactgcactgcagcctgggtgacagagtgagactccgtctcagaaaaaaaaaaaaaaaaagaattcttttctctaaggatgttgagtattggcccccactctcttctggcttgtagggtttctgcagagagatccgctgttagtctgatgagcttccctttgtgggaaaccctacctttctctctggctgccctcaacattttttcctacattttgactttggtgaaacctggcagagacgcaacaaaaaaggaaaatgtcaggccagtatccctgatgaacatctatgcaaaaatcctcagtaaaatactggcaaactgaatccagcagcacatcagaaagcttatccaccacgatcaagtcagcttcatccctgggatgcaaggctggtgcaacatacacaaatcaataaacgtaatccatcacataaacagaaccaatgacaaaaaccacatgattatctcaatagatgcagaaaaggctttcaacaaaactcaactccccttcatgctaaaaactctcaataaactaagtatcgatggaatgtatctcaaaataataacagctatttaagacaaacttacagcaaatatcatactgaatgggcaaaaactggaagcattccctttgaaaactggcacaatacaaggatgccccctctcaccactcctattcaacatagtattgaaagttctggccagggaaatcaggtaagagaaagaaataaaggatattcaaataggaagagaggaagtcaaattgtctctgtttgcagatgacatgatcgtatgtttagaaaaccccgttgtctcagccccaaatctccttaagctgatatgcaacttcggcaaagtctcaggatacaaaatcaaggtgcaaaaatcacaagcattcctatacaccaataataaacagccaaaccatgagtgaactcccattcacaattgctgcaaagagcttaaagtacctaggaatccaaattacaaggtatgtgaaggacctcttcaaggagaactacaaaccactgctcaaggaaataagaggacacaaacaaatggaaaaacaacccgtgctcatggataggaagaatcaatatcaagaaaatggtcatactgcccaaagtaatttataggttcagtgctatccccatcaagctaccattgacttttttcacagaactggaaaaaactactttaaacttcatatggaaccaaaaaatagcccgcatagccaagacaatcctgagcaaaaagaacaaagctggaggcatcatgctgcctgacttcaaactatactacaaggctacagtaacaaaaacagcatgctactagtaccaaaacagagatacagaccaatggaacagaacagaggcctcagaaataataccacacatctacaaccatctgatctttgataaacctgacaaaaagcaatggggaaaggatcccctatttaataaatggtgttgggaaaactggctagccatatgcagaaaactgaaactgaccccttactgacaccttatacaaaaatcaacccaagatggattaaagacttaaatgtaagacctaaaaccataaaaaccctagaagaaaacctaggcagtaccattcaggacataggcatgggcaaagacttcatgtctaaaacaccaaaagcaatggcaacaaaagcgaaaattgacaaatgggatttaattaaactaaagagcttctgcacagcaaaagaaactatcatcagagagaacaggcagcctacagaatgggagaaaatttttgcaatctattcgtctgacaaagggctaatatccagaatctacaaagaacttaaacaaatttataagaagaaaacaaccccatcaaaaagtgggcaaaggatatgaacagacacttctcaaaagacatttatgcagccaacaaatgtatgaaaaaatgctcatcatcactggtcattagagaaatgcaaatcaaaacacaatgagataccatctcacaccagttagaatggcaatcattaaaaagtcaggaaacaacagatgctggagaggatatggagaaataggaatgctattacactattggtgggagtgtaaattagttcaaccattgtggaagacagtgtggccattcctcaaggatctagaactagaaataccatttgacctagcaatcccattagtgggtatatacccaaaggattataaatcattctaccataaagacacatgcacacgtatgtttattgcggcactattcacaatagcaaagacttggaaccaacccaaatgtccatcagtgatagacgggataaaaaaagtgtggtacatatacaccatggaatactatgcagccataaaaaaggatgagttcatgtcctttgcaggcacatggatgaagctggaaaccatcattctcaaccaactatcacaagaatagaaaaccaaacatcccatgttctcattcataagtgggagttgaacaatgagaacacatggacacagggaggggaacatcacatactggggcctgtcagggagttgggggctaggggagggatagcattagcagaaataacctaatataggtgacggattgatgggcacagcaaaccgccatgacacatgtatacccatgtaagaaaactgcacattctgcacatgtaccccagaacttaaagtgtgtatgtatgtgtgtatgtgtatatatatatacacataacatatatatatacacacacacacacccaacatacacacacacacacacacacacacacacacacacacacacacacatatacacataacatattcttggtcataaaataattctgagtacattttggaagatgaaagttatatggtgtatgttctgtaatccacagaattaattagaaatcaataacagtaagacaatagatgtcaattactggaaattaacataattttttataatcattgggtcaaaaaactcacaagagccattagaaaataattttaaatgaacaataatgaaaataatacatatcaaaatttgtggggtgtagctaaatgaatgcttagaaggaaatttgtagccttaaatacctgtatttgaaaagaagaaatttctcacatcgttaacttaagcttgtatcttaagaaaccagaaaaataaaccaaaagaaaacagaaacaacagcaatcagaaattagtgaaatagaaaacagaaaaatagtagagaataattaataaaaccaaaagtactctttgaaaaaaattaatagaattgaaaaacgttttggggtattgttaaaggaaaaagagggaagacacaaattactgacatccaagaaaacattagaaaacccaatatcaatgaatggaagtgaattagtaattaagaacctttcctcaaaggttccaagcccagacagccttattggtgcgttctgtcaaacatttaagttagaaatttgaccaatcctctacaagctgtttgagaaaataatgagaagggagtacttctcaacttattttataaggccactgtcaccctcatttcagaaatcagacagaactattttaagaaaagacaactatagcccaatacacttgtgaacatatgcagaatttcttaacaaagtatcaacaaattaaacaataggtaaaaagcataaaagcttaagttatgtggccaaatggagcttctcccaagaattcaaagttgtgttaacatctggaaactattaagctaatttcaccatattaatatgataaagttaaaaatctgtgtgatcattttatagagatacagaaaaagaatttgacagttttattttctttttcttttcttttcttttttttttttttagacggagtcttgctctgtcaccctcactggagtgccatggtgtgatttcagctcactgcaacctccatttcctgggttcaagtgattctcatgtctcagtctcccgagtagctgggattacaggctcctgccagcacatccagctaatttttgtattttttgtagagacgaggtttcaccatgttggccaggctggtcttgaactcctgacctcaggtaatccgcccacctcagtctcccaaagtgctgggatcacaggcatgagccactgcacctggcctacatttgacaaaaattcaacaaactttcattaaaaatatgcagatggctagaaatagaatagaacttagttgattaagtaaatgttatatagaagatctacaacttacataatattcaagggggatgaaaacaatgttattcctaacttgtgaaacaaagcatgtatgctgctgtttactttcatttaactttgtactgcaggtctgatctagggcaataaagcaagaaaaagatgtaaaaagcatacggattggaaacaagtaaagctgctcttgtttgcataccacatggttgcatgtgtagaaaatgcagaaaaataagagtgactggaactaataaatgaatttaataaagttgcagtatacaaagtcaatatacaaaaatcaattgtatttttaaatactaataagtacaattagaaagtgaaataaaaccctccacaatagcataaaagaacagtcttgtgtcacttaatgacagtgatacgttttgagaaacatgtcattaggaacattgtgtaaacatactacttggacaaacctagatggtatagcccaccccatacctaggctatttggtgtagcctgttgctcacagtttacaaacctgtacagcatgttagtgtactgaatactatagacaattgtaatgcaatggtaagtatttatgtatctaaacatataagcataggaagggtacagtaaaaatacagtgtaataatcttaggggactgccatcgtatatgcagtccatcattgactgaaacattgttatgtggtgcatgattgtatgtaggaataaattcagttaaagatgtgaaagatctttacacagaaaattacaaacattgcattgggaaattaaagacctgtataaatgtagagctataccatgttcatggattggaagatttaaatgattacgatggtagttttcccaaaattcatctatagatttaatgtaattccagtcaaaatccaaatagactttaagaagtagacaagctgattttaaaattcacatggaaaaataatgatccttggtctgataaccaaatgtcaaaaaataaatgcttgatataaatgctcctgagactgattgttcaaactacaagctgtatccttttttttaattttttctaagaaatttactatgatctggaaacaatgaaaggttttggctttgaaaacctttccttggaatgtctgttggacctcatagaaatcttcaggatgtcaatgatggacttaaaatagctaagcaaaacacttctaaaaactgcagcaaacttttagggggtcaacttaatagttaggattggccaagtgcggtggttcatggctgtaatcccagcactttgggaggccatggcggatggatcacttgaggtcaggagttcgagaccagcctggccaacatggtgaaaccccgtctctactaaaaatacaaaaattagtcaggcattgtgtcacacgcctgtaatcccggctactcaggaggctgagacaggagaatcacttgaacccacgaggtggaggttgcagtgagctgagatcatgctattgaactccagcttgggcaacagagtgagaccgtttccaaaaaaaaaaaagtaggatatatatatgtacagacaaataaaatttaacttttcatgtaaatgattttaactcgagttttcaacaatttttttcttctctttttttctttaacatacttccaaaaaatgctactacagactttaggcatgtggtgaatgaaatgctcttaggattattttcactttggggtgatggtgagagtgtatgcttatctgtgttgagtgtgtttgatctctgaatagattttatttgtattgatttcatagtttataaaaggaaaatatttaaatcatttaccatcttctattaatgggaaattttactcatttttatagggaagaatggacagaagctatccaggctgtagcagacagactgcagaggcaagaagaggagagaatgaattgtagtccaacttcacaaattgataatataggagaggaagagatggatgcctctacaacccatcataaaagaaaggtagaaaataataacttattcccagcacagcattcatttgtctggaagaaacatattaaaagctaccatttgcagaaagatgtcagccagttttcttacgatatgtaaatatattggtgggtcttattcacatgaatctgaaatacctgttgttgtttaaaaccaaataggtgaacattgtttcagtgatccagcactttagcactgaatgctgatagggctcatgtgtgactgatgtgccatcacactactttataatttgcattttttccttattatttttaatacaattttagaaactttgtaataaaatgttttccctgatgatttgttcttttccatttcgcatttcgtattctcccgaaaagcacgagcagtaatggctcggatgtacttcctgattggtgccctcagtcatagtaaagtcagcaggaaagtgaacaatcttggaaacaataactcttatttaatggctgcttctgagtcagtagggaaatagacttttccttctctcagtgttccagcataataagtacgaatttatatttttatgagcaatataaattttttcattgcaatagaaaattgaaaagcaatttccttattacaaaaatgatattttcatgattaaagatagaggtgttgagataagcttgccatttatcactttagaatatgtttgatttaataggttgtaaattaatcttcagggaggaaaacacaaattttcaaggtattatccatgaaatttggtattagcacagtgattaagaactctttggagatagactgcctgagttcatatcctcccttttccacgttaaacttgtggacttggtgaagttacacactcacaacataaagttaattatcctttccttatgtgaataagaataatattctatacttgatctgggccaaatgtctgagatccctttctgtcttcattgtagatttctactctgtttgtttgttgaactgaatccctcttttcttttacgtcaatttaatctgccttgttcctccatcattgcaaaaagaaaaacaaagtctagctacacccacctacctactcagagataagaaagcttcttttgtacatgtgtaaattatttcatttaaaatgaaatgaagaatagtgtaaatctgatatggttaagtatttgaaccccaaattcaaaatacctctatggatttttctttttggagactcagttggagtaaaaaattctaagagaagatgttttagagtgatgtttatgtttaattatctttatgtggacaaagaatagtagctaactttaatagctaatatttattgagcacgtattacataaacactttaaacattttttttttcattttgaacttcaactataagttaagtaccattattattcctgttttatagttaagggaaataaaggatggaaggattaagaaattttccccttaattacacacagggtgggagccagtacttaaccccaggcagtaagatctgaactcctccctttctagcactaggttgtgatagtaaagttctactggttttttcaagaatttacaagctttattatcaattgaaattaactaatatccaaatgtcatataaggacaacagtttttcataatattttgagaaacagagtatagtcataagagaatatctgcataattttgtttctaatataacttcattataagcataaaaattatagagattagagaggctcaagatatatgaaccaagaaaaagaaataagctgtatattgacgtgttacagtatacaattaaaagatcttatatgtttgaagttctgttaacttttttgaaataatttaaaatagttctaaattactgcagaagttagtgcagaaaaagaacatttgtaccactactaactccataacggtcctaatgacttagcctcaagtggtaaaatattactgtcattttcataagataaatgattctagaactatacccttatgtatatcaattatcatgcaaagaattgcagaagtttggattatttttaagactataaccacacattgtgaaataagaatattattctaataatttataggatacatttccttctttaatttttgccaaatggcaataggattaaaagaataggtactgattatgatggctatggtgacagttgtcagactgctatttcttgcatgaaatagggttcgttacctcccttagtggtggattatcgccacagtgtctgctctgccagttaaaaactcaattggaaaggaaggatgttgggtgtaaagaggcaagggcctcacagacagatttaagtgctcttctttgtttgaattaaaagaaaatgtggttctatgttttaattaaaagatagcgtttcagaggaatttgcttagagaacccagaagtgcctaatcttggtcagccaagctaccattcttgtatgccttgtcaagtatgtgaaggggcatagcataaaaggataaaaagccaagtgagagtcaaaattctgcttaatttttaacagactagcataagcttctctgggatcaactggctataatctcatgatttacgtttaaagtataagcagtgcctcctgctttcccactaagtttgactccagttcttgggattgtatcacctaattcctggctgtagtaactcataccagtggccagtatccagagaaaaagagaaggaaaaaaagaacaatggccagacctgctgaaatctcatgatctcacactgcatgaatctgcttatttaaaagggagaagcgacgtaaccaatgtagaagttgactaataacattagctccacctcttcccgtgagaaagagcaccaggagaagtgggcagagatggaggcaaaggagtgaacttcgtcagagctcttttcctctttctacttacttggttttgctgttacattgtaaatgtatctggaatttatctttttttgaccaaatatgctaatactgtggtattcttggaagttctttatgttcctcattgattatatgtttatttttaatctaatttgtgggctagacagtgtcttatattctggtgtgcctgatttgaacacatttattaagcatttgttatatatgcccatgtatctctttacctaaaacagccacgtaaacatgtaaagggaagagtgtaactgtaaagtatttccccaataaattcttaagatcaggctttggaggaggattatttttctggagagtattcatactcctatatttttattaaagacttactgtggctgggcgtggtggctcacgcctgtaatcccagcactttgggaggccaaggtgggcggatcacaaggtcaggagatcgagaccatcctggctaacacggtgaaaccccgtctctactaaaaatacaaaaaattaaccaggcgtggtggcgggcgcctgtagtcccagctactcgggaggctgaggcaggagaatgtcgtgatctcaggaggcagagcttgcagtgagccgagatcgtgccactgcactctagcctgggcgacagagcgagactccgtctcaaaacaaacaaacaaacaaaaaaaaggacttactgtatctttttccataacatcatccagaagaccaaaacattttgtaatagtgtacatttcatttgtaaagactacacaattactgtgtataccattctgaccatgagcatttgatagcaaaaatacctttttaatttcctgaagttctgtcaaaatagatgggaaatctgtttctgattttatcacatacagtgctttttaactaatagtaatttccatgtaaattcccttttttttaaagattgagagtcaaactgacaagctgtgaagttcagtgaaggctgtcatactttttttttagcctcattgttcctaagaattgcaattttactatttacttatttatttattttcatttgagacaaggtctcactcctatcacttaggctggagtgcagtggcacaatcgtgactcactgcagccttaacttcacaggctcaggtaattctcccaactcagcctcccaggtagctgggactacagacacctgccactgcacttggctaatttttgtatttttttgtagagacagggttttgccatgttgcccaggctggtctcaaactcatgcactcaagtgatccacctgccttggtctttcaaattgtgggattacaggtgtgagccaccacgcccagccaagaataaggattgcaattcttaaggaatatagtaatattttataattaaatattgttttcaactgaaaatgtcataaagcattttacagattgttttctaatttttaccccccaataattcaatttcattttctatgatatttaataataaggcacagcaagtattattttctagtgcttttaaataaaaaaatgaggaacatactgtccaaatgaaactttgagcaataaattgacactctggcctggttatgaaaataatgtttctgagttacttgccatgtgtattagggttctctagagggacagaattaataatatatatatatatatgtgtgtatatatgtatgtgtgtgtgtgtgcgtgtgtgtgtgtgtgtatatatatatatatacacacacacatatatatggagtttattaaggagtattaaacacacgatcacaaggttccacaataggccatctgcaaactgaggagcaaggaagccagtttgagtcccagtgctgaagaacttggagttgatgttcgagggcaggaagcctccagcacagcagaaagacgtaggctgggaggctaagccagtctagccttttcatgtttttctgcctgctttatattctagccacactggcagctgattagatggtgcccacccggcttaagggtgggtatgcctttcccagcccactgactcaaatattaatctcctttggcaacaccctcacagatacacccaggatcaatattttgcatctttcaatacaatcaaattgacactcagtattaaccctcacgctgtggaacaaactacctcaaatttaatgtcttaaaacaatagccatgtaaatatctcatgattttgtagtttgggccactctgttggtcttgcatgcatggctctcaatcagctgcctacagcttatacatgggtgggctggaaaatccaacaaaaccttccttatgtgtctggggccttggtgctgactgttggctatggtgtcttggttctcctccacttggtctctctctcggagtggtaatttatcttccagggtctctccacatggcctctctctccagcaggataatatggactaactgacagcattagagctggctttctagagctttccaagagagagaacgcataaactgccaggcttaaaggctttgtctgttactggcatagtatcagtttgatcatattctgtgttcaaagcaagatacagggttagcccggggagagagaaagttgactccaccccttcatgggaagagtggaatgtgcatacagggagaaatgggaatttgtggcagccatctttgcagactacctagcacaaatagcttgttatgtagtattccctgattttttctgctctattaatgcaattaaatctaatattacctgttatttgttcaaatgacactagctgatttactatatttgatatttagagctacatgtttgatttttagttgaattaatatatcttattattttccctgctatctctttgctactttatctttgaactagagatattattgaatgtaagacactttaatttgacatttggggaaaattataaaaaatatgagcagcaaaaaatgttgaaagtgaacgtaggcatttctaaaattttaagaatttttatgtaatatacatgagagatattgggatgtagttttcttgcattgttttcctctcattttggtattgtcaaaaaattggggttcagcctgggagaccacatgggttcttggcttcacacaagaaggaattcaagagcaaacaacagaataaagtgaaagcaagtttattaagaaagtaaaagaatgaaagggtggctactccataggcagagcagccctgatggctactggttggctatttttgtggttattttttaatcatatgctaaacaaggggtggattactcctgagttttctggtgaaggggcagggaattcccagaactgacagtttcccccgttttcagaccatacagggtaacttcccgatatgtcatggcatttgtaaactgtcatggcactgatgggaggttcctttggcatgataatatattataatgaatgtataatgagcagtggggacaaccggaggtcactttcatcaccatcttggttttggtgggttttgactggcttctttactgtatcctgttttaccagcagggtctttgtgacctgcatcttgtgaaaggagacctgccaaactcctatctcagtatcaggatgatgcttgtctcagaatgaatgagaagtattcctcattttaattttcagaaagaatttgtataaaattggtgtcatttcttgtttaaatgtctgtagaattcaccagtgaaaccatctgggcctggagttttctttgatgaaaggtatttaaccacagactcaatttttcttaataaatatggggttatcaagttatctgtttctttcaaagaaagagctttcaaagcttgagactttcaagcaatttgttcatttcatcaaaggtgtcaattttattgtcaaaatgccatttataatagtctcttacgtttcttttaatatctgtagaatctgtagtgatgccacctctgtcattcctgatattggtaatttgtgtcttctctatttttctgaccaacctggccagaggcttatcaatttttattgatcttttagaactagcttttggtttcactgattttttctctactctttttctttcttttaaaaatttaattgatttctgctctgatctgtatcattttcttctaactcttttgggttaacttgctttttttttaagtttgttaaggtggaaactgaaacaattgatttgaaatatttctcacgtttactttagataaatgataaacagaaaaaaaaagttataaaaggcactaaaattttcagtgacttgtaatttcaagataaaacccaaatacttatttgatatttataaacctctaaactgagtttaaatttatgtaaactgatcatatacaattaccttctcttctcttcaaaaacctattaatatgaaagtaaaggaatttcaaaaggaggcaagtccacaaaaatgaaaagctgggtcggggaggggcattagggcacaaatgccttcaaaagtttggaagtttctggaagaatgttgatagagcagagcaggaaaagagtacatagaggggactgtagagaacaagtggcacgtgtgactggcaaaatcctcaggattacctgacttaagaaagagaagtgaaactgaaaacaggcacattaattaaagatattcttcttagagctcccttccttgctgttctgaattgcataaagtactctctcaggaataacaactgctttctttgatttattttaactgaagtatacgaggttctcgacatttcttataaatatatcctatatctctctctttcttggattttatctttattttgctagagtaaattctcagatagctccttccaaagcactgcttttttaggcatatttggaaatgtttgtgtggaacatttttgattatcacattttctgggggtagcagcactactaaatccttgaaaacttgagtccttaaaaatgagtgaaaataatttttttcctcctttgcccttttacacaactgataatttcgctgaggaattctaggttcaaaatcattttctccaacatctgagaactgcttaaattattttcagcatccatggttgctaatgagacagccaatgccagtctgattctttttcatttaaatgtgcttataaattggtaaaatttggttttgagtggatattgcaaacacatatatatatgctaacaaataaattgcatcaaatacttcatattatattttttaatttgtatttttcagacaatgaatgattttgactatttgaaactactaggtaaaggcacttttgggaaagttattttggttcgagagaaggcaagtggaaaatactatgctatgaagattctgaagaaagaagtcattattgcaaaggtaactgatttattaaagttgattactaaatttttgtttgcagtgtgcatgtgtttgtgggctcatgaatttacatgctaatgtatgcaaattccattaaacaaccaaaatatggttgtagactactgctacagtaatttttgtgtattaatatttgtaatttttaaagttttcagacattcataatatttgtatattatatactaaagctattctcttaaggaaatagaaatgtttatgtttgcatgtttgggagaatgttttgtgatctatatcataattatactaggattgctttttaataatttctcctatcgttctgaatttcttattaagattgactagtgtagatgatttttactcataaattctaaagcttatataacattgaatggaaaaacatcctaaatagatttgaaaatactagaatggtgaaattaaaataaattattttaggaagacttacttcccacccccatacctttattcagcttagacctttttaaataaataacatgttaatgatgtcagttctcactcagagttctgaacaaaatcccaattccctcaggagatacactttacaaattggtccatgctttaagtcttacttaattcaacaaatgacataaattactgttatactttatggactacttcaacttccagttatttgctactatagtttcctcatctggagtgtattgccccttacactttgtgaaactttgtttccctgtctttgtacatttgttttgacctcaactcctttacaagtcaatgcccctattggaaagaacattggctttggaatcatacacacctaggttcactactcacctaatagtctttaacaaccagtactttttaaagcagtactttggggaagtactggtctcttaggggcatttggaaatgtttatggggggcacatatttgcttatcacagtaactgaggaggaggggtacttctgacagttaccaggtagaagccgaatgtgctcaatatcttgcagtgtgttgggcaaccaatcagagccttagtttttttcatttaaattggtataataaaacctctggacaggaatattttgaggattgggatatgtaaggtatttagcatcctagctggcacttattattaattaagctgatattttctgggaggtagtataatgtcaggtaggttttgctgcttagtaagtgatccaactttttatgcctttattttcttatctacagagtggggctaatagtagtacctgcctcatatggttattttcagggttaaatgaatagataaatataatagtacatgccatcagtattaaataaacttaacaaattaaattacaaatcaaatgaaattaaaatatgctattgttataaatatttgctataattattattactattattactacctactgtgtattattactacctactgtgtatcaagcatcagtaaatatctattccattctgttttttcttttatatattagcctcacttgtatcccattatttaatttctgttcatcagactggggaatatcctattagacactgtcttatctcactacttacacttttctgagtaactgtacagaactacgtatatttcacaaatgatagactattctgattgaagtagtgccttgctgctttctcccaacaaatctatttatcgtttcttgaaagaaaatatgctcatttatagcaagatgattaacactatgaagatttggagtgtgacaagacctggggtttggttcctgctgtgcccttctcagagcaacatatcagggaagaaatgattttgatatctttttactggtgatgttaattttgattgcttgactacagtggtgtctactgtgtttcttcactttaaagttgctattttttccattcataagtaatcagtatcttagaggaaatactctgggactatataaataacctattttttcttaaacttttaggtactaattttaacacccatatcagtggattttgcccataataattattactgttgtgttctaatggtgattttctatttccctcattccttatacatttattcttagttaagctaagggtttatcaattttgttaatcttttcaaagaaccaacttttggctttgttgacttttctttgttttatctgtctttgctttaatctttatttttttttcctactgcttgctttgggttaatttatttttttcctagttccttaagttataaagttagattgttgatttgcaatctctcttatttagtataagcatttatggctttaaatttctcccttagcactgtttttgtggcatcccataaattttagtctgtcgtatttttgttttcattcatctcaaagtatttctaatttcctttgtcattgattgtgtctgttgtttaatttctacaaatttgggaattttcttgttttctttatattctaacttcatgttgtagttggagaagatactttgtatttgtcttttaaagtttattgagactttatttgtaatccaacatatgatctatcctggagaacgtcccctatgcacttgaaaagactgtagattctgttgttaggtagagtattttgtgtatatttaatagagcattttgtgtatatgtcttagatttagttgctttattgagttgtcgaagtcttccgttgccttacttctttctttctggttgttgtattcatcattgagagtgtagggtattgaaatctccaactattattgtaaaatggtcattgctttctgcagttctttcaatttttgcctcatatattttgatggtcttgttattaggtatgtaagtgtttattattgttatatcttgctgtattaacttttattaataatatctttttttggtgttttctggccttttcatttaaagtctattttgtctgatattaatatagccaccccttttctcttttggttactatggcagtaccccctttagctgcagttttgcttttcatggtttgagttacccccaatcaaccacagcctaaatatagatgagtatagtaaaataagatattttgagagagagaccatatgcatcacaataacttgtatcacaatatattgttataagttttctattttattattgttgttaatttacttttaatagtagctgttaatctacttttaatatccatttataaaggatgtgcctaatttacaaattaaactttatcttaggtagtatgtgtaggaaaaaaacacagtatatgcagttggctctctgtattccatatccatggattcaaccaatgtggatttaaaatactcaaaaataataatacaagaataaaaatattaaaaattaaaaaaccaatgtattgtaacagctatttacataacatttacattatatctgatatgataactaatctagagatgatttaaagtatatgggaagatgtgcatagattatatgcaaatactatgctatttgatactagggaagtgagcatttgtggattttgttatctgcagggggattttgaaaccaatcccccatggatatcaaggaatgactttatagagtttggtactatccatggttttaggcaaataccagggtctcaaaacatatcctccactaataaggggaactgctatattttcatgtaataattttttctctttcacttttacccagtttgtggcttttggagacagcatggaattggatcattcttattgtttgtttaatcgactttcccaatctctttcttttgattggagagtttagtccatttatgtttaaagtgagtcgtgataaggactgacttcggtccttttgctatttattttctatatgcctcattgctttttgtccctccttttctacataaatgccttcttttgtgtttaattgattttttagtgaaacattttaattctcttgtcatttcctgttgtgtatattctatagctattttctttgtataggttatatttaatatcctgaagttatagtactgtaatttaaatttataccaccttaactttaataaccctcaaaaactccacttctttacaattctgtccttactcctttcaattgttggtgtctttaaattgcatctttatgcattgtgtgtccaaaaacaagactactaattttttaatgtatgagtctctttaatcatgtagaaagcaaaaagtggtattacaacacaaacttacagtaatactagcttttatatttttttgtgtatttagctttaccagatctttaattcttcatctgactttaagtgactgtctaatgtccttatatttaaacctgaagggtttaatataactcactatagcttttcttgtatgacaggtccagtgctaatgaactccctcagtttctgtttacctagaaatgtcttgatacctccctcattttttgaaagatagttttgctggattcttgctttagtttttttccttcagcactttgaatgtatcaaccaattgccttctggccttcaatgtttctgatgagaaatcttcgataatcttattagggtgcccttgtatttgatgataagcaagcaaaacagactcattgctaatatggaaaaagttcgagtggtcttgatagaagttcaaaccagctgcaacattcccttaagccaaagcctaatccagagcaaggccttaattctcccaattctgtgaagggtgagagaagtaaggaagctgcagaagaacagttggaagctaggaaaggttggcgtgtgaggtttaaggaaagacaccatctctatagcctaaaagtgcaatgtgaaaccacaagtgctgacacagaagctgcagcaagttatccagatatctagctaaataattggtgaagatgactacacgaaaccacagattttccatgtagttgaacttaggacttccttagaaaggagaagtcattgcctggctctaaagcttccaagggcagattgactctctcagtagtggctatgcagttggtgactttaagttgaagccattgctcctttaccatttcaaaaatcctagggcccttaagaattatggtaactctacactgcctgttctcttatcagtaaagcaacaaagcttggatgacaagcacatctgcttacagtatgttttactgaatattttaggcccgctgtggagacctcctcagaaaaaaagattactttttaaatattactgctcattgacaatgcaccagatatacaaaagctctgatggagatatacaaggagatgaatgttgttttcatgcctgctaacccagcgtcagttctgcagctcattatcaacgtccattctgcagcccattatttcaactttcaagtcttattatttaagaaatacattttgtaatagacagtaattactgccatagatagtaattcctctgctgatagatccaaggaaacttaattgaaaaccttttgggaaagattcaccattctagatgccttgaaaaacattcagtcttcatgaatgttcatggaaggaggtcagaatatcaacattaataggagtgtgtaagaagttgattccaatcttcatggatgagtttgaggggttcaagactccagtggaggaaataactgcagaggtggtagaaatagcaagagaactagaattagcagtggagcctgaagataggactaaattttatcaggcccatgatgaaacatgaacaaatgaggatttgcttcttatggatgagcaaagaaactggtttcttgagataggatctactctttgagaagatgccatgaacattgctgaaataacagcaaaggatttagaaaattacataaacttagttgataaagcagtggcaggttgtgaaaggattgactccgattgtgaagaaagttgtgctgtggataagcagcatggcatgcgaaagagaaagcctttcttggaagagaaagtcaatatgggaaacttcattgttttctcattttaagaaattgccacgctgggcatggtggctcatgtctgtaatcccagcactttgggaggccaaagcaggcagatcgcttgaggtcaggggttcaagaccagcctggccaatatggtgaaaccttgtctctactaaaaatacaaaaattagttgggtgtgatggcaggtgcctgtaatcccagctacttgggaggctgaggcatgagaattgcttgaataccaagatcgtgccactgcactccagcctgggtgccagagcaagacttcgtctcaaaaaaaagaaagaaattgccacacccactctcacctttggcaactgccaccctgatcactcagcagccatcaacgtcaagagaagaccttctgccagcaaaaagataacaacttgctgagggctcagatgacccttagccttttttggcagtcaagtatttttaaattaaggtatatacatttctttagacatagtgctgttacacacttaatagactacagtatagtgcagtgtaaacataacttatatgcactgggacaccacaaagttagtgtgactcgttttattgcaatacttttgttgtggtggtctggaacaaaacctgacgtatgcctgtatggaaaaaaaaaaaagaggctatttggttgagacatgaaacattggttcttgagaagcccaggtctattgatgtagagtaacctttccttcattacaggtctgaccatactatttgattgtcccatgaataatattcatttacttacaccattggaaacaccaaattggcgttcagtttttaggatttatcaatagacaaagcaccgaagacttaagtatagttacagaacagactgaaaatgttataaaccctgtcagtgtaaaagaaatggtatagttgatggatgtcagctgaaagcatgttataattttttttttaaaaaaaagcaagaatgaattggaggccagagacagggtgatggagccaccagggttgcaaaggcagaggttgatggagccaccatgggcctagaggacagaaatacaaattactgaggattagttacagaccttgaaatcgaatttcccttgctgggtttagaacttgcttggaatcagtgatgtttttatttcttccaatttctccctttctgagtgggaatatctgtcctaggccttttctaccattgtattttggaagcagataacttgttttctagtgtgagaggtccacagatttagaggaattttgccccagggtggattatgcatagagtctcacccattcctgatttgggttataacacttgggacttttgagctgatgatatttaaatgagattttggactttgacttgatactgcactggttgagacttctggggatattggctgtaaagtatggcgtatgggctataaagtacattctttggtctgaagacatgtaacttggtgggggtgcagtaccttctgttccagtcatcttacggtattttgagcttttgtatctaccattgggtatgcaaagcccaatccactgtaaacgtctatttccaagaattaccatttatagcttcctggggatagtggcagtagctcagtgtagtgtatttgccaactatatatgggagtggggggacttttttctggggaatatatgccatagtcatctgcagtctctttctccctttctggcagacaggatggctctttctggaattttgtgcatcagagggtacaagaggaatatatcaatggccagcccatctctgtctgcattgctgcatatctcccatatcttttttatttttatttttggagacaaagtctcactcagtcgcccaggctggagtgcagtggcgcgatctcggctcactgcaagccccgcctcctgggttcacgccattctcctgcctcagcctcctgagtagctgggactacaggtgcccaccaccacgcctggctaattttttgtacttttagtagagacggggtttcaccatgttagccaggatggtctcggtctcctgacctcatgatccacccgccttggcctcccaaagtgctgggattacaggcatgagccactgtgcccggccaatatctcccatatctacttattttggggacccagatagccacctcaaacaagcatgctgggacatccacttgctggttccagtcatctcctgatcctgaaagaagttcttttgatgaccatcaacatgtcctactttaattcaccccttaaattcccataatgattctcatagagccatgcctcattaatcacccatccatttattatttattttgtttacttatttatttttgagatggagttttgctcttgttgcccaggctggaatgcaatggtgcaaactcagctcactgcaacctctgcctcccaggtgcaagagattctcctgcctcagcctcccaagtagctgagattacaggcattcaccaccacacctggctaactttttgtatttagtagaggcggggtttcaccatgttggtcaggctggtctcaaactcctgacctcaggtgatccacctgcctcggcctcccaaagtgctgggattacaggcgtgagccaccatgcctggcacatccatttaatagtctagtttttcactgcctgtcagcctgaccatatggccaggcaaatggccacagcccattcatgggtgtacatccacacatgaaggttatgtttgtttagttcatccatcattgcaaggagaacaatgtacaattgagccctttgagctgatttgttgttctttcatcagtttcacatcagtcagttatagtgtgacagccttccaaacaggatgctggctgattacctttgaactgctatcatctgtaaaacaagccactttttggtggtcagtgagagctctttgtaagacactagcatttgaacagtaggatgtggcaataggatctggtagctttacagatggttccaaagttgatctggaagaaaagaggaggccaagcgtgatgactcatggctgcagtctcaacactttgggaggccaaggcaggagaatcgcatgagtccaggagttcagactcagactcagcctgggcaacatagtgagactcccatctctacaaaaaataaaaattagccaggtgtggtggcatgcctctggtgataccagctactcatttggctgagatgcgggattgcttgagcctgggaggtcaaggctgcagtgagttgtgattgcccccactgtattcagcctggttgacacaaagtgagaccctgtctcaaaaaaaaaaaggttttcttctattgaatatggtaagtgtcttcttgcattcctcagcacattcccgttaagccattttcattttgttattggtactcgttagagtgtttctctgacattacccaagacatggatattttaggttttaggattatgttatgtccttcagtcataaagacagttgcagttaatgcccgggagcaaaccaataatcgtctctctaatgatgtgttctatactttcttgtctggcccatggtcccagtggttactgctggacagcattcatgggctttttgccataagctccagtctgagttgcagatacttctaaaatcatatctgagtgtatatcgtaaggacccaaaggcattaattgagccactgcaacttagataatagcctgctgttgtttaggtttccattcatatgtgtcctttcaggtagttttacggattggatttagcactagtccccagatacagaatttttcttcgcaaaactcaagcaaaccagctgcagtgaatgctgcttgtttactttcatggttatgtaataagagcaatttaattttagttgcctgtagaatgttatgggtggttcctgcccaggttattcgtaagaatttcacagtttggttagaccctggggtatttgctggatttatcctccagcctgtggtattcctgtgagccaccactattttcaagttagccctagcttgttcttaggtttctgataccgtcataatgtcatcagtgtagtatattattgtattctggacctgtatcaagtcagaatcccttcgaaacaaattataatggtaagctgataaatgcagataaacctgcagcactgcagtaagtataaattgggatcattcccactagaaggcaaagtgcagttgtttttttcctgagattgggaccaagaaaaaagtattttcaagatcaatcagtatgtctctctctctttttttttttttaattgaaacagggtctcactatgttgtccaggctagtcttacactcctggactcaagtgatcctcctgccttggcctcccaaagtgctgggattacaggtgtgagccactatgtctggctgagtatgtctcttttagattgttttattttgagaacttctgaaaccatgtcagagactgctgatgctgtagatgatactatattattcaagtcttgattatctgctgtgagttttcatgaataattcacctttttcatgcacgacacagaacttgttggtaacagcactccagtgtcgaacatgtcattaattcatgtgctaaatctcttttggtccaccatgatactgtttcaaattaacaacctatgtgagctggggaagttgcacagattctcatttagcctgttctgactgaagggaaaactaacaagctttctgcagtatagtagctgaagttttccctggtcaaacatcatatccttccccaaaacatattcaggtaatgtggatgcaagtacttccaagattcattcaaacatactaattttcatccaaattttaatttaatcctatcagccatttcatcctcatatcctgtctttctagttattgcctctgctaggattttaccaataggttttggaatcagaggcactgaattctatgtcaggaacccctggaaggtttcttttttaccttctattgtacctacaggtgtgcatatggccttcagtccctactaggagattagttaaaagaaagccctggttctgtgtcagtcctcatcctgattaatttggtagcccatcacctctgatgatttgaactgaggttcttcattgtcatttttgcttcccagcttggtgcattctttgaaattagggtgcatagagtgtttgtttagggcccttcagtgttgggggactaagaggcgctcccattggtaaacctaacttctgatagtgcagcattaagacctttgtgttaacatcagtgtccattttattcatcccatctcttagtaaccgtttaaaacttcatcctgcttgggacttcgttgactatctgttttgtgttacccattcacttgtgattcagtcttattttcttagcatctgtaagacccatattaagaagctgagacaacaaatctgacacatttcttggaccattgatagattttgcagcagttatatcagatgcctgcctagcggggccccttcagtcacagtatttaccatgatttaaagggcatattaaggatgaacaaacatcctgatgaccatgaagttaatccagcatggtttgcatatgcagcttaccagctatgtcatctatggaggagtgccacttggcatttaaaggaggggaaggaccatttcccttttcagggtaaacaaattttacagtggcttttacccagtccaccagactagctgtccctttaggaacaatctattgtgtgtttggatcatgtacaacaatccatgattgttcagtaataaggttcctgcatcaaccccaagcagacttcttcattctgcaacattcagaatcaaagatactgctcccaagttagtcactctcacaatctattttcttaaatgtttttcaggaacccgatgaataccagttcacaaggcaagataactccttcacacataacccctgcttccagtactgtcttggttttgtcacccaccatttggacaatgttcctggtggtcaaaggccatagatatactgtctgtttttttcagcataattttccattgggtttatcctggaggctaacagccatagctcaagctaaccaaaatccaagctttttgagcatcaggatttccttaacactctctcttactttcattttagctgttttaaaatacagcagactgggccaggcgcagtggctcacattggtaatcccagtacgttgggaggccaagtcgggcagatcacttgaggccaggagtttgagaccagcctgaccaacatggtgaaaccctgtctccactaaaaatacagaaaattagcttggcttggtggcatgcgtctgtaatcccagctacttgaggggctgaggcaggagaatcactggaacccaggaggcagaggttgcagtgatctgagatcatgccactgtactccagcctgggagacacagcgagactccctctcaaaaaaaaaaaaaaaaaaaaaaaaacacaaactgcagtggcaataagaccagcagctcctcacttctgtctctaaagtggggaaagggcaagggtggaggaggctttctgtaatacctggaagctgaccgacagaactttgatgagtacatgaaggctctagggatgggctttgtcactaggcaggtgggaaatgtggacaaaccaagagtgattatcagtcaagaagaagacaaaaggtggtgatcaggattcaaagtatgttcaagaacacagaggttagtttccatctgggagaagagtttgatgaaaccactacagatgacagaaactgcaagtttgttgttagtctggacagagacaaactcattcacatacagaaatgggatgacaaagaaacatattttataagagaaattaagtatggtgaaatggttatgacttacttttggtgatgatgtggttgccgttcaccactataagaaggcataaaaatgttcatgatttggagctggaagagctctttagttttcctctttactcaagtctcagtgctatcctgctgttacagtatggttgattaaatggttattcttggtgtggaggtggaaaatggtgatttaagagtttgttattccaagcagttagcctaattttaacctggaagtttatcatgttttataattaaatttttgtcttaaaaaaagtggatacattttataatttcctttgaaatgcaaatcaaattggaataaaaatcttacatgtggggaaaaaagtacacgttaccagtggattgtgtatttagcttgtttctcatcattttgcatttctttatgtatccagtgatctaagtccttgagattttggtctgtcatttctaaattccattgacaacttctatatgtagtaacagcacagtacagctgccgtctcatgccattggtgactgtatacccatttaggcatcagagtttgtcattgtctgccctgtcattcttccttttttgaaacaatgtttttgccatgctttaatgagtcctacttatgatggcaactgtgtcagctgtccctaagaccactctcaggctcagtgagtcatgactcacaagactcagaaaagactcatggttattgtttatgatagtgaaaagtacagattaaaatcagcaaagggaaaaccacatagagcaaaatcctggagaaaccaagtgcaagctttaaggtatcttcttccagtggagtcacatggatgatgtggtgaaatcaaggatctccagagagacagacacaatcggatacatatacatatatgagagagaattcactgggaaattggctcatgtgattatggaggttgaaaattcccaagacaggccatctggaagctggagaccttgggatgctggtaacgtatctccgtccaagttccctgggaagctgatggtgtaattcttagtctgaggctaagggccaggaacctgggttttggtgggaaactagggagttgctggtataaagcctggagtccaaatgtcagagagcctagagttctgatgtccaaggacaggagaagaggagtgtccccattccaggagagtgccttttctttgcttttttgggtcctatttgggctcttagttgattggatggtgtctgctcacattgtgggtgaatatttctcactcagtccatcaattcacattccagtctcctctggaaacacagaaacagctattagtaatgctttaccagttctctaggtattccttaatccagtcaagttgacacataagtgcatctgtgatggttaattttaattctcccagtagtgaagtgttgtcaactaaagaagcttacctgagccttggtgtccagggtttttattggaagtcagtcacataggcaagcagtaccttcatgactgccctgagatgctcagattccaacctctcagagcaaaatcaggcacgaagtattaatcatgcatcctgttgtttgcataaactatctagtcaaactggtaccatgtggcccaagatctccagcatacaaaaatactctgaccaggcagaatatttcagaggctcagaattcatttcccaggagttggccaacggcgccagttctgaagactgacttttttgggaatgtgtagagtttgggcaacccaggcctgatgtgttaccctttttctgcacgtaagtccattaaaataacccaatgcgtttgcttgattactggcatctctttttccttggactcttaagttcttactggtggatcttaactgaaatctcttaacgtgatcagccagttactttgttctcttctttcatattcttttgaacctctgtattaaacattgcatcaacgattgtggtttattgtaggaagcagataatggtttgatctgctataccttcatcaactgtcattgttctattgggagtatgatttcagtgatttatgttctagagttatttcatgtagttcgtgtagcttctattcttcagcagcatgcaccaaggttattcgttatttactagttcattcactcattatttcaataaatatatgtcgaacacctaattatttgctaggtactgctctaggcactgggaccatttgaacgaataaaactgacaaactcctctcctttgggaaattttattcaagtcagcaattagagaataaataatacacataataaataaaccatagagtatgtaataaactaatccatacttacagagaaaagtggagtagggaaataaggaataatgatggtagcgattttggggacttaatgcagttttaaatagcatgactatggaaggcctcactgaaaggtgaaatttcagcaagcatttgaaggagatcaggaagcaagtcctttagatattttgaaggaagaatgttccagcaaggggaaatagcaattgagaaggccctgaggagggagcttacttagcacattctaacacattctttgaatagctaggagtctagcatggtgtggaacaagaatggtgtaggatgtttgtaaggatattggcttttactgtgaatgaagtgggaagcctttggaaatttttatgccgtgtagttacacagtctagttttcagtatcactttggctgcagtgttgacaatagactgtggattggaagcagatagtttgctaattgcagcagtaatctagataattgatgatagtggcttgtactagggtagtagcaatggaggtagtgatgataatgagaccttgggtgtattttgatgaagaaccaacaggattgcttgacagattgaatgtagagtatgagtgggaaaaaaaaggagttggagatcattgttaagatgtttggtctaagcaactgaaagcatggtattgccattcactacattgaagttgactgcaggagaaacttttcaaggggagatttggaattaggttttagatatgtcaaatttgctatttttgttagatactccagtttatgtcactgattatacatccatgccaaataggcattttttaagtttaggaaagaagtctagatttgaggtataaatttggaagtctgtcagcatatatcctgtattagagccatagtctgaatgagtttaccaaaggaagagtgtacccagtgaagagaattctgaggactgagtcctggagatgcttacagaataagggtttcagagcaaaggaagcagcaaatgagactgcggaaagacaaccactgaagaggaggaagatgaagagattaggatgtcctgggacccaaaagaagaacacgttttcaggaggaaggagtgatcaaatgtgttaaatgttacgtttatggcttctcttctgagtaggaagtaagatcgcattttgaaagtgtgaacgagtgaggctgagataaagagagacaaataaatgaaaagctcctgtgcttggaagtcagcacagacctgggttctagtcttagcttagtagcttgactaggtaagggttagtgtgtacatttaagtatacctaccaggcaaggaagaaggcctgggaaagatttgaaacaaccatcctgagaaattgaagagtgacctaagtagcgatggatgaaagaggcctcagaagattcagctgagtttttagggagattccaatggtgttagtcaatatgtttgtgtaaatttatctttagatgtgaaatatagagttaagagggtagagatgaacttgtcccaataccgcgtatgagagaggcagaagaaagactggagtccaaagtgattatatcatgatggaagtcaaaggagttcatttggccttcatctaaggaatatttggaactggagcatcaagaacaaagtatcaaacacaatactcgagaaaggcgcaataatgtttgtagttaacagagaacaacggtgctttcatctccatcaaggtgagaaatcttcaaaaaaaggaatagaaatcaaggaacagaagacagtctgacagctggagaatggaagaagtattagaagtcattatctgggccagtgctcaagttttcaagaaacaaaagttagaacccaaaatttagagcttgataagtgtgacatgtctcctctggcaggaaaaaaaaaagtatacattgctaacatatggcttgttgagacagtggaaaagtaaataataatcactggtaatcattgtttaatttgtaaaagtgtgtcatatcactactcatcagggaaatgcaaatcaaaaccacaatgtgatatcatctgtattagttcattctcacactggtataaagaactgcccaagattgggtaatttataaagaaaagaggtttaattgactcacagttctgcatggctggggaggcttcaggaaacttacagtcatgatggaagggggaagaggcatgtcttgtgtggtatcaggcgaagaaagggcgagtgtgtgaagaggaactgtcagacacttataaaaccatcagagctcctaagaattcactcactatcacaagaacagcgtgggggacactgccccctgatcccagtcacctcccagcaggtctctccctcgacatgtagggattatggggattacaattcaagatgagacttgggtggatacctaaccatatcatcatctcaccccagttacaatgacttttatcaaaaaaacaaaaaaatcacagatgctaaagggaactctcctatgctgttggtgggaatgtaaatcagtataaccactatagaaaaccatatgaaagttcctcaaaaactaaaaatagaactaccatatatatatccaaaacaaaggaaatcatcatatcggggagacatctacacccttaggtttattgcagcactattcacaacagccaaaatatgtaatcaacctaagtgcccatcaatgaatgaaaggataaatgcgatatatgtacagagtggaatattacttagccataaaaagaatgaaatcacgttatctgcagcaacattgatggaaatggaacccattatgttaagtgaaataagccaggcacagaaagacaaatattgcacatttttgttcttatgtgggagctaaaaaacgggattgcatcaagatagacagtagattggttgttcctagaggctgggaatggtagggggatggggagatggagttgattaataggtacagaagtacagttgtaataagacctagtgttagatagttcagtagggcgactatagttaacaaccacctactgtgtattttaaaatagctggaagagaagaatttgaatgtctccagcataaagaaaagttaaaggttggaggtgatgaatatccccattaccctaatttggtcattacacatatggaatgtgtcaaaacaacacatgtaccccgaaaatgtatacaactattatgtatcgaaaaaacatgtgccaaagtaacatttctctaccctcttcccgtttctcccacctgattcgtgtcttcctctaggtctcatttatagctctgggtggatggaggaaatggtttagacggaatgtgtcttgatttcaactagacttgtggtcaatttggagaaaataatgtgagcagagtacctagtgaagtagatagtaggttgtttgaagatgggaggcagttttgtgaagtagaaatgacctttactattgaacttagatgtgggatcagttggtgcagggattaaaggagatgacactcatggtgttcttgatcattaagggtagaaattttctttttctcctcttgtttgccctctcctacacctcattccctcaaataacctaattaccacaaaacatcgagagggtcaaatgaaaggagaactttagatcgtgtgtaatagagggtgaatgataaattggagaggattgggaaaataaaatattaaaaagactattcttctgcctgaagaaataaaatcccattccccctaattcttctatgaaagaaattagatttaaaagttcattatttactattttaccatggataaatatatgtaaatttgtatttcaaaagcttttccatgaaaaaaatacattgtatccccaagcatttctagaactcttcataattatgatcaacagatggattttttaaaaggcatcacattgttttagtcactgttttactactgttatttttaactttttgttttgacatgttgcttttaactgtaattaaaaattattagcatctgtgtttactttttagcttgcgcataccttatcttcatagcagaaactaattagtatgtgaaatacagtaccattaaatatgcattaatgggaagaaattctaatctgatcagctgtaaaatatgttagaaaatacattttggtatgtacatggtgttcattccagttccattctcataacaaatactgtttttgcttttgcctccatacgtctttacttggttccttggatgtggtcagattacaaatttagggggtagaaaagtcttccctcatgaaagttactaagtgatttagaaaaataactattatgcgtgataagcctgttttaacaaaatagaatgtaataccccactgaaaatattcaaagcactagaatatcttttctatttctaaataaatttcatacatacttttctctagtcttttcctaatttcttgacccagatcacttaacatcttaaaccacaacaggtagatgttatcttctgtgaatttctttctgaactgcctattaaaatgtctgtgattcactctcatgttggaggcatgtaacttttatattagcactgttaactttatatctcagaactatcccctttttctttttccgctgccaccatagtagtccaagccatcctcacttctctcttggggttatgtaatgctttcctaattgatccttcttagaagaacgtgagtagactttcacaaacatgtcacccccaccccatcactttctctatgtcccacaccatcacaatacccaacttacactctaccaatagcattggttctcccttacagccccgttgacaatagtggataacctccactttttccttaatatcacttatcagaaagagtaattatttaagttggataatttacttgtttgtgttttccactagcctatgaactctgtgagcaatgggatcttattttttttattaagttaccttataccagcactgttcttaccaattagtgagtgcacatcagcagttttttttttaagtgaatggacttggttcagtatatcacaaaatagccacttgtataatgcttaattatgtatttcatattccctctgtgatgctcattaactgtagtatccccttctctggtttttcccattaacactgatcaccatgtaagtagaactaaagctccatgagagcagagaattttgtctatttgttcagtgtcctgtctctgatgtgcagacgaatacccagaagatacttgttgcatatgtgttgaagaagtcggtgggtgggtgggtgggtggatggatgaatgaactcttgcacacttgacatcttggaattctttcctatgatacacaattcagttcaatagacatttattaggtatctgctgtatgcttaccattatgttaggcacagtgtatatggaaatcagtaagttctggtgtcatttctgcttctgatttattttgttttacaatgtttgctattctaattaacttaggaactatagtacgatatgacattggctttcaaattgagcacttaaaactgactcctataaaacaaataagactgagatgatttcatgtttatgctttccttcactcgttgttaattatactttctgttcagacacaattgatcttaccttctttgaatggttgtgggatcttagcttctttgattaatctagttatcattatctttcgagtttaaggtcaaatatttttataaagataacaaatataatgcagtgtcctgatgttttgcttttcatgtctttcttccatctaattttgattttctgacagtgttaagaaattgattcagcaagggctttatttaagatcttgccagaagtgaagaacagagatgctgtgttcgtttcagcagttgtcttcctttcgtttcttctttaagatagtgttacttttgaaatatgaaacattatctccagttctccatatgttgaagaaaacactagtttgcttttgatatcaatatgagatttatgcccaaagttggggaaaacattcttagtttatttttggtttgaaatatacttacattttaaaatgatcacctacagtaggagggttgtgagctttttttttttttttttttttttttaagaaaagcacattaaacctgtagtctctggagctaagctatgaggacaaaaaagcaaaagaaggatacagtggactttggggagttgggggaaaggatggaagcagggtgaggcataaaagactacacattgggtacagcatatgcttctcaggtgatgggtgcaccaaaatctcagaaatcaccactaaagaacttattcatgtaacaccacctgctccccaaaaacctattgaaataaaaaaaaatgtgtaacacccacgcccccaaccaaaggaaaaaaaacaacctgtagtctctgctacttgggagtctgaagcgggaggattccttgatcctcaggagtttgagctcagcctgggcaacatagcaagaccctatctctaaaaaaataaataaggaagcatataaggctgggcatggtgcctcacatctgtaatcccagctactcaggaggctgaggcaggagtaatgcttgagtccaggagttcaaggttacagtgagctgtgattgtaccactgtactctatcctgggcaacagagcaagaacttggctttaaaaattaagacgcaaattaaaaagccacaagcagaaaggtatatatttttatactctgttcctttctatttctaaaatgtgtaatttagaactaaatattgcatgtgtattctgtgttctaataactaatttatttaaagtaggagacttttaaattctttgatatttattgggaaatatatcctttcatccccctgaataaaatgtattacaaacatggagatattaaattacctcatgcagaaatattagttgataaattgttcccttcaaggaggaaagctcaatatttaattttctgtgtccctgataattttctgactgatttttgtatcattattgatatactttgattaagtatgagtgaatttatatgaacttatacaatcatctgaattaaatcattaatttgagtttttttgtattttggtggagagaatgctgagtggtaaaggaagcatgccactgtgttttaaaatccttttcaatctctgggcttaacctcttccaattttagagaaatagtgaaattattattatcagtgctcaaaacatatattgaaggtttgctttttttcttttgtaggatgaagtggcacacactctaactgaaagcagagtattaaagaacactagacatccctttttaacagtaagtgactagaggacagatgttataatcgtaacatttgaaatttaaggaattttatgttagaaattaaattgtgaaaaatactattcatttagatatctcattttctttgtggaaagaacgtaagtcaaatttcttataacttattagaatgtatggatttttacagtgtgtatgcattgataattcctcccattatgcatttattacttttttgagaattttttttctcccatgaatctcttgccattaaaaacaaaaacaaaccatagagttaatacattacctctggcattttaaggagactattgaggaaatggctgatttttaaaaatttcttaaatgtaaagattttatgtttgttttattggcttctgataaatatcttaatgatcagaagcatttcttcaaatatggaaggcagaaatgtttatcgaatatattttatagaaatgagacttctttgagggatagagtactttaagaaatatgggaatgctaaatacattagaggtgggataagccatgctacgtttttttcactagacaaagtataaactgattatatggtatgcctacaacttagttgtcttgaaagaaactggattttttagttctgttcttagattccttgtaatatagggataattggtaaagtttctgtattttcttggttccaatgaactatattgagatgaaaaataatagctagactttccaaagtggaaccctttacactgtttggaatatctgaaatagacattttcagagctgtcagtagatacctagacttactttgctaccttttttggtgtgtttattgtctagtgtaataagatagcatttgggtattttttaataacctatatataacctacaaaattatataaaccaactctgttaggttgggttctgttgtgcactcaatatgcaaaaagtgatgttgtcattgtattagaaacctgagtgtaacaaccgtagctacattcctaaggaacttcaactagtgtaatttgttggccacgctgtgaggttgcatggatgagaaccttgagtactaatgcagcttcaaatcaatggcaaattagattgagaagtgcttgttgcaattaagtttacttttacttgaaattttaattttagtttttcttgtaataatacctattgtgaactaaacatttgttttatgtttctcataaactcttaagcacttttaagtagtaaataaactcttaaacaataacaattcttttcatctttcatgcttactatttctatgtgttctatttttagtactattataattataagaatacaggattataatgtaacattttttcttttttttatttcaagtccttgaaatattccttccagacaaaagaccgtttgtgttttgtgatggaatatgttaatgggggcgaggtgagtcaagaagtaaatccagtatttgcatggtagtattttcattattttaaaaacattacttaaaatacaagttacaatatagcagttctccatttcttgataggaatttatgtagctcttaatactattgaacaaatgggagcgaaattatttctgatgagatgtaatgattgtttttatataactacatttatatgttggaaagcataatcatattcttctttttcctgtgtttttaaatgtaaaaagttttaacagaagtatgatttttgaaatcatgttattaaattttgaaaaccagaaatacaagatttattgtttcacaaagtttcttttcaagtaggctgtgaacatggtcaaaagttattttacccattctaaactcagtggaacaatagtccatgggcacattatggctgagttttctcttctttatagtagagtactatgactatatatatatatatgtgtgtgtgtgtatgtatatatgagggtgtatatatatgtgtatatgtgtatatatatgtatgtatatatgtatatgtatatatatgggtgggtatatatgtgtgtgtgtgtgtgtgtgtgtgtatatatatatatatatataatttttttttttttttttttgagatggagtttcgctctgtcgtcaggctggagtgcagcagcacaatctaagcttactaccacctctgcctcccgggttcaagcgattctcctgcctcagccccccgagtagttgagactacaggcgcgcaccgccacacccagctaatttttgtatttttagtagagatggggtttcaccatgttggccaggatggtctcgatctcctgaccttgtgatccatctgcctcagcctcccaaagtgctgggattacaggcgtgagccaccacgccgggcctaccatgactatatttaagagactgacaatattttggagataaatttaatatttttattagcacatttcactcattcctttattccttctcctttctcttccttggttttgatcacagtcaatgtgagggaaaagtaaatttactggaaaagctaactggaaatatttttattgtgggctttctgaaataaatttaattattaaatagggtcttgtttgtgtctcatgaacttaaaatattcttattttccaaaataaataattaaatatcctttatggaatttttttcctgtagaattatctgatttgcaggaattcgtttgttgcaaaacttcattcattcagggcttgcatggtggctcagacttgtaatcccagcagttggggaggctgaggcgggtggatcacttgagctcaggagtttgagaccggcctgggcaacatagtggaagcttgtctctacaaaaaataaaaaaattacctggacatggtggcacacacccagctcctgtactcccagctactgaggagctgaggcgggaggatcacttgagcctgggaggtcaaggctgcagtgagccatggtcatgccactgcacttcagcctgggtgacagagcattacctggtctcaaataaaaaaaaaaaaatcaaaacccaaaacttaattcattaatttggtaaacacattttgagtgcctaggcagtatgggtttatgaaaatgtgttaagatattatccttgctgtgaaggagtatataacttcccttagtgtattacaaattagaatgcatagtgaaagacctaacttctaataaagtcataaaagaaaatgctttatggatgatctagcacttagagtaggcttaatgagatttcacccagggaattgatgtaagaagttgtttcaggcagagaggatgggatgggcagaatcactggtggatgataggacaagataattaaataataataacccaggaatacagaactgggcccttgcagtaagatgtctgagaaaatacgaagaaaatggatgttgtggaactgtaggattggtacatctttttttttttgagatggggtctggctctgtcattcaggctggattgtagtggtgccatctctgctcactgcaacttccacctcctaagcttaagctatcctcccatcacagcctcctgtgtaactgggactacaggcatgcatcaccatgcctggctaatttctgtatttttttgtagagatagggttttgccatgttgcctaggctggtcttgaactgttggcctcaagtgatgcacccacgtcagcctttcacagggctgggattacagacgtgagccatcacacctggccatattgttacatcttaatgaccaattaattagatcttggtagaaacaaaaaggtacaatgaaaagtgatttttggttggaatttgggagccttagcagatacagtgcaattatgaagaacatgttaaccttataaatttggttttgaaacagtttttcgtaagcttttaaagtaatgtatgtgtggaactatgatggagagtggataaagagtcaaaactgtggatgcagttttggcagccattcccataaagattataatttaagttatgggggtggaaatgaaattgatgaaacctcttacatcagtatctatcaaaatttaaaatgcgcttatacttggactcagcaatttcatttctaagaatttatcctacagacgtacagatgcaccacagaatgatatatagataagtatactcattgcagcattgtagcattttaaatgagcattcgtaaggagtctgcttaaataaagttacattcatgcagtggaatctctatatccatctgaaagaatgagacagcccaatatgggcattaatagaagttaaaaaaactaggtgcagacgagtataaagcatacttctgttgtgttaaaataaaattagaccgtaaacatgtgtatatatgtttgtctattgatcgagtatctctgaaattatgcactgggtattagtgcttgtctttgggaaaataaactgagtggccagggataagataggaggaagacttttcatttatgtatttttcagtatcttttgtgttttgtgccacatacatgtattatctaatagttgaaagtagacagacaaataaatggttggatgaatggatgaccaagggaaacagtaagacagataaaacagtccgcagacaaaaacttggaaaaacactattaaatgtctctcttttttaaacggtattgtgtgttcatgtctatagtaacaattttcacattgttttacaattacctatttacttgtctgtctttcccatcaaagtgttagctttctaagaggcttgttcacggtataaccctagcatcttattcactgcttgtacatagttggtgcttcacaaatattcattggattatttgaatgaataagtgaacaaatggatgaacattccctcagggattagggataagagaagttagctaaaaggggtaaaataggaactactgaggagtaggaagaaaaatagaaattgatgtagtatacagtttattttgttaaaaaagctgaaagtgtaaatttaggagaggatatctttttatttcaaaaatacatatgtattaagtctttgtggaaggcactctggtagatatctagggcatagaaatctgaattaaacatagatcttgccctcaaagagtttatagtctactggagaaagggtacaaaaataatactaagtgtgaaataattatcacttctatcataacagatagatagatggtgggactttggtgggatgagggaaagcttcctagagggcgctacctggcatctgcacttcttttctaaacccggagtacttaaagattaattaattgatgattattgaaaaaaattttacactaaaagcagattttcagattagccagatgattttctttagcattaatactcctacattatttttcttgttcagcatatctttgtttttcttcagaatttctgttttggattgggctatagataagtattatttaatattttgaagcaagtgaactgattctctagggtctcactccatcaccctgtctggagtacagtggtacaatctcggctcactgcaacttctgcctcctgggctcaagcagtcctcatgcctcagtctcccgagtagctaggattataggtgtgcaccaccacacttggctaatttttgtatttttagtagaaacggggtttggccatgttggccaggctagtcttgaactcctgacctcaagtgatctgcccacctcggcctccctgtatgtggtgtataattttaacatgcgtaggtaattacagtgttggtacacacacacacacacacacacacacacacacagaaaatgaaaagttatttatatttaataactttagtaggaaatagaattttatatatttaacctcacaatttttttttttttagattatcagatgtattttaaaatagttatttagttcttggagtatagtaggattatttcaattcttgatttatcatgactggggaggaaatctatgcttgatgtgtttatccttgtggcaacttgtttaattttggttttgctttgggttcaccttgccatttatgctgcccagggatgccttataaaaatgcagaaaacgaccaggcgtcgtggctcacacctgtaatcccagcactttgggaggctgaggcgggcagatcacgaggtcaggagttcgagaccagcctggccaacgtgatgaaaccccatctctactaaaaatacaaaaaattagccgggcatggtggtggatgcttgtaatcccagctccttgggaggctaaggcaggagaattgcttgaacccaggaggcggagggtgcagtgagccaagatcacgccactgaactccagcctgggtgacagagcaagactccgtctcaaaaaaaaaaaaaaaaaaaaaaaaaaagcaaaaaacttaattactgtagaaaaagtattaaacatagtagttatatttttgaaataggtttaaagtaagggaaacaataaacacacgtaaacaattcacactagcacaatccacacatataccaagactcagccagtggggtaggatctgtatggcatctaaggacttgagcgtgagaatactggccttttgtaagcaagctctggtaagttcataataccaaaatggcagcacactcaaatctttttatatcaagtttttgccctaagatgagctcctttagtggcctcgctgaaataactagcccaatttttactcaatttatgcttattgttcactgatttttaattaacaatagcatcttcttcttagtctatgctctagaaagtttaccttgaattataatttgagttaggggtttagcatgctcttgattatgcttgtgatttttatgtgtttgtcaatataagtcacatgccatgtagcaatgttgaagtcaatgatggatagcacaatggtagtccgataagacaaacatgcacaggtttgtagcctaggagcaataagctataccatatagcccaggtgtgtagtaggctatgttgtctaggtttgtgtaagtcactctgtgatgttcacacaatgatgaaattgcctgtattagttctcacactgctgaaaagaactgccccagacggggtaatttataaaggaaagaggtttaattgactcacagttccgcagggctggggagtcctcaggaaacttacaatcatggtggaaggggaagcaaacatgtccttcttcacatggtgacaggaagaagtgctgagcaaagggggaaaagcttcttataaaaccgtcttgtgagaactcgctgacaatcacaagaatcacatagtggtaaccacccccataattaaattacgcaccagggccctcccatgacatggggattttgggagctacaattcaagatgagatttgggtggggacacaaactatatcattctgctcctggcccctcccaaatctcatatcctcacatttcaaaacacaatcatgcctttccaacagtcccttaaagtcttaattcatttcagcaatatcccaaaagtccaagttcaaagtctcatctgagacaaggcaagtctcttctgactatgagcctgtaaagtcaaaagcaagttagttacttcctagatacaatgggggtacaggcattgggtaaatacacccattccaaatgggagaaattggccaaaacaaaggagctgtaggccccatgcaagtctaaagtccaatagtgcagtcattaaaccttaaagttccaaaatgatctcctttaactccgtgtctgacatccagatcatgctgatgcaagaggtgggctcctatggccttgagcagcaccacccctgtggctttgtagggtacatccctcctcccagctactttcatgggctggtgttgagtgtctgtggcttttccaggtgcactgtgcaagctgtcagtagattaccgttctggggtctggaggacagtgaccctcttctcacagctccactaggcagtgccccagtggggactctgtgtgggggctacaacaccacatttcccttctgcagtgccctagcagaggttctccatgaggactctgcccctgcagcagactggtcatccaagtgtttccacacatcctctgaaatctaggtggaggttcccaaaccttaattcttgtcttctgcacaccagcaggaccaacaccacatggaagctgccaatgcttggggcttgcaccctctgaagcaatggcctgagctgtacattggtcccttttagccacagctgggactgaagcagttgggatgcagggcaccatgtcccaaggctgcacagagccgggttggggggccctgcttttgggccctggccctggcccacaaaactgtttttccctcctaggcctctgggcctatgatgggaggggctgctgcaaaggtctctgaaatgccctgaagacattttctcctttgtcttggtgattaacatctggctccttgttacttatgccaacttttgcagtgggcttgaatttctccccacaaaatgggtttttcttttctattgtattgtcaggctgcaaattttgcaaacttttcttctccgcgttctcttcaatgctttgccacttagaaatttcctccaccagatacccccaaatcatctccttcaagttcaaagttccttagatctctagggcaggggcaaaatgccaccattctctttggtaaagcatagcaagagtcacctttactccacttaccagtaagttcctcgtcttcatctgaggccacctcagcctggactttattgtccatatcactgtcagcattttggtcaaagctattcaacaagtctctaggaagttccaaactttctcacgtttttctgtcttcttttgagccctccatactgttccagccttgcctgttacctggttggaaagctgtttttacatttttgggtatctttacagcagcaccacactctctgtggtaccaatgtactgtattagtccattctctgttctcatgctgctgtgaactgcccgagactgggtaatttataaaggaaagaggtttaattgactcagttctgcagggctggggagaccttaggaaacctacaatcgtggtgaaaggggaagcaaacatgtccttcttcacataggagcaggagagagaagtgctaagcaaaggaggaaaagccccttataaaaccatcagatttcatcagaactcactcactatcagcagaacagcatggagataaccagccctgtgattcaattaccttccagtggatccctcccacaacacattgggattatgggaactacagttcaagatgagatttgggtgggaacacagccaaaccatatctgcctaccagcaagtttctcaggccatatcccagttgttaagtaatgcatgactgtatttggagcactaaaaatttttgatgaaagtgaattgtgaaagaaatgttggctgtgaaaaatcagccctaacttcttacggtcgtattggtacaatggaatttcatcatagttgcatgtaatttatatgaattcaaagaagtgggctcaataagatatagctgagatagacaagttgatttaaatgatgtgattattctgctctttttctcaatttctcaatgagtgtatttacagagtgaccttaggatgagagatataaatttgctattctttactccttgttacttcctactttccatgcatagagcttcatggaatataaactctggtgttttaaaatacaaaacttacataaaatgtcattgagtgcattgtaactgcaggtgttcatttaaagaaactattttctggccaggcctggtggctcatgcctgtaattctggtgctttgggcagctgagataggaggattgcttgaggccaggagtttgagaccagcctggcgaacatggtgagatcccgtgtcaaaaaaaaaaaaaagttagccatgtatggtgatgtgtacctgtagtcctagtaaattaatcaggaaagctgaggtgggaagttcacttgagccgaggaactcagggttatagtgagccatggttgtgctactgcactccagcgtgggcaacagagtgagaccctgtctctaaagaaaataaaagaaaaaagactatattattgtaccaaagatagaaaactgtcctgggtttaactatgtcgagagatgacagtatgttggtctccagtgtaataccgttctaaggaatgtttgggagtgatttgattatttttgataccttatggattaactttataatctagtacattatcattcatctattaaataatgagcaacttctgtgggctagacctcagaagattcataaataaggaaaacatactatttttcctttgatgagtgacttactggggagatagatgagaaaatacttgtatacactgcagtgacatggttgctctgataatactggttactgtgcatggagagaatgagcactttaatgaacctgaggagcagaggaaaggaaagcaaagggtgccagagtaggaaactcttcttaaaaagtggttgctaggctaagacgtaagaataactatacattatatcactaaggttgggaaggagagcattcctacacaggtaaaatggcatgtgtagagtacacaggagcagacaggttcccccacccaccgaatatagcacagtgtggataatgcatagagttctgcagaggaaagccagagagtctgcacaggtagtcagaatcacattaagacagatcttcactctcaagtcatttagatgaaggcagtggagcatcatggaagaatttctttgggggaaatgtttagaaagaatacttggcagtatagaggttgaagtagagaggacaaaagtggaagcaaggaaaatacttgggaggttgctgcagttagaaggttttcagtaattcacttataaaaatgataaggttgtcggatgtggtggctcatgcttggaatctcagcactatgggaggctgaggtgggtggatcacctgaggccaggagtttgagaccagcctgaccaacatggagaaaccccgtctgtactaaaaatacaaaattagccaggcctggtggcgcatgcctgtaatcccagctacttgggaggctgaggcaggagaattgcttgaacctgggaggtggagattgcagtgagcctagattgcaccattgtgctccagcctgggcaacaagagcaaaactccatctcaaaaaaaaaaaaaaaaaagattattaattgaagcagtgttagaaggaagcaaattctagtaatatttagttattagaatcaccaggatttaatgaataaatatgcagagaagtatcatatgatttcctgtttgctgcttggggaattgtggatactggagtatttataaaaatagaaaacacagggagaagaatgagttcttaagcagatcatgctatatttgaggcacctagtgtggcagccaaggagtggggagagttaaatcagagatacaaataggcatcatgagcagtgttaaaacccaggaagtgaggaaatatccaatgtgaggaaagtatgtacagttagaacatcagtggccaaggatggtgcctggaaatgccagagtaaggcatgctgtagacacagctgtagatgcagtgagactagtgcacaggtgtagaggcagagagaagcctaaggaggatcctgggcaggaggagccagacaagagaagccttagaagttaaggagagattaggtacaacagagtatattaaatactgtacaatgataactgagaattgtccattggatttgccatctaatagttcctatggagactaccagggattcttccttttctggtttggtacaaggtatgcaccttggctgtagtacagaatgtaaaagggttggtttggagcccagtagaacaaggttgtaagagtgagttcagtgcaatttcagtggggcatttgtagaactgattgtaaaatctctctaataatatgaccaatcacactgctaatatatccaggcagctctctttttattccttaaatgttactaaatttacatgagaagcagaaaaatatcctgggagaataaagtagacaaaattgactaaggaggtgtttttgttttctttggtttaggaagtctctacttaggacttgtttccaaaatcttactcatagcttcatttatttcaggcttatttgttggacctctgcaaatctctctcaagtctgaagtttcctgaagttaaagattcattaggggagtaaaggaaaatcattgtgtagaaatgctattcatctgataaattcttcacattcctctattttctttatgtaggttgtaatgaagctaacagtttcagttatgtactactatttttgtccatacttagttcattgtaaactctatattaatttctttgataacatgtatttgatttttttgcaatacggctttcaggttcttgccattcttgagattctcatgcttattcagatttctcatttggctggcattttgttatcagtgaaccaaaattatctcattttaaattcacataagacaaaagcaccagtagtcagtattctagttctccttactaatttacggaggtgtgatctgggtgatttttaaattaatttaattatcatttcatattcatagtgatgatttttaaaattttacaaagttttcaggtatataaacatctttattgtcaggtgtctgacaagctaatttctttgctaactattttagttattaatatattatgtaggttgtatcagaattttgtttttcacccaatgctttttcaaaattcccaagtcaagaaggatgcattacaatgtttacattagcatctaaaggcaatgtaaagtcgggaagcatttttagtatataatttcataattcaaagacatttttaaaaaatgaatggttaaaccagtatctcactgcattaaatgtaattgaatgcattgaatttagttattaggagatgttattacaagcctcaacatgtaacatgcttgcttacaaatctaaaatctcagatcaagtggctggaactgcaggggcctgccaggcatctgggtatttacatgattcctttccatgtggttatggcagagcatggccatttcaaggtagtcaaacttcttacacaaaggctggcttaccacagagtgggtatttcaagggagggaaaacagaagaagcaacatatgtataattggaaaccctgaggaggaaaaagagggcagtgacacaaaacagtatttaaatatcaaaaactataatctgaaaacatacttacaggcttttgtgttctccatttttcacttagcataatacttttaaaatttatagatactgttccatatatcagtagtttgtttctttttatggctttgctccgttgtgtgatgtacagtcatatgtttatatagttgcccctggatagacgtttgggttctttacattttgggcctattagaataaaagctcgtgaatattccagtacaaatctgtgtgtgaatatatatttttaatcttcttgggtaaatacatagaaatgcaatttctgtgtcatttgttatgatcaacttcattaaaaactgcagactcttttcaaaatcagccataccattttgcattcccaggatgttacttgacaacatcaccacacttggcatggtagtctttttaaattttactcattctggtggatgtatagtggtattttttagcttcaatttgaatttctcaaataactaatgatattgaacttcttttcttattctgatttgccatttatacatcatcttttttgaagtatcttaaaatcttttgtctgttttaaaaattaggttgttgtcttaatattgagttgtcagatttatttatttcatgtaagggctttatcatatatatattttataaatattttctcccattttatagtttgtcttttcatttcataatgggaaattgttccaaaatacacttttgttgtaatctattgtaatcagcattttaatgcatagttagcattcagtaaaattaatcaattttgactgtacaatttagtgagttttgacagctgtataaagcagtttcccatcaccacaatcatgatctagaatgtttctttcacaacagagcctcgcatgtctctttaaagtcaattctctcccctcactctcaccctgaaaaccactgataggctttccaaccagtatgaagggcagacttctaaattagaggaaacacaattcattgattattttctcttatgatttgtacattttgtttttaaaacatctttttctaactgaagtttgttaagatttttttctaaagtcaaagctagacctgttgggtggtggcaggtcggggagattttcttttatgctttcttctagaagtgttaatagttttagctcttgcatttaggtctatgagccatttcaagttaattttaatgtatactgctacataagggtcatgtttcatttgtttcttgcaaagtgatatctaactgttccagcatatttgttgaaaagactgtctttctcccattgaatgatttggtacccttgtcaaaaatcagtcatatatgtgtgggtcgatttctggactctgcattctgttgtattggtctatatctatcctgaaacctataccacactgtcttcactatgccacacacttactttagaataagtgttaaaatcaggcagcttgaatctttcaattttgatattctttttaaatttggttttgctatccaatttcctttgcatttccacataaattatagagtaagcttgttgaattctacataaaagcctcctggattttaattgtgattgtgttaaatctgttgatcaatttggggagaattgacagtttcacagtgttgtcttctgattcataaatatggtatatgttttcccattatttaagtctttaatttctttcaacaatattatgtagtttttagtgtacaggtcttgaaagttttaaaaatttatccttagggatactttataattattttatgtttttaagttataaatggtttatcagtcattattaaaaatttcaatttgtagttgattcttgctaatatatagacatacagttgatgtttacttattagccatactaatattagttttagtagtcttttattgtaaatatattggatttctctatgtagatgatcatgtcaggtgagaacaaagacagttttactgctattttctaatatgtgtacatttccttgccttattaaactatccaggatgtttagaacagtgttaaagagcaggataagagcaaatatccttgctttatacctaattttagggcagaagcattcatactgtcaccattaaccatgttgttagctgtagatttttcgtagatgctctttattaaaagttgaagaatttctattagtaatttgatgagtttaaataatcttagtttgattagctctgcttctttgttcttatggtggtagctttagggtttagaatatgtatcttttctcatcacggtagactttcaaacaatatgctgtgtcactttacctgtactgtaagaaccttataacagcatacgtctattttcttaccttctatctgaaccttaaaaggcatacatctgtttccctgccttctgtcttttgtgcagttgttctcagacattttacttccatgtattttttaacctttacaatacactgtttttgccttaagcaattatctttaaaataatttttaatagaaaaaatgttttatattcataaagtagtcattttaagtgttctcttttcctttgtgttggtatacattttcatctattacattttccttttgcataaaaacttcctttagcatttgtttttgtagtgcaggtctgatagccgtaacttttgttagcttttatttgtgtgagaaaatctgcattttgtcttaagatgtttccctttctttaaaacagttttgctgagttaataacaaattataaataatttgtacatatttaaagtgtacaatctgataacttttgacccatgaaatcatcaccacgataaaaataacatccccacaaatgttctcctatacaggagattttaggaggaaaggtgcatttgaactaaatcttcaagaacaggtatgttccccaaataagattagctcattcaatcaaaagtatgtattaaatgcttactgcgttcgctaggatgaataaaacagtcatgatttctagaaggagatgcatattataaaataataaaacaaaataaacccaataaatataatggcaacagagtgctgtagtatgagagagaatgatggagaacctactataaatttagttatctctttgaggaagtagtgttaggttgacatttgaagggtatgtgggaaggaacttcctgtgctctgatgagagaagcctgttgagcatgagactttagggcacggctgtagatgcagtcatctttttgcaaggatgggctgaatacctgttcacttactaaaccgtgggagtacagctacactctagtgcagttcctgttaggctattatgagagagagttatggagaaaatttcttcctaatagaatgatgaaatatgcttgtatatttagtagtttgagttaatgcattttacattactgtattcctatagcatggctaagcttaacaataaaaaaaaactatgtagtctttgcctttataaaggaacttaacttgataaagataagctccctattttagcagcaaataattcactttcctttttgaacaaagataagattattcaactattatatatgatttttaatacttccaatgaaaatattttacctcaaaaaccttaaggatgatttttcttataattttttgagaggtatttctgaatttaattttattttttgcaatacatatttatgaagaatataatatgtgtcatatactaggcatggtgctgaagatgcaaagatatggtgtactgtcataattttctcattttcctatgcctttgccaagaaaaaaatagagcattaaatttataataagcataaatcagtacattaattattagtacatttatttgaaacctttgaataatttttttctattgcaaaagtgataatgtacattcattacagagaacttcaaaaagccaaaaaaattattttaattctgtcaaaaaagttcttattgaatgctgctttcttcaaggcaggcactgtactatgtgcttagtatactacatgagcaagacagatggtctctgcatttaagaagggcataggccaggcccagtggctcatgcccagcactttgggaggccaaggcaggaggatcacttgaacccaagagttcaagaccagcctgagcaacatagggagaccctgtatctaccaaaatagttaaaaattagccaggtgtggtagccagtgcctgtgctcccagctactcgagagactgaagtgggaagattgagtgagcccaagaggttgaggctgcagtgagccatcatgcgactgcacttcagccttggcaacagagtgagaccctgtcaccaaaacaaaacaaaacaaaacaaaaatgcatagtattctggggaatggatattaaataattacaagtattttttgaggtatgaaacagaagataaaaaccactctaaatcttaccatctagaaataattgctaataccgtgttaatatattttccactgtttatactgtacacatattttcaattttatcattttaaaatatgttacttgttgcctactaattatgtagatacactttaacttattaaaaccttcccaaatcattgaacgtttaggttgttttcattttttagtcaacttaagtataatttacatataatgaaatgaactcattttaagtatatgattagatgacttctgacaaacatatatatgcatgtagcccccatcacaataaaaatataaaacattctcattgcctcaaaaagttctgccatgcctctttgcagtcagtcttccctgtacccatagtacatccacacgtggccctaggtagccattggtctgctttcagacactaaagatttgattcatctttttaaaaatgtcacagaaatgaactcatacaatatatactgtcttgtatctacttctttcattctgcgtaatgttttttgagattgttaactttgttgcatttctcagtcatttatttcttttattgtgaagtcattatcctttgcacagctataccaccatttgttaatctctcccactggtgacgtacatgcggattaataccagtcattgcctaatatgaataaagctgataggcctgtttcttttctctttaattaatactgaagagtatgattgttggatttatggtaagcatatgcttacattttacaaaaatttaaaactgttgtgtcattttacagtctcagcattaatgtaatgagaattttaggtgttctgcaccctcaccagtgcttgctgtggtcagtggttttcattttagtcattctaacgagtgtgtgggagtatgttactgtggttttaagttgcgtttctcttatgactaatgataggaaatgtcttcactcagactttttgccattgcatatacttttgtgacctgtctattcaaatatttcacctattattcggttgttcatcttcttactgaattataggagttctttggatgttctggttacaaatagtttgccaaatatttgtattacaaatggtttcttccagactgtagcttgccttttcattttctcagtgatgtcttttgaggaacagacgtttttaattttgatgtcttatttatcaattcttgccttttatggttttcactttttttgtgtactgtccaagaaatgtttgtgtaccccaggtcacacatctttctcctatttgttatgtgtcacgtgctatataataagtttctgtcaacagtgggccatgtatatgacaataccataagattataatgtagctgaaaaattcatattgcctagtgatgtaaatgttgtaagtcatactgcagtgcattactcacatgttttggtgatgctggtgtaagcaaacctgtgctgccggttgtgtagaaacatagcacatgcagttagatacataatacttgattgtgatagtacatgactgtgttacttctttattttatatattgtacttttcattgtttcttaaagtgtattactttcacttatttaaaaaaaaataggtaactgtaaaacagcatcaggtgggtccttcaggtgatattccaaaagaaggcattgttagcgtaggagatgactactcgatgcctgctccgaaagaccttacagtgggacaggatgtggaggtggaagacagtgatactgatgatcctgactgtgtaggtttaggctaacgtatatgctgtgttttcatttttaaccaaaagttaaagacgttaaaaaaaatagaaaaatatttataaagatgtaaagaaacaatatttttgtatagctgtacaatgtgttcatattttaaactgttataaaagagtcaaggcgtttttaaaaattttaaagtgtataaagtgaaaaagttatagaaagcaaaggttaactcattactgaagaaaaaaataattttaattattttatacattatacagtgttcatagtctacagtaatcacctaggccttcatattcactcgccactcactcactcaaagcagcttccagtcctacaagtttcattcatggtattataaatgcaatagacaggtatatcgtttttaaatcttctatatcatatttttactgtacttttctagatgtgtttagatgtgcaaatatcattgtgttacacctgcctagagtattcagtagggtaacatgctgtacaggtctgtacctagaagtagtaggctatgccatttaggtttatgtaagtaaaccctaggatgttgtcacaatgatgaaattgtctaattgcacatttctcagaatgtatccccatcattaagcagtgcatgactgtattttcttctaaaactttttaagttgtacctattacatgtataggtctgtgatccattttaatttttatgtatgctgtgagctaagagttgaggttcatttttttccccctacagacatcttgttctttcactatctttcattgaaagggctgtcctttagtcagacatgggggcttatacctgtaatcccagcactttgggaggctgaggcaggaagaccacttatgtccaggagttcgagaccagcctgggcaacacagcaggaccctgtctctacaaaataaaaaatttaaaaaattagcctggactggtggtgcaaggcagaattgggagcattgcttgagcccaagaggttgatgctgcagtgatccatgttcataccactgcattgcagactggacaacacagcaagaccctgtctctgattgtgtgacttgggtacctctgttgaaaatcagtttgtcacacatatgggtctgtttctgcactgtcttattctgtttaattgatctttgagtttctctttacatcagtaccacgctaacttgataattgttgctttgggagtatattttgaaatagagaaaaactttgttcttttttcagaattgttttgactcttctgtgtcctctgcattttcatataaatttattatcatgtcaatttttacaaaaaagtctgctgtaactttgattatgattgcatttaatccataaatctatttaagaatattgagtcttctaatccatggacacacactctgtttgcttatggatttctctaatgtctattgaaacactgtagttttagtgtataggtttgtataatttttcaatttttctttacctattccaattttttcccatttacaattgtttgctgttagcatataagaatatagttggtttttatatattaaccttgtattccatggccttcctaagctcacttattagttctagaaaccctttttctaaatttctttgaaatgtctatgtagatagtcttgctctttgtaaataatagcagttttacttccattcttgtttgtatggcatgtatatatttgtctgtttaattgtctatctgtctatgcatctttcactgcctgtgactgctagtgcagtgttgaacaaaagtagcgaacattgtgtttttgttccctgtctcggaaaagattaagtcttttattattaagtgtgatgttagtcataagtttttcatatataccttttattaggttaagttctctcctattcctagaatattttaccatcagtggacattgacttttctttaaaggtttttgtgcctccattgaggtgatcatatggttgtttatttagacacggagtctcactctgtcgcctaggcagaagtgcagtggcgtgatctcagctcactgcagcttccaggtttattcccaggtttaagtgattctcctgcctcagcctcccaagcagctgggactacaggtgcccaccactgcacccagctaatttttgtatttttattagagttggggtttcactatgttagctagattgctctcgaactcttaccctcaagtgatccacgcacctaggcctcccaaagtgctgggattacagacactgtgcccggctttctttttagtttgtacatttgataaattacattgacattcaaatgttaagccagtcttcattcttgagattaaccatcttttagtcataatgtattatcatccttatatgttgttggaattgaattagagaagttttgttaagtttttacatctatgattttgagggatattgatctgtactcatcttttcatgtaatagttctgtctggttttgtattgtggcaatgctggcctcatgcaacgtgttaacaactgttctcgtattttctgggagtgtttctataaaattgtaattatttcttctttaaaggggtggtggaattcatcagtaacttttgggagctccagtttttattgtgggatgacggttaactataaactcgtatttaactttttttcccattttgtgttccgcttagattataccatttcacatacatcctaagatcctttcactggtatacttttatttcctccttcaagcctttgtactgttgttacaatacattttacatttgtatgtgttataaatgccactatgcattattatttttgttttaaaccagtgattatcttttaaggaaatttaaaacagaagaaaaattaatttctgttccctgacacagttactatttccaatattttctgtcctgtgggtagatcctgttttccatgtggtgtcattttccttcattctgaaacattttcttgaacaatttctagttcagtgtctctggtggtgagttctctaacctacatgtctgataatggctttattttcctctcatttttggaaagatatttagctatgtatgaaattctaatttgccatttttacatttcattactataaaaatgtcactgtactttcttctggcttatacagtttctgtcaagaagtctgctttgttcctctgtgcttcatgtgtctttttttctgtggtcgctgttaagcttttctgtttattacttcctttcagctattgattatgatgtgccttggtatggtttccttcacagttctttggcttagggttttttgtttgtttgtttgttttttgtcttttttttttttgagacggagtctcgctctgtcgcccaggctggagtgcagtgacgtgatctgggctcactgcaagctccgcctcctgggttcacgccattctcctgcctcagcctccagagtagctgggactacaggctcctgccaccaagcccagctaattttttgtatttttagtagcgacggggtttcaccatgttagccaggatggtctcgatctcctgacctcgtgatccgcccagcttggcctcccaaagtgctgggattacacgtgtgagctaccgtgcctggccaggcttagggtgttttaagccttgtggatctataagcatatagttttcattcaatttggaaaatttttgaatattgttctgtaagtattttgttactcatttctcttgttccatcctgagaatctacttatttacatgttagacatcttgatgttatcccactgtttactaatgttctcttctttttttcagtcttttctctgtctttaattttgggtttttccccctgtgtctttaagtttactaatactttcttctccagtgtctagtaacatctagtatattttttatttcagacattttcatctcttgaagtttgatttgggactttttttttcatcttcatcttatgtgcttccctctaccttttgaacttttatattttcaacagctattttttatattttcaacggctaatttattatggtattcgtgtaattatatcttatgtgtcattttctcagtctgtttctattcattgattagtctcctgattataggttattattttcctgtttctttttatgtccgttaattttttattggatgccagacattgaattttacattgtcagatgctggaagtttggggattaaaaaatatatttaggcattattcttatgtataaacagtatgatcctatcagtgcttgcttttaagcttagtaagactggtctggaatatcctttgctctagcactaacacggctgcactattgaggcagtatttttttaaaactctgttagatgccatagtttttaggagatctttctattttgccatgtgagaacatgaaatatttttgcctttctgttagcctggtgattgtttcatctggtccttttcagtggctctttccgtagcttttccccacatacaggtgctgctcaatgagactccgaggcaatccattgtagatctctcgagctctgtctttggtactgtcttctgtctagttacctgtctcatgaattctagataccttggtctccccagtctctgaactcagtatcattaaatcaaggatcctcgtaggctctttttgttttgttttgttttcctctccctgtgttacagcctggacattgtttctaggtatccagctggagtaatcataactatcaccttattcatttcccttttctcctgggcaactgtagatctgtgcatttagttatttatccaattttagaaaatttcagccattctttttcaaatgtctttctcctttcagtaatttatattacacatgtgttagattcattgatactgtccaacaggtcactgaggcttttttttcccagttgtaatttatatcgattctttagctatgatttcacattcagaagtcctttctctttcagtgtcgaatctgttaattccatctagtgaattttttattttagatgttgtttgttttatctctacagtctcatttgtttctatttccctttatctcttctttatgttcatgtactattttgaagtcagtatctattaattccatcatctctgatttttaggtatgtttctaatgactgatttttctcttggttataggtcatattttcttgcatcttgtcatgtttagtaaacgttgattggatgctaaatcatttgttcttgggggtttctttttttaatttatttcttcttggctttattgaggtataatgaacaaataaaattgtataaattttaggtatacagtgtagtgatttgatacgtgtatgtattgtgaaaggattgccacaattgaattagtgaatacgtctgtcacctatcagttacctttgtctgtgtgtgatgagaatacctaagacctactctcttagcaaattttaaatatacagtacagtatcattaactatagtcatgatgctgtacattaaatccccagaacttacccgtaactggaagtttgtaccatttgacaagtatctccccattttacttacctccctaccccagctcctggcaaccatcattctactttctgtttctgtgagtttgattcttttagattccccatataagtggatcatacagtatttgtcatccctgacttattttacttaacataatgcccttgaggttcatccatgttgtcacaaatggtaggacttccttctttttatggctgaataatattccattgtataaatataccacattttcattatccatttatctgctgatagatgttgcttcttcatatccaagaaatctatatatatagagtgtttccattcttggaatagagatacctgcagtcctgccttaattacagtgaataatgctacagtgtatgtgggagtacagatatctatttgaaatattgatgtcatttccttcagatagatatatatacctagaagtgagattgcaggattatgtgatagttctatttttcgtttcttatggagcctccatactgttttccataatggctataccaatttacattcccaccaacagtgcacaagggttcccttttctccacatcctcaccagcacttgctatctcatcttttttataatagccatcctaacaggtgtgtggtaatatctcattgtggttttgatttgcatttctctgttgactagtgatctatcttgagcaccttttcatgtatctgctggccacgtgtatattttctttgaaaagtatattcaggtcctttccctattttttgatcagattttttttcttttttctttttttttcttttttttttttttttttgagatggagttttgctcgtgttgcctaggttggagtgcagtggcacaatctcggctcactgcaacctctgcctcccgggttcaagcgattctcctgcctcagctttccgagtagctgggattacaggtgcctgccaccacgcctggctgatttttgtatttttagtagagacggggtttcaccatgttggtcaggctggtctcaaattcctgacctcatgatccatcctcctcagcctctcaaagtgctgggattgcaggcgtgagccactgtgcccagccgagttttgtatatatttgggatattgacctcttatcagatatattatttgcaagtattttctcccattccataggtttttgactctgttgattgttttctttgcttcacataagcaaagagataaatagtagtcccacctatttatctctgcctttgttgcttgtgcttttggtgtcatatccaagaaatacttgccaagaccaatatcaaggaggtttttttggtatgttttcttctaggagttttatagtttcaggtcttacgtttaagtttttaatccattttgagttggttttttgatatgatgaaagataagactccattacattcttttgcatgtgtatatccagttttcctagcactatttattgaagagattgttctttctcccttatgtattttcagtacccttgtcaaatgtttgttgaccatataggcatggatttatttttggcttttgattctcttccattgattagataatttgagttttacgtgagttactggattttgttttcttctgtcagagtgttagtttttattctggaaggcagtatttacaaatatgattgatatttcagtattgatgttagctttgttcgtgtaagttcaggtttcactctgactcttgagatatctactgaatgcctgagagttcagtaatgactcttctctgactgcctaaaaattgaatgtctctcagctctgcgtgagctctaagagctactacatatttacagctttcctttccttctctgcttgtcctcataaagttaaaccctacacatgcattgcttagtattcaactgcagactcaactgtgcagattctgtatagcttcctcctcattagtgttctgtcctgcaaatgccatctacctcatcatcctcaaaatctgatgtttatcttttcagcagtgaaacccttgaattaggtttgtgatttttcttcctcaataatgtgtcagaaagtgcccccagacaaaaggtggataatcatatggctcacctcatttgtttctgttgtaacaggtaccatcgtcatgcacttcctcttgtccagtatctaatgagagttcttttatatatttgctcagttttcatcttctgttttagatatgcccatcaaatgtttagggcagttgggtaagttcagtcctgttgacttttcactcatatattctggttcttaactagtagttaactaaaaaatataaaaaatttgaaatttaaaatactaaaaaatctgaaatttatcgtattatattgtgaggtaaaaatctaatttttcttcaacctggttggaaggccgttttcacatttttctcaatgtatatacttctgaaaatatccttgtgtagaagatggcttctatatttttatgtatgtatgtatgtatttatgtatgtatttttgagacggagtcttgccctgtcacctgggctggagtgcagtggtgcagtctcggcttactgcaagctccacctcccgggttcaaccaattcttgtgcctcagcctcctgagtagctgggattacagcgcccgccaccatgcccagctatttttgtgtgcttttggtagggacggggtttcgctgtgttgccagggctggtttcgaattcttgagctcaggcaatctgccagtctcggcctcccaaagtgctaggattacaggcgtgagccactgtacccagcgtatatttttattttttaaggaaatttctaggagagcaactaccgaactttaaaaattatcttgctatctattgccagattgttttgcaaagactgtctgtttacatactagccaccagtgtataaagatgcttatctcacctcactttcactgacaatactaatttttcataaatttaaaattgcccttttttaagttttgtctctgttacattgattattacaaggtggcctatgttcatatacattaataatttgtagccctctcaggttaattgtacctttacccaattttttgtgttttagtcttttaatttttttttatattaagaatatgagctttgtcacatgttataaatactccattttatttctatctttgctactttatatggctaaatctactggattttcccttcattattccatttcttttttatttttttcaacttttattttaaattcaagaaggtacttgtgcaggtttgttacctgggtatatggccatgatgctgaggtttggcatacaaatgatcccatgatcaggtactgagcatggtacccaacagttaatttttccaccctttttaacccctcccctcctctagtagtttccagtttctatagttaccatatttatgtccatgagtaccaattgattagctcctacttataagcaagagcaagcagtatttggttttctgttcctgtgttaattcactccggataatggcctccagctgcatccatgttgctgcaaaggaccggattttgttctttttacgactgcatagtattccatggcatatatatatatacaccacattttcttaatccggtctatccatgtctttgctgttgtgaatagttctgcaatgaacatgcaagtgcctgtgtctactttatagaacaatttgttttcttttgggtacacactcagtaatgtgattgctgggtcaaatggtagctttattttaagttctttgaaaaatctcagaattggtttccatagtggctgaattaatgtacattcccaccaacagtgttacaagcatccccttttctctgcagccttgtcaacatgttattgtactattagaccgattattgtttgacattttaatggcagccattctgactggtatgagatgatatctcattgtggttttgatttacatttccctgaagattagtgatgtgcagcatttttcatatttggtggctgcttgtatgtcttcttttgagaaatgtctgttcatgtcatttgctcattttttattgggttacttgtgtttagcttgttcaattgtttaactttcttatacactttggatattagacctttgtcagatagtttatgaatattttatcccattctgtaggtttaccctgttgatagtttcttttgctgtacagattctctttagtgtaattaggtctcacttgtcgatttttggttttgttcaattgctatcgaggacttagtcatataattttttccagtgccaatgtcaagaatggtgtttcttagattttcttctaggattcttatagtttgaggttttacgtttaaatctttaaccaatattgagttaatttttgtatatggtaaaagataggggtccagtttcattcctctgcgtatggctcaccagctgtcgaagcaccatatattgaataaggagtcctttccccattgcttatttttgtcagccttgccaaagattagattattgtaggtggctggctttatttctgggctctctattatgttccattggcctttgtgtctgtttttttacagtaccatgctgttttggttgctgtagctttatagtatggttcgaaggcaggtaatttgatacctctagctttcttctttttgattaggattgctttggctattctggctcttttttggtttcttgttaattttgtagttttttttttccagttctgtgaaaaatgatgttggtagtttggtaggtatagccttgaatctgtagattgctttgggcagggaaatatggctattttactgatattgattcttccagtccctgagcatggaacgttttttcatttgtttgtgtcatgtatgatttcttttaacggtgtcttgtagttctccttgtaatgatcttttaccttcttggttagatgtattcctggatttttttgtgtgtgtggctattgtaaatgatttggctctcagcttggatgttatcagtatatagaaatgctactgatttttgtacattgattttctctcctgaaaccttgcaaaaatcatttatcagttctaatagccttttggtggagcccttagggtttcctgagtatcgaatcattatcagtaaagagagatagttatactttttctttgcctattaggatgcctttttatttctttcttttacctgattttctctggctagcactctccactaatatattgactaggagtggtgagagggggcatccatatcttgttccagttctcaaggggaatgcttccagtttttgcctgttcagtatgatgttggctgtgggtttgtcatagatggtgcttattattttcaggtatgttcctttgatgcctagtttgttgagggtttttatcataaagtgatgttggatttcattgaaagctaatttggtttatgtggtgaatcacatttattgatttgtatatgttgaaccacccttgcatcccaggaatgatgcctacttgatcatggtgaattaactttttgatgtgtttttcaattcagtttgctagtattttgttgaggatttttgcacctgtgttcatcagggatatagtcctgtgattttctttcttcattgtgtctttgccaggttttggtatcaggatgttactggctttgtaaaatcatttttttggaatagtttcagtagaatttataccacctcttccttgtaccttacatagaattcaactgtgaatccgtcttgtttgggacttttttggttggtaggttttttttattactgactcagttttggaactcgatattagtctgtacagtgtgtcaatttgttcctcattcagtcttggtaaattgtgtgtttccaggaatttatccatttcctctagattttcttgtttgtatgtatagacacatagcctctgaggacctttcgtattcctgtgggataagttgtaatgtaatctttgtcatttctaattgtggttatttatatcttctctcttttcctttgttaatctcactagcagtctagcaatcttctttatcctttcaaagaaccaacttttggcttcatcatttcattatgtggatttttaggtcttaatttcgttccattctgctctgattttagttatttttttttcttctgctagcttatgggttagtttgttcttgttttcctggttcctctagatgtgatgttagagtattaatttgagatctttctaatgttttgaggtaggcatttagtgctttcaactttcctcttaacactgcttttgctgcgtccctggaattttggtgtgttgtgtacctattttcatttatttcaaatactatttttatttctgccttgattttgttgtttacccagaagacattcaggagcaagttgtttaattttcatgtaactgtatggttttgagataccttcttggtattgatttctgtttttattccactgtggtccaagattatggttagtatgatttcagggtttttttgtttgtttttctttttctttttcttttttttttcttttttttttttttttgagacttactttaaggacgagcatgtggtcagtcttggagtattgttccatgtgcacctgagaagaatgtatgttctgtggctgatgggtagagtattctgtagatgtttttcaggttcagttggtcaagtgttgagtttaagtccagaatgtgtgacttttctgcctgaatgatctcactcatgctagtagggtgttgaagtcccccactattattgtgttgctgtctatgtctttttgtagatctagtagtacttgttttatgactctgggttctccaatattgggtgcatacatatatgtgagatatatatatggaagatatatgtgtgtgtgtgtgtgtgtatatatatatatatatatatatatacacacacatatacatggaagagagagatatatatatggaatatatatacatactggaagagagagagagatatatatatatatggaagatatatatgtgatagttaagtcttcttgttgaattgagccctttatcattatgtaatactcttctttgtcttttttttttttaactgctgttagtttgaagtctgttttatcagatgaaagaatagtgattcctgctcttttttgttttccattagtgtggtagctctttctccaaacctttactttgagcctataggtgtcattatatataagatgggtctcttgaagacaagccagatggatgagtcttgtttttttatccaacatgccactctgtgccttttaagtgaggtgtttagaccatttacattcaaagctaatactgttatgtgatgttttgatcctatcatgaagttattagctggttgccttacactttctagtgtgtgtttttgctttatagggtctgtgggctatgtacttacatgcatttttgtggtagcatttatttttctttcatttccatatttagaattcccttaaggatctctcataaggctggtctagttgtaacaaattcctttgtgcttgtttgtctggaaaagattttacttcttattcacttatgaagcttggtttggcaggttatgaaattcttggttggaatttcttttttttttttttttttttttttgagaaagctaaaaataggtccccagtctctcctggctggtaaggtttctgctgagaagttgacggttggcctgatgacattccctctgatctgccctttttctctagctgcctttaagatttttttttctttagtgttgaccttggacagtctggtgataatatccttagtgatgtttattttgcatagtatctcacagttgtactctggatttcttgtatctggatatctgtctccctaacaagattaccaaagttttcttgagttatttcctcaaatatattttccacattgttaactttttcttcttctctctcaggaataccagtaatttgtaggttttatcactttctgtaattccatatttcttgaagactttattcattttttaaaattattttttctttatttttgtctgactggattagtttaaaatactggtcttcaggctctgcaagtctttcttctgcttgggccggtctattgttaaagctttcagttgtattttgaaattccttatgtgaattttttcaattccagaaagtctgattgatttctcttaaagatgcttatttcttccttcatttcctggattactttagaagtttttttttgttgattttcaactttgtcttggatctcattgggcttactgcaatccctactttgaattctttatctgtcatttctgagtttccattttggttagggaccatttctgtagagctagtgtgatcctttggtggtatcactacattcagatttttcatagtgctggaattcttacgctgcttttttcttatctggagaccctaacacttgtaacttctgtaattattttcatgcaggtaggattttttctttctttttctttccctataatgttattatatatttttttctcctttcccttttcttcccctcccttcagaatgtgactatagagaattctgggtagggtctttgactttgtttctttagtcctctgtgctgcttttggccaattttattttgggctgtggcatttgacctgcaagcctgtagatggcacttagaggtaagagctaactgcagccaacatggcttagtgtataccttgatacttgtttactggcagaagctctttgttgccacaggctatggccaattcatggaatgtaccatggtctgagctcactgcccagccccagggtcagggggttggcagagggcaggaatggcagggccagacctgacaggtccacctacaggtcccctgatgacagacacaggcactagtgccgagggagaatgcagtgggtggccaccaagggcccagagatgtgcctagtagtgtagctgggaaacctcctcagccccaagttctctgcacagggataggggatggtctaaacttctagtccaggagagtaggtgctcaagatgcctagagcatggagcagagaccccctgcactaagatctctgcataggaggggtggggtgactcaaactccagaagcaggcaaggaggtgctctgaatgcctagggatcttcctgggtatggagcagagagagctctgcttcaccataacgttatgtccaggaggagtgcggtggctcaggctactcaactaggcaaatggttactctggatgccagagatgtgcttggagatggagcagcaagggccctactgcaccacaatctcaggagaacagagtgggttacccggcaatggcacatgcgaatctgttccaggttgccaagctgaacgtgactgcaagttttgcagcccaggagaaactgcagctgtagcggctctcctgctgccccaggcttgaaagtggggaaagcacaattctagccctgttgttggggtactttccacagttttgactgtgaagcccctatcccattccagagcaggtgttttgatctctggtccaagactgacatgcctgtgcagccacactgctgggtcaccaaggaatggctgagtttttatgtgcccaaatttaaaacattgtcctgctctttttcccgggtctggaaaaatgccttcagctttttccgtcacagtgactccaggccactccccaagttagctccaggactgggagaaacaaagtgctctcccttggcctaggttgcttggatccccagtggaagggtgagtcacagagggaggctccttgcctctctcatgcactggggcttcacttaacttttatcagctggatgccgtcagtggggctgtttgctggccttctcctctctgggatctggagtgtacgtcatgattccagtagattcctgttttccttcttgaattaaagctcacagagtttatctttatctgctatcttgctatgtccaagtggctgaggcgtgcagaaagcctctaacccaccctcttggggaaaagcaaaaagtctatttcttccatttcttttatgcttagaaaattcttcttcatcttgagactagataaccacttacacatattttctagttttttaattttatattggactaatacatataaattttattttgttatgaggtgaaaattaaattttatgtttcttcagagttaattattgttgcactatttgtcattttcctgtatactttatcatatattgtcatgttcaagtattctgtattaaatttttataacctaaaataacctgttccttgcttcattatttctttggtgtttcatttgtgtacctattccatatgaattgtagttatataagtcaatttctttagacaaacctttttcttgaaggcactatttaatatgttgcacagaaaccttctggttcaataataccttggctcacctcatccatttttttaaaggaatggtgtattatttctaccttcacattctcttttcagcccacctaaatatgacaacttacctttgaaaagtaacagatgacctaattcctaagtacagcaaatgttcctgtctttctgaaactttattttcccttcacttcttgtagtcttgcttcctttttttatatctcttagtattccatctgaatgtcctgttctgcttttttctgtcctatgtatagtagtaccctaagattctgccttcacttatcttttcagtttttactgaattcctagactattctttgctttctcagtcttaacaatatcctttctatgaatgattcccatatctaccttcatgaacttgcaaagctgtgttatcaaatgcctatttagatatcagcatgtcaaaataaaacccattgctcctctgtccccattcccattcttttcctttatatcagcatctactcagtcagccatagagaaacctcaacatcgttgatttctcccttgacccaagtggtaaaagctagttccctctggaatattgattctctttatatgtctgttactactaccttagctgatgtccctcagaagctctctgcaagctcaaatataacttctgatatttccaaacatgcttattctttgaatgtcttttctgctttataataattaccgtaactttagtagaaaagtttatgtatctggctcttgtaaccagatagtgatgtccttgcagattggtacggttttctctcattgtgtctgcagcttttcataacagtggtgatcagtaacttttttgttgtactttaaaaattgtttagcagtctgtagtctcaggcatttttagttgattctctcattgctacccgaattgcctttttaacattatgctaattattttattttatttttaagttccagggtacatgtgcaggatgtgcaggtttgttacataggtaaatgtgtgccatggtggtttgctgcacctatcaacccatcacttaagtattaagctcagcatgcattagccatttttcctgatgatctccctcccttggctctgccccacaagccctaatgtgtggtggtgttctccctgtgcccatgtattctcattgttcagctcccacttatgagtgagaacaagcggtgtttggttttctgttcctgcgttagtttgcttaggataatggcttccagctccattcatgtccctgcagaggacatgagctcattcctttttatggccgcatagtatttcttgggttatatgtaccacattttctttatccatctatcattgatgggcacttgggttgattccatgactttgctattgtgatagtgctgcagtgaacatatgcatgcacgtatctttgtagtagaatgatttgtattcctttgggtatatacccagtaatgaaattgctgggtcaaagggtatttctggttctgtgtcttacagcaattgccacacttgtcttccacagtggctgaactcatttacattcccaccagcattgtaaaagtgttcccatctctctgtagccccactagcatctattgtttcatgattttttaataatcactattctgactagtgtgagatgctatttcattgtggttttgatttgcatcctctaatgatcagtggtgttgagctttttttcatgtgtttgttggtcacataaatgtcttcttttgagaagtgtctgctcatgtcctttgcccacttttgaatggggatttttttttcttgtaaatttgtttaagttccttgtagactctggatattagacctttgtcagatggctaggttgcaaaaattttctcccattctgtaggttgtctgttcactctgatggtagtttcttttgctgtgcagaagctctttaattagatcccacttgtcaattattgcttttgttgtaattgcttttgatgttgtcatcatgaaacattgcccgtacctatgtcctgaatggtattgcctagattttattctaggttttttatagtttggggttttacatttgtctttaatcaatcttgagttaatttttgtataaggtataaggaaggggtccagtttcagttttctttatatggctagctagttctcccaacaccatttattaaatagggagtgctggccagatgcagtggctcatgcctgtaatcccagcgctttgagaggctgaagtgggcagatcacttgaggtcaggagtttgagaccagcctggccaacatggtgaaaccccatctctactaaaaatataaaaattagcccagtgtggtagcacatgcctgtaatctcagctactcaggaggctgaggcaggagaattgcttgaacttgtgaggtagaggtttctgtgagccaagatcatgccactgcactccagcctgggtgacagagtgagactctgtctcaatcattcaatcaagcaatcaatcaataggatgtccttccctattgcttgtttttgtcaggtttgttaaaaatcaaatagttgtagatatttggtcttatttctgagttctctattctgttccattggtttatgtgtctgtttttgttaccagtaccatgctgttttggttactatagccttgtaatatagtttgaagtcaggtagtgtgatggctccagctttgttctttttgcttaggattgtcttggctctgtgggttcttttttggtcccatgtgaattttaaaatagtttttttctaattctgtgaagaatttccatggtagtttattgtgaatagcattgaatctataaattactttggccagtatggccattttcccaatattgattcttcatattcattagcctggaatgttttcccatttgtctgtgttctctcttatttccttgagccgtagtttgtagttttccttgaagaggtccttcacttcccttgttagctgtatttctaggtattttattctctttgtggcagttgtgaatgagagttcataaatgatttggttctctgttgttgttgtataggaatgcttatgacttttgcacattgattttctatcctgagcctttgctgaatttgcttatcaacttaagcttttggactgagaggatgggattttctagatacaggatcatgtcatctgcaaacaaagacaattttacttcctctcttcctatttgaatgctctttatttttttctcttgcctgattgccctggccagcatttccaatactatgttgagtaggagtggtgagagagggcatccttgtcttgtgctggttttcaaggagaatgcttctggattttgcccattcagtgtgatatttgctgtgggtttgtcataaatagctcttattattttgatgtatgttccttcaatatctagtttactgagaatttttaacatgaagcgatgttgaatttttttgaaggccttttctgtgtctattgagataatcacgtggtttttgtgtttagttctgtttatattatgaattacattcattgatttgcatatgtggatccaaattatgctaatttttaagctaaaattctttcatacttattatctacagaaaaaaaattcatgctcttgtcatgttagtaaagatcctaaccaatctgatctcatcttttttttccagaagtcctattatttctctgattatatattattttttggctacatgtgttccctacatgtgttttcttgccattgctatttttcctctttagtattaatgctttctaaatttttattaatcacctactatgtgcaggtactgtcctaggctgtgttggaaatacaaatggataaaacttgagtagcacttttttggagatttttcccttaaattttccattatgaaaaacctattcttcaaaacttaggtaaagctttttcttatctatcaagtctccttacatgatgccagcacagattaatccctctttgccttcaaagtacttttaatatctgagttataaaatgttatcacaaccctctttttttaaaaatcaatacctgtgtcctcttcattcatattgcttaatggcaggaattgtcttttgtttaaaccactttattgagttatgattgatatacaaaatgctgtatatatttaatcggaacaacttgatgggtttggagttaagtgtatactcatgagaatgttaccgcactcaatgcttggaatcataagagattctgtcttatcactgtattccctctttctcttctccagtgcccagcagtgactttaaaataattgatactcactaaatgaatgctgaattgaaaagttggttcagagccaaagtagaaactgagaaggattagccagagagttaggaggcaaatcaggagagagtcatattaccaaagcccagaaatgtgtttcaagaaagagggcagtaggtgatgtcctaagcttcagatttggaagaagcagtgcagactgtaaatagattattggatttggcgattaagaggttgttggttatcttaacaagttccataaagtagtaagggtacacatcagatagcagactgagaagtaaattcttacccttaaatataatttttagctgatatatttatagaaattggctggcagacacattgaagatacatagtctaaataaagatctagaatcttgcatatattatatcgatttagggaggatccatattttttgtaaagttaaatgagtgggtaagtaggcttgacattcttttaagaaaatttagaaacctaatcactattttcatctcattagaagactactgcaactccacatagagatcacacgatcttttcatcaaagttagtgatattttgcatggcagaaattattttaacctggaaaacatggctccttctactttctatccttgttaggctggtaatacattgataatatatatctaactatatgaaatgaatgaattttttaaaatatccctgagtaattgtataaatgacttgatttttcacatactgtatttgattatttggaagacatacttaacatttctgtaatcagaatgccttttagaatagatcatgtgttatagttttaactgacaaccttttttaccttggtgttttataaaatgatgatgcagtcccaattcgtagcatatgagatttgataaaatacagtaatatagtaggaagcattaaagtttagagactgcaaaatattttagttttaatataattattgttgtgctacactttttggggctataggtgatattttctctctctctctgtttactatgccaatgggtcatgcataaagcttatcttataatatgctgttaagtgaaggtgggggtgggaatggggaagaatgaatttatagggaacctgttttatgttacttgaaataatgactttggtgtatgcagaacaaatcttagttaaccataattttcaccaattttgtagaaacattatgagtcaatgatccatgtaagggaaaaatttctgatcttgcagtcaagggtacattggctgattggttcatttttttcacagacatgtattgtgtatctattaataaccatgatacctggcaatatactcagcactgtaaacaatctttcattgttctgagcatgtttcaacaacaaagattaatagtcaattcacagtgcctgaaacctgctctttcttcatgtatgttgtccaattgagataatatttgtagtttctttaatgaagaagtggcctattggagagccgtgtacttggtcacagtaagcacccagtgaatgtttgttgactatcgaatggtatatgttttaagaggttgactaggaaatggatgggcttatagttttagtgataatatgagaaaggactggcattgtagctaattattattgaaaatagaatatacattgagaactgcaataggaataatggatgtttctcagttcattttgggcattactaaaataaattaaaaacataaaaccttaaagtttctcaccatagaaaatgtcaaattattttctattttcaataataatttgactttgaaaatatttttagagatatcatgattaatcaaaaattgtagaatataacaagttcgcgtaaatcagtttcagcaaattgacagtcttgtctttgaaatcaaataattaagtgaaaatatatctgtgcttgtgttcatttattttagtaatatctcaatacctaatccttgaagagtgaagcaacagtatagtgagggggaaactgcaatctgatgatgcatacctttttcctctggtaactgaaggttaaatgggtagcaagcagaatgccttaaacaagattggtatattgattaaaacgctgatttaacagctcgcagtttccccttggaaacctggaaaagataagccagctgctgtctaagagtgctcagtgtccactgagagtacactatctatcatcacaatatggtgatgagaggtgttttatgtttgtgttaatttcccccactaaatcagtaattattacaatcctgtccctgctgtttaccctgcagctgtttttccatttgtcgagagagcgggtgttctctgaggaccgcacacgtttctatggtgcagaaattgtctctgccttggactatctacattccggaaagattgtgtaccgtgatctcaaggtaaaaaaaaaaaaaaagtaatcaaaatttgtttttgcagagactatagggacaaacataaagtaattacaaagttatacagttttgagaaaagcagatttagttgggaaaaaagcactatgtttaaaaatttagttcactacatttgaaggaaattttattcactaacatgtatgtagttgatttatgtgtgagtttttgatttgcaaagcaatttctgcccgactgcttggatcaaataaaaatgttaaacgtgattaagtcaaataaattcacaagttacacttaaaacaagttttattatgtttacagaaatgttttatgaagaaacatagtaagactattggaaggaacatattcattttgattttagcattaactttgggtggttttaaatacctgaagcattttaatataataaccatttattaatgtgcctcgtgttttatttatgaaagcactctattttttctgttggtaatagtgttttgactgctgtaagttccattatgatgagacccttagggtagctcaggattggcaaactttctataaagggcagataaaataatttaggctttgctgttcgtgtatagtctcttttgtaaactactcaactccatcattgtagggtaaaagcagcctcagatagtatgtaaatgaatatgtttggctatgttccagtaaacaaaataggcgatgggctcaatttagtccacaggttgtcatttgttgatccctggagtaactcatacaaggtaatagtaattctcatgacagtgttatgaattaggttggcgacattaaaggaatttgtaccacgacacattttgaataaattctagatgttagtctttcttttgtaagaagcaaattgtgtataaaatttgacacagaattgccttattgatcaaatactatttcatgtaacgtaatgattggtagaaacagaagttacatgaggcttttatgaaattctgttttgtttgaaatgaggtatatagaagctataagatgttgtatgtaggaagaactgaactatgtacctataaaacatctagatcagagatgaccaactgtctaagtgccaaaatgggctaaagattaatacaaattaatagtttgattgtatttagcctgaatctttttataactaggaatgtggcagaattcagcattcatgtatctgcatggccagataatcctatactgtctaaatgtcttaaatatcaatttctttaaaggaattagttatgtggcatgacaaaatgtgttaactttccaaatatacttagaagtagttagctctgctcttcctgagtccacttctcgtattcccactacatgttttatgaatcctatttgtaggggtgaaaaggggaaggatagaagcatggaggcttagatttaaggaaattataacaattttgaagtaataggtaacatccagaaagcttaaattcaaaagattgaattattagcctaaagactgctaaagaaaagaatgttcatttgattgcagtattgattatggtcttggtcagtatttcttctttaatcatttctcatcaaatgaatcaacatattgagggtatgtgtgtgtgtgttttcagatggagtctcgctctgtcgccaggctggagtgcagtggtgccatcttggctcactgcaacctccaactccctggttctggcgattctcctgcctcagcctcctgagtagctgggattacaggcatgtgccaccacgcccagctaatttttgtatttttagtagagacagggtttcacggagttggccaggatagtctcgatctcctgacctcgtgaccgcctgcctcgaccttccaaaatgctgggattacaggcatgagccaccatgcccagccaacatattggtatattgaagctcattaaatgagttccactgccccattctttctgatgatggaattagactaaatttgtcaaactgcaatataaagtacctactttatatatgaatatcagtcaattagttaccacgtgcacagttcaccaagtttactagacaattaagtggtctctgctccctgagtttatttcttaaaaaatatagccttaacttaaagacctaagtatatagttagcataggacagaaactgtaaaggtacacctagaaaaatccatgtaacataagaaatcaaacatccaaaacttacacacatgttatttgtatccacagtaacaggattatttataatacaatgacatattttaggtaagatcacagaaattttgagctggtctttaatttataggtgatctccttcaaacctagaagcctagtaaatgacttactaaaagtaatgacctaagttgatagcagtcagggtttttggaactcatgaatcctagctccttattgaatgttcttgtcactatatcattctgacttctagagttgaaatgaaattatagaggggggatgcattggattaactttgggaaatctttgtaagcctaaacttcaaattaaactgcagaaggtaagagaatgagtgtttcaaatatatttataccagatgtattaaagaacattatcatgaactgatttaggtacccactttgatcagtctcagatttgtctctgttctcattactaataaccttgactttgttcaaatgcaaatccaattgctatgcctacagtagcagcacttctcaagtaaatccatacccgtttgccgctgtctcattcacattggaggcagagccttcttttatgtgcaggttaacttaagatatttttatcagttcctgtttcctaataaattagtgtttatagcaacagaaaaattgttgaagcctttgttgtactttagaaagtaagttcatttaatttgtcaatacacatcatgtaatgaagttttatttttattaaggacccaaattccttgtgattacttaaggaaaactgctgttgcttcatgattgcccaaaatttcgaagaaatctcttcaaagacttcttcagtagtccaaattatatgttaaaatcttcttttctgcttagctcttattttacaaatacaaccaatgaccatggccatctaagcacagcgtaggctgaacagggacatttgcaaaggtgaatataactatattggaaatcattaagaattaatttcttgctagtttatgggagaaaataatacataagttgttgctatttcctatttgtagaacacctaatcttgttttccacctaatgtgagaatagttaaccatttacagtattaatatgagaaagcaccaaataaatttaggtactttctaacactcagtaatggcacgaaggggtggcttcagagagttttatcatagccctcctcgtcctcatcagctccctaatgttcacttcaaataaatgcagtttgggtggggaaagcatgcttgctttgcttgctgagcttcaagacactttccccagctcccacttctaactagatggtcactggatttccccctatatagaaatcttaagccactgctcttcattccttccacttctaaaataaaattgtactggtattggactatgtaccttattcgtaataaatttgtaaatagcctggcaacctatttggggtctgtttacatgatgagtccttttctggattcagaggttgaagtgaagaaacgtttttcttttggaatttcagcattccatggtcattcagtttctgcaggttagcttgtgacattttggcactggatgcccgtaaacttaaacttgcaatgtgcagagtaggaattccttactaccttcttgggcctgagtgagtcttggtgcctaaaactgagtttgatgtatgtgggctaaaatgtggtgtaagagtgagtaacaggaattgtttatttctattgctgcagtagtcatcggagcccttaggaactgctattttcattcctttgtttaatcacaatgtcagtcgtttaattaaaatgataccatatatatggtgtttttaaactttcaaatatttagtctggcctacattcaagcctagcttctcagactgggtgctacaaacaggttacaaccatgcctcggcctgcaaagtgttcagagaagcttccaggccagtgagttctggcttcaagcatcttgtccagttaacctggtatgccccacaactttaaattgttattttactgtgaaatgtaaaaggttgggaagcattgtattaaagacagctaggatttttaaagtttaattttatgctagccatcagcaagaacaggaggaaacatagtaatttttgttacaattttgtgcccactaagcacaggaaaaaagatttaaaaatctaccatttcttcatatacacactgaatcaagaccctctgtcaagtaatgcctgtccacttcaactgggcaaaaaatgttacccttttttttggtggaaattctatgatgtattatgtctagtgtttttttttttctctctcctcaaaagcatgaccttttagataacaaccctctgatagaaatagtaagcattacttagatttttaatatacaatcttgtttcttatgacttcatatttgacttcatcactacttttgttagtggatgcatccattaagcataagcatgctgccctactctccatcttggaaactgagattggctgtgaatattaaacagatgcatgtaaagtttcataaatttagagtacctaagcagtcagtgacaatatgcattacatattgtctggctaacaaagggaagaaggaaagtgatctagaagagaagactaaagaaagatcatttgtaaatatttttcttcctcctttacgcagtagaaagattcctaaaaatgtatgactactgtaaataatgtaaatactacttacattatgttagtgttaaatgaaccaagacagtgatttccagatgttactgatatatctaggccattgatatgctttggaaagacttacaggtgtttctgtgcattctgcaggtttacgaatcaccctactaatggtccttgtattttacagaaactctgttaatgcatcctgagtaaaattatcatgtattgtataacagaactgtacattttattatctcctgatttatctttatacaagattagatttggggatattattttttaagctaatattttggtggacaagttttagtcattcatgctcagcaaaacaacgttttaggatggtgagagaagacaaagtaattgatagaagaatgtggacactacttcaaaataactgggaaattatgaggctgggcacagtagctcaaacttgtaatcccagcactttgggaggcagaggtgggaggactgtttgaactcaggagttcgggaccagcctgggcaacatggcaaaataccatctcttaaaaaaaaaaaaaaaaaaaaaaaggaagaaacaaacaaaaactagcagggcgtggtagtggtgtgcgcctgtgtacttaggaggctgaggtgggaggatcagttgagcctgggaggttgaggctgcagtgagctgtgattgtgccactgtactccagcctaggcaacagagcgagaccctgtctcaaaaataagaaaattataaaatatttgtgttttgtttttttgagacaggatttcactctgtcacccaggctggagtgcagtggcaccatctctgcatattacaacctccccacacacctcgggctcaagtaactctcccgcttcagcctccagagtagctggcaccacaagcgcataccaccacgcacagctaatcttttgtattattggtagagacagggtttcaccatgttgcccaggctggtcttgaactcctgagctcaagcgatctgcctgcctcagcctctcaaattgttgggattacaggcatgagccactgtgcctagcctgtgttttgttacttaaaataaattattgcatattgaaaagtatttttaatgcagtcattgagccaacagaaatgttttatggggttccactcttgaactttgttcttttctttaaaatacagtgttttttagaagagcccacatcatgacaatttacaaataagccattaaactcttcatgttttaagaaaagatgagttcatttattcaattcttatggtatgttaagtttgcatttagcatctcatttctcaaaactgtcacattggattgttactgttatttacttttgttttatagatgaaattgaagcacgtagaaattaataatatgcccaaggtcacacagtgaataagggataaagctcaaattttaatatgaaccctctgacttgaacccatagtcttatccattttgctctctactgcctcccaggcagtatgctaccagtccccatggccatgacccttaccccatctctctcagtcatcccttaggcttatcttatttcttactatatcattgtaatttttttaaaagctaatttataaaacaagtagggtaaccagctgtcttggtttgcccaggactgcccagttgtagcactacacgtcctgcattctttgaaacccctcagttctgggcaaactgggagttggtcaccctcagcctattccttacccaaacctatccttgcatctcatttcattcttcttctcacaaccatgatctgaggctcagagatgagatacgaggttacagaattagatgcaagtcagaattttacacacacgtacacacacacggagctaggtattaaaaagcagtgtttatacattttggtttttctgtatccagccacttcaaaaatagctttgtcaaaacgtggagaaatagtgcatcctgtctgtcatgtttccatgaagactttcccatgcatacaaagcatgtgaggagtattggcacattacacaccaaactagatgggaatggaatggtgtaaaaagtacattcacattttgttcaatattttgtattatttggaacttttataagaattgttaatgtattatattagtaaaagagtattcactaaagatcttcagcattttatatatttataaagcatatttttaaaaattaataaaagggcatatacatttttattcagtaaaacaacagaagctttagtatatacttaacgtttctcattatggcaaagtgggagggaggaagaagagaggttgtttgaaagaggtggaaaaaagagagaaaccagaggctgagaagagacagaccaaggcagaaagagaaaataggacagttgaagactcttgatgtttctgattggtttcaatatacaagacttattgtcatttgtgcagattgggtttggtttctaggttctggctggtagagaaacaggaatatacaagataactgagtttggataaaataaaaaattttaatttggtggggcatggtggctcatgcctgtaatcccagaactttgagaggctgaggtgggtggattgcttgaacccagcaggtcaagaccaacttgggcagcaaagtgagaccttgtcactataaaaaaattaagaaattagccaggcatggtggcacgtgcccgtgttcccagccattcaggaggctgaggtggcttgagctgctgaggcagaggttgtggtgagctgtgattgcaccactgcactccagtttgggtggcagagtgagactctgtctcaaaacagaaatttttttttaaaggttcagcagtatattttatgtgttcattcagctttctgtagaaaaaaattgaagccagacttacctctgtgagacatgctatacatgaaatgtatatcaagcatttggtttagttagatggcacattgaagtactataaaaaaggacttttgtctgttctgaactttgcttcagtgaacacaacttgcctaactgtatttagtgtctggtttataagacatttgacaatatggcagagagtataataacatattttatatgactgatatgtttatgttctaaagtggagatctgttttaaatttgatattaacttcagagtccaggtacattctttcaaatgtcatcacattaaggagtagaataagaatctactcctcaaataaaagttaactatcatttatcctgttaatatacttttcacattttgtatattttttcagtatgacagaagaaatacctttaggttgtgtctacatgactaggcaaagttttatgggccctgaatacataaggctgtatgatcataactcagaactcatctgtatctttgtttgatgataatcataatcttaggttcaaattagctcgaggggaactggctggttacattgttatttctaattgtgttggctttgcacaaattcctcctctcttacatttcataattttccgcttgaggcacatgatcctgttacttggttaaatctttaagattttctttggtgttttgaattaatgggttcaaagagggtccaactttataacatttatgctatatatttttattaactgttgaatgtttgactttgatattctttttctttttatatttaaaagggttggtatttctttattacaaagaactgcaaaagaggatatcgccttaccttacaaaataagatttaggtttgatttacaagcaccaccaaaaaacatttctgtaagtgaatattttataatagcaatagattcccaggagaaattgttgaaaccatctgtatatatctagaagaagatgctcatctctttgggattgtttagatcacattttcttttttaaaaaaagaggattgatgtttgctttgaaaagttgattaggctttaatttcagaacttacaaaataatggctcttaaagctatatcacttattcccatcggtttaaaaatagataattttatcatcgtgaagtatttgataaaacatgtttctttttacacgtgaagcaacagagtttgtaagtactgagcgttctattagctacaactatgtcctgtttccaaaataccttactcagcattcagtagttttttaaaatggtattttcatgttgttgaagactatagaacaaattatgtcatttttcttaatacacagttggagaatctaatgctggacaaagatggccacataaaaattacagattttggactttgcaaagaagggatcacagatgcagccaccatgaagacattctgtggcactccagaatatctggcaccagaggtaggcttcggttccattaataggaaagtaacattgacataatgatttgcaaagtaaaccatttaagcattaaaagttaactgtagtatctactacttttatctatatttcaacctgaatcaaaattttttggctcttaatttgttataatggggtattgtaggatcaagaatatactgaaattaaattttataaactataagcacaaaggtactagctatagtcagttaaatcaatttttatttcttggccatatccattttatcttggctatacccattttgattcatttattaaaatagaataattgatttcagcaagagtatttatatttataaaccatcttggactttccttagaaacaacagtggtttttaatttatagtattgtgggtttatttaaaattattttattgggaaaattattgaaatgacagtagctacattttggaatttatgtcagaggaagctccaaactggtaacttccctgtgctaagggttccacaataatttattaatttgtttattcaacaaatatttattgtgtatctgctgtatatcaggtacttttctggatgatgtggttacaggcacaacacagaaaaggatcctagtctcagggaacttaactttcagtggagggagacagaataaaaataaataaataacataatgtcttaagtttcataaacaaacaaacaaaaaagcaagattaaatgtaagggtgtggtgtggctgttgtagatggtgttccagttactaatgctgtgtaacaaaccaccctaatacttagcagtggaaaacaaccattttatataaaataatggattttctgaatcaggaatgcaaatgggcacagcaaggatagctagtttattctccactatgtatgaggtctcagcttgaaagactttacagtgagagcatgattctatggctggagactagagtcatcaggaagcatcttcactcacatgtccgacagttctgctgcctgtccactggtaccttatttgggctgttggcaggaacacttacatgtagcccttctctccatgagtctggacttcctcataatgacagtttcaatgcagtcagacttctttggctctgagccctaaaagcaaatgtcctagggaacacattagaagctgcatggtgcctttgtttccacctagtaaaccatcaagactattaactttttaaaaacttgatttcacagatatttttataattggagtacaattcatatgccataaaacttactcttttaaaatacacactttggtgatttttaatatgttcacagagttgtacaactatcatcgctgtccaattccagaatattttcatcactccagcaagaaaccccatacccgttagctcctcattcttccttccgccacaggcaaccactgatctgctttttgtctttatagatttacctattgtagacagttcatacaaatggaatcatacagtatggagtcttctgtgactggcttctttcacttagcataaaattcagtgttcctccctgttttagcatgttatacttatttcattcctttttatggctggataatattccattatatggatataccacattttgtttatttgttcagcagctgatgtacattgggttgcatccattttttggctactatgaataatgctgctgctatgaacatttgtttatgcatctccttttatggcctattttcagaagtcacacaacatcatttctgtcatacccttactccctgaagcagttgtaagcctgcacaggttaaagtggtagagacagagaccacacctttacattacagaagagcatgtgagatgggagatactgccacagccatctttgaaaaataacatctttcacagatactatgttcagcgaaagtgatggttgatggaaagtgatggtacctgttgcaaaggtaaaagggaagagctttccaaagagagcagctggtgctccatttcccctcaaactccaatacagttattgtggctataggcaaatagggaggtgttaatatttgatgtgtgagggtaactatttaatgagcatctactatgtgccacctgctgtgtaagtgcattacagctattatttcatttaacatttggaataatctttgatgatagatagcaaatgcaattttttaaaggtgagggatcataagatcagaatatttaaatgttatctgtacacagctaagaggtggtagaagtgtaatgaagattctaattagtgtgtctgactataaagcccacttttactttttaaactacatacgtcctggcctcaaaaaatcctaatttgaagaccacttacaaatataaataatcgtaatttttaaatgaatgctttgtaaatgcccaacaggaaaaggtaatcaaaagaaattaggaagtaaaataaatccccaatgatactagcattccttaaacataaagtaactcatgctggtctattattctaatacttcttttcaactagggattacatttacatttcaacaatgttaagttattgtaaataagtgctactatttaaaatacaataaatttcatactattattttcttgccaaaaatataattttctctctttaaaaatttgtagtttagaattctctatttttgtggtttaattaggtaaaactttagtaacactgtttcttgtttattcaaataaaatattttctagaatagaattgtttttataaatgtcacaaaaaattatttgtttctctggagttcagttacccctgctataaatttgctatggaagaagatatgccatatttagaataacaaaattaattgtgtcacaattagggtaaattatttctgaagaagatgaatacatctcatttaagaagcagatgatctgagaaacaaatatattatttcatatgcagtgtcatcaactgaagaacaaattaagaatctaatgcaagaagagtccacttgtttctgaatggaaagtttatagttgccacaaaattatcagtttctctttaaagacaagaaaacatttctgtataccttttttaatacttcaaaagtctggtctttaaaaacagtttgtatacccatccttggtggatacacattgattcataattcaaatctggacaccatgtttttatagggaagagtgattattgttgttattatttgagtatgagaaatcttgaaacaacttacgaaattgtaacttttatattttaaatgttgtgtcacatattgcatttttaaactttgactgtgtttacccttaaaaaaataagaatttaattcctttattctggtcttcagcgtggaccattttactgagggacactcattcattcatcaaagaattatttattgaatattaagtatcaggcattacattaggtactgggaatacaacgatggtagaagatgtttttgccctcaagtggcttgctgttcactgaggtgataagacatggaaaacagttattactgtgcaagaaaataactgctttactagttccatacagtggagtggaaggaaaaggaaaagtgcttaagcctgcagggagggtccggcagtggaaaaggggaagcaggaagagaggaggctggacacatagatagggattgaaatgtaacagttttagatttgatcctgtgggctagggaaaattacttgtgaattgagagcaaggcgatactgtgatcagatttacatggtcagtgttagggagcgattggcaggagctgaagccagcctcttccttttacctcagatggtgtctcgcactttttttggaccttgaaatttctagtacattaccattattaatgctgggcttttcgtgacagtactagaagtagtagttgtgtatcagatctgtaatacattcttgactactgcttctcttgtgaatgactcactgtcaacattttcccctctgtctttacagaagatttgtttacacattatgtaggaatcttgctgcaacctatacttcatctagcaatagtgttccttcgccttttacgttgttttaatctggtataaagacaggtgaagggtattttgaagatacttcacaaagagtgttagaaatcagtttaaagccagtttattaaatgtccaatgtcagatacatggcaggttttaaaataaacttgagttttaagtgaacttaatttgtttcttatggcaaattagaaaaacataaaacttacagtataaatatgccatttgttgaaaaaagaatatttttaaggtatttgttctcttatctcttttgatgaagaatgcagcttacaatgcagttttccaacttgggaagcatttaacaatactgctaatgtagaaaaggctagctttgttttgttttgtgtttttaacaggttacagcggttcagttctagctggcatatgcactgtgcatttagtgtgctacatcttgaaaactgcatttgtatgtatagttttaaatgaatgtacttttgctcttttgtacattcgaaggaaataaacttatagtaaattatggaccatatgatatcttgaggggattttgtttttataatctgtgctgtattttcacacctagaaattataaaagaaattagaaatcacatataaactcttactgctaaattttattatttgatttggctcctattgaatccaaaccattttatgcagtgctaattatttagagtctcagctttgctcttgagttagcagtacctgatccactttccaactgtaaaacagtttgaaaatcaaatgtagcttacatgcaagacccaacaaaattaaaagtgttaagtgcgttttggcagttcacttttattatgcccagtcctcaaatgtaccagcagataatcatctgaatgttagttatttttcacatgcttatgtgatcacacaaaaagtacatgctaaaaagaggcagatggtgacagatggggaaggttgaataaggtggttttggaaacctagagaaatgcacttctgtaatagtgtaaaaataaaaattatttgataatcaagttagaactaacaaagattgcaaaaaatgacttgattgttgggaaatatatctagctgtggttgctattgagaaaaaaatgcatctaattttatttcatctaaatgtaaaatgatttgtttttccagtggctgaagtgcagtatttgatgcattctttttagttttttagaaccccattcttagaaaatgttttgcttgccaaaattttcctgattttttctttgaaacctactatctttaatatcttgcatataatgtaacatttttaaaatagctgaaatagatgagaatattttgacaactattttgatacaaagatttgctcaaagtcattgtgttagctcatagtacacatggagattaatttctatataaattaaaaaccaaagatatatattaacttccacaaaaggtagtaaaggcagtgccagggcatggactagtgttgtaggtgtgggaaatagttagaagctaacttgcttgaaatgtattaaacagaattttctttattttaaatccaacaaagaataaatgtaaaatatgtcattttgtgggtgctgccaatgttgtttttaggagatctgaagagaaatgaatgaggctaaagttacatatgtttgcacatttaatctgtaggtaaaaatagtagcacatgtagttacattctgattagtctttgcacaaagtcctactatattccagcagattgtaaaactagtcttagaatctctatgctttttgtgaaaagaaagagttgttttagtagcctttctaaaattgtggacaaccctaacattttatttacttattgataattcatatgatatctctccacctggggtaattttgaaaaccttcatcttcctgggaattcagaaaaggtctcatcaccatgattaaagggaacattaaaggagtagagggatgagttcagatagaagctgtctgctctatagttagaattcatgtttaagaacttctaactctcatatgagttggcttactatttagttgaatatatttaatttctttctatagtatgttgctattttatatgattttctgggtaatattaaaagccattccattttatctcataattggacattgtttaaatatgaactaaaatggaattaacgcctctcaatgtttataagtggcatcttttacttacttagaggtctgtcagttcttaaagtagctatttttcgccctaacttcttttcaatgttatatggtcttttggctttaacagaatatttgcattcagtacttcggtgtgattctagtttaagcatgaagtttaattttaaattctctgtaccatgagaacatatacaaaactaaccctaactggaaacactggtgattacctatagtattttacaatggctattgttacttgggttatgaaggctcagtttcttggaatcccataatgtctattgcttcagaataaaaaagaagtatagaaatttcttggaagatatgtgtaagtatgatctaatcatcattattgtatccatttagcctttctcttgtcaaaggatttttcctgtgctagccagagtttgcttttgaaagtacgatgttaactgtatacaagtatttgtgtgtgctaggagaggtggccataaagcgtacagcattctaattcatagcaaatggcattgacagttgctgtcacttaagaactattaaagcagttgagaaatagttataaaatatatatttatgaagaaaataccaagcaactgtagaatttataatcttatgtattgaaatggatacttttcctgaagctgcagtttactttaaaatctgaatgagaagatttataggtctttttttcttagcccatacctgtgatgttaagaatatctgaagggctcccataaatgataaatgatacagatgtatgtttaggtataaaacacacatctatcagttacctgaaatgtaaggctaccagaaaaaactttttttttgaattagtggtaaattggttcatccaagttcgcagtttactttcacagcataggtgtgcagacagtttgtttagatgtttaattttttcccccatctgttctgtcaggattattgattgagcagtaagccactccagggcatacatagcctccttataattgcttgccttgggtgcattgtgtggcctggtgggcaagctgagagaggggtccctttaacctcctagtaaatcctcctggtaaacaaatattgtaatgaatagttttttttttgttttgaaaaagcccattagccaaataaatatttacattagtaacttgaattggtagtatcatttaaaaatatatagtttctcattcaatatcattctttgaaattaataacaattcaaaaactaatgtgttttaactcacctggctgttttataaatgtaagtgtcttcatcaaatattgatcaaatatttccaggatatttaatgttaatttgtatctgctgtaacctccttgagtcttaggttttatcgtatcataaagtaaagcagtttctggctcctattagaaatacagccttgttttctagactttgtgctctgtttaagttttcatttgatgtgacctctcatcattttttaacaattacatttttttgatgttccaaatctcctctttcatctctgtttgggcatttgtgttaaaggtaggtataatgtacaactacatctgtggttacaaaggactgtaggggtagaggaaataccaaatgtctgctttcctatttaaagtttgggtttcatttacaagtcagtaatgttggttttatggaaaggagacagaagttatttcttcaagataaatctttcactggattttttcaggagcatattttgatctgcatttatatccaaattatatgagaaattaaccttttaatgaagttgaaatatgctctaccattgttgtacctgtccattataccactgtttatcatacctttcagccagccctcacaataaccatgaaataaattagccttttagctagaaaaaaatgatcagaggtagccagaaagaatttgcaatccttaagttaaaaaaatgtaaattttatatgttatgtatttatagaataataagtgctttgagtagagggagaaaaattgtcttcttaaaataatgtgaaagaggttattggattcgaattggttaatttggctgtgggatttccagagtatttgaaagtattgtgttttgaaataatttagattcaggaaagagaaaggatattgttttaatagtgggaacatatgtatccacatgtaggatactgtaatcattatttatgtatgtttcatcttatagctgtttggagataggatttggacaaaaatctttctaattgatagtgaagtctcttaggtaaagagggattttagttgttagggtgttttcttctcagcattgcttaagtttacatgtcaggaagacaatacgttacatcagttttgttcaatacaaagtaatacggcaaacagttctaattatagcattatgtatctgtagatcaattaaggcacgtatgttcagaggcaaaatcacttattttaagaatcgatattcattttacaaagctaaataaaatgtattttattttatcaaacagatttttttacaatgcagttttatttttcagttgcttacttctcttcaaaaataaaaccccccttttttatgtactcactttcccttctggctgcaaaccaggtatttaaaaaaaataaaggattgccagttttgccagctggggatgagaacccggctggtgaaatgtgggttcgggaggcagttaatccagcttttatgctttttatggttttatgaaaaaaaaaagaggttaaaaaccacatttggctccttttcgtatatgccactgttgtgttggtgttgtaggaatgtagttaaaggttacttagatataaatttttggttgttattagttaaaatcttgtgtcaattagataaaggcccaccaacagtgcattgtactaattggccatgagcgagatccttgaatcatcaaaagtcagtggtattttaaaataatacatgcagcatttcctttaacgtaaatatgaagtagaatttcttctgcttttttaggttattttttgttttctatttgttctcaaattactcatttcaaacaagtaaaaatatgacattctttgcgctgatgatgaaaactagaatttgttgttcttccagaaaatgtttttttgttagtttgtgatttacaaaacatttctagaaaagcataggatctaaacatgtgttcatatcttaccagtgaagttttcagttttttagccgtaaaacaaacattgatataattgaattaaaaatcttttcataatagaaatgcttattgaatagatcttttaagtaacatattttttcttataaattatatcctttgtctttaaataccctaccaaagtgcctttcatagtatttttaggtaatcataatgtaactgtcaaaaatatcacctgtaattctgtgagattattggtaaattttaaataaaagtcatgtaggagtaatcttccagaaaatatttaattcgaagcaagaaagtttggaacacaagtactgctttgtccttatcaaatgttctcctttgtaatcggttgtaagtgtttttaaattgataaattcatatatttggttttccccatctggttttccaaagctgagaggatcaaataaaataagctttaagattatcaaatatagttttaaaataaaatattcaaagttgcatatagatgaggaatattccattggatgaagaacaaatctgataaaaagataaaaccaaatttttcctggggcaaatggtaggttaccatgttaccatttgaacaggttgctccagcataggcaaacggatacttttgtatcatttctaactaaatttattttacgtgtaatatattttgggaaaaatttaaggacatataccacacagatattaagtccattttttttgctgtaacaggaatttttgttgtgaggtataaagctgtggctatcaaagtttattacagctcgtaccataagcttttatattcactttgtctcttaaatagttccagaaagagttgaaacatacaggggcatccaaaggtttttcaaagttattttaatggttgtcttgccctgtagacttctccattacattgcctttgtttactactgtctttcactgtttaatttgtattacttagttcttcttaaggcaagaatgtacagtgcactttatgtgctctataatcagcacaccctagctctgagttgttacttgaagtccacatgggtggaaccagaatgaaaaagtcagtaggcctaagaaaaaatatgtaaatatgctagctaacgtttttcatttgatccttatgtatattcatgtacttgggatttttttttttttgtacgacctgcccctttttttgtacactggccatttgtggatatatattgaatatttcacatatttgatgtgatttgtattttttgtaggatgcttcacagtttaaatgtcaagatctcagactacctaggctttgaaagttaagattcatttttatgtaaaaatcttatgttttatgaataatgctttaaaagttaacatgtaataattaatctttttactgatttcacttttaggtgttagaagataatgactatggccgagcagtagactggtggggcctaggggttgtcatgtatgaaatgatgtgtgggaggttacctttctacaaccaggaccatgagaaactttttgaattaatattaatggaagacattaaatttcctcgaacactctcttcagatgcaaaatcattgctttcagggctcttgataaaggatccaaataaacggtaagcctcaaataacgcttagtgaattactgatgaatgtggttaaaaattgagatatggaaattaattcaaatataactaactccaagaagcaatgtatttggtgtagacatcttcccactgagatcctgacttatttttaactgcataatatagaacatttaaaaatttttctcaactctttcctaacttggaaattttatgcagatttaccaaataaggattttgagagtttcattatccatattatgagtgaaaatttcttaattgctctgttacttgatcttgtggggatagaagaatcacttttctttctttcagtctctgggcctttgtatttcttataaaaggaatagacctatttttcaatactctcctcccacccgcaacctgtgttaacatatctaattgcatttttttttttttttttttttttttttgagacagagtctcactctgccacccaggctggagtgcagtggcgcgatcttgactcactgcaacctctgcttcccaggttcaggtgattttcctgcctcagcctcccgagtggctgggactacaggcacctccaccacgcctgtctaatttttgtgtttttagtagagacggggttttgccaagttggccaggctagtcttgaactcccgacctcaagtgatccgcctgcttcggcctcccaaagtgctgggattacagtcgtgagccaccgcacccggcctctaactgcttttttgtcatttgaaaataatcttttctatgcatagctgaaagagttgatggcaaaaaataattgtacacacttttaatttctgtttttgtagctacagctatgaattgaagaactctatggctcttgctgctttgttcaatgagctacagtatttttattcatgtttatacattcattcatatttataaattcataaatcatatgtgaaatgactattaatattaaaatgtttcttaatatgtgtgtttgtatatggatatatctgccttcccatctaggtatctgtgcatatcagtatttctctgagtctactcatttgaagcatagatgatttcacatattgttgaatattttataatacctcacatagagttttatgaaaatgttttacgtatggttgatgctcatatatatatatattatatatatatgagtgggttaatgagtgaatcccaaaaagttggatttttaagtctatctgagaaatggttttcattgtattcttctagcttttaaccttgtaaggaacatggctttatcttcagcagaaataagcaaacataataaaagagatattgtctttctgctttgtgaagactcattcaagaaacattttgtaatcctagctgcagatattatttatatgtgtaaagtgattttgttttcttcttcagagcactttcacagctattaattcccttgctttttcaggagccttgttgggtggataggggagatactattcttatttccatttcattgagttgaaaacaaaggcccagagagggttaggtgatttcttcaaggtctctcagaacattcatgcagaccaagagtagaagtcaagtttcttggtgcctatttggtatttcttatgtatcttatttacaatgcagcagtttctcagtttaagttttgaaatgtgttccgtttgatagcgttcttttacaattaagtaaggagcagcacccgatgataggtaactttaaacagagtggtgacttttatcttttttttttttttttttttttttttttgagagggagtctcgctctgttgtctgggctggagtgcagtggcgcaatctcggcccactgcaacctccgcctcctgggttcaagcaattcccctgcctcagcctcctgagtagctgggactacaggcgcctgccaccacacctggctttttttttttttttttttttttggtattttagtagagatggggtttcaccatgttggccaggatggtctccatctcctgacctcgtgatccacccccctcggctttccaaagtgctgggattacaggcatgagccaccgtgtccagccgacttttatctatttcattttttggtctaatatttggcttggtattcgaggcagtgaatatttatctcatcgttttcttattcctgcaggcaactttgaccaccctttactttgtggccctctttatataagtggctagtagaacaaaatgtacttgtggttttcatgtgtatgtctcattcatttttttttatttgtcagcccactccatgaatagcacatagtcggtacttaggaactattgaatgaatgtgaggcaaattcttagaatgttaaccgcctagtatgtattaatagaacaattcctaactgtttgttcaccaggaggttgatattgatctaatgagaagatgcagtattttcaatgatctaataatttcttttataatagatgtgtcaagcccctccactgctgcatcaaaatacagagaatacaaggatgagtgagatgaaccagtctctgctctagatgttcatagaataatttggggcacaaaacatatactcacagatgctcaggtcaaactacatacaaagtactgttgaaattattggctttgtctaggggattgggggacttgagctggatcagaaaggagtttgaatttgcattggcactcaagcacagaaatttacatgtagagtatagctaggattgcaaaagaacatggcatttgagaagttcagtgactagagtgtagaatatgagttgggtaacactgggaaatgaagctgatatattagattataaggatcttaggtttcttagaaaatatttaatcttcattcagaagagggtgagatactgcttaagtgtttaaagcaagggatagtataatcagatttgtgtcatgaaaaggtaactctggcagctttgtcatggacagattagatgagtgaggatccaggggcaggcagagcagttaaaagtgtttatggggccaggcacagtggctcacacctgtaatccccgcactttgggaggccgaggcaagaaggtcacttgaggtcgggagttcaagaccaacctgggcacatagcaagattcatctctactaaaaaaaaataaaatgctgggtatggtggcacatgctgtagtcccagctacttgggaggctgaggtgggagaatcgctggagcccaggaggtcgagactgcagtgacccaaggtgacaccattgcactccagcctgggcaatagagtgagtccctgtcttttttttaaaaagaatatttatggaattgttcagataatagatggattccttcctgaagcagtagtacacaagtgatagaggttatgattaactagaaactatgaggaagtaggaggagttaggaatccctctgaggtttccagctagggtgattaacagacagggtatgcaaaccaaggaggcttgatggggctagatgttgataataactttgggtacactgagtctgaagtttctatataaaaccaagatggaaatgtcaagtgagcagctggaaataatagaatgaatgcttaaaagaaacacagtaactgactacatggattgggaaccataactatatctaggaggtagctagagccaaggcagtagtggcaagggtagtggataaggagaagagggcctaggacagaatcttagggaacctcagtttcagggggagaaagaaaagaaagctaacaaggaccttgaaaagcctttggaaacataagtaatgatagcattataatacacctcttcattttttctacgcagctattttaaatactactggaatttttctggtatttcttattgaattgctgttagttctatccaagggtcaactatcattttgcttttatttcttagtctccatcctttctgttcattctgttagcccctcctttatcttcctatgcggagttgataggaaaagcatgacctcatgtattcagtaacattaggaaaatgtgaattctgtgatgttcctaatagtaaaggaatttgtagtagctgaggatttagtctggcattctgatactggagtttagtattctagacataaatatcttacttcaaagcatattttgttattatttttgaagtcttaaattgtatattagagagtcattgacactgaaatttttgacagtttcacacattgaagaagtgtgttaaagaatttctcctagcttctaaaatggaagtctgattgtattctcagactttgcatagtattcatagctgatattttagttttatatgtatttgataaatatagaataaatgctggctatgttcaaaaccaaagtattgctagaaaacttgaggagttacaaaaatggataactaaagctggattaaaacattttatttacaaaatgattatgattctccactccaactcccatctcaagtacaattcaaatgaaaacagtattgaaataaactacaacataagtgtaagaaaatgccatggagctttgatgtttctcatgcagactatgttgacgcatgcttgaaaatattaaatgcttttcagaaacgtgttttggtgcttttgcttctctggttccccaagcacaagcttagaatgccttttggataatccagcactgatcttgccttcaaaggagtttgcagtctcctgggaaagaaacctacacaactgaaatagaatgaaaaagagggcagggtctgaaatgctgagctctcactgaacacagaactaccagtctgaaaattccaaatgcaaacatcgaacagcactattatgatcaaacctaaaagtgccatctctggggtatagttcatttagagaattctataaggatctgggagttggagacccagctggtgggaattatttatcatcactaaagatattcaggtatcagttgactgttttccattttaattgtgtgtcaaaggatactaggtccttcccagtcatgtgtttcttagatctaataaccagaattcattagaattatataattataaatgatttctgacctacgatggcttgacaattttttgactttatgatggtgcgaaactgatgcgtatttagtatgctcctcaactaatgatggaattgcatccagataaaaccatcttaagttgaaatgtgggcttatctagacataacccatcattaagtttaggagcatctgtatttgttttctatgacgtatttggttttcttccaacccagtggtgttttggagttagcatataccagctctcaagaaccaactgttaaattttcaccaattttatgagctggttgtatattatagtcattactaaaaattatataaatttactaataataggaaaatcaaaggtcataaatactaaaaagtcattactccttaatttgttatgtttcactgttatctgtatttttgagattagttatgtctgctgtatctgtttggacataatatataatggtttgctactatgcatctcttcctgcctacatgttcagtgacatcttattggtagctcgaaactggccacagtggaagaatttataccgccagaattggcaaatactatgagttggggctgcacttactgttttgttgactgtttagacttaagagaaaatattaataatgcagattcattacattgtaaatagcaccaaaaaatgaatcttcttccaccatcccaaagttactaaacatttagcaaagaaatcactcacataactgacaagtgaagttctgaagtctccattgtatcactttcagctttgactttaacataaacaaaaatgtcaaccaatattcatgttggaactaatcgtaagtttcatccattagtggctttggcgtacagcagaaattaacaagttttctgtgagaatcaggtgactaatttacaatacacaacattgtatgttttatgatctttgtaaattttgtgttttgcattctttatatcagtaaaatttaaatttatatgtctggggtgtggtggtggctaggtcaggcaaggtttggtcccagcagctccatggctgctctgctctgagcatctggtatctactgtgcctttgaaaaaaaaaagaaaaaaaattatatttgtataaatgcatgattgctcacagagagctggttgttaagcacttaccagcacatatcatttctaataatgaacaagtccaaataaagcctactatataaaattcagatttaaataggtttattttatcttcctttccttgttcttttcccctcttttcctcctgttcttcctatttctcacttttagttcttttatgcttagtaatatatactatattaaactgaataagccagaaaacactgaaatttctttacctattattagtccattttcattctgctatgaagaaatacctgagaccgcataatttataaagaaaaaggggtttattggacttacagttccacatggctggggaggcctcacaatcatggcagaaggtgaaggaggagcagaggcacatcttacagggcagcaggcaagggcatgtgcaggggaatcgccctttataaaaccatcagatctcatgagacttattgactatcatgagaacagcatgggaaaaacctgcccccatgattcagttacctcccacctggtacctcccatgacacatggggattatgggagctacagttcaagatgagatttgggtggagacacagccaaaccatattcctatgttgtttctaacccttgcagtgacccaccagcaaacgttatcattccccactctgcagatgagaaaactgaggttaagcctcttttctgttgtcacacatctcataagtgccagacatgattgcctcttccagatctatctctaaagcctctgctcttttccaaataccatactgttctgaagctagttcttacaagcatattaggaaaaatagatcttatagcaaaagctttttacttttagagctatttatcccaagaactgtttattacacagaaaattacactttcacaaaatattttttgttatgctttgagcttatgtaaatgttttatacttacttaattttatttctgttctcatagccttggtggaggaccagatgatgcaaaagaaattatgagacacagtttcttctctggagtaaactggcaagatgtatatgataaaaaggtaagatttctttatggcatagtgtgtatatattttggctgcactgctaaaatgaatttatagcaaaaatattttaagtgaataaaagttaatgatgtaatgatactttccattttaccgacatttaagtgattattgaacttctgtgcacaaaattttactcatgattttgactccccaaatgcctcttgagattttgctcaacatgatcacagaatttttctatttttttcccataataatttgtttgcctctcattatttctttaattttaataaagataccaagtgttaatttttctttaagaaaactagttaaaattttttaatttgcccttatgtctttaattttaaagtgaacacttcagattcatttatacaaatccttgttttaaaagaaatttaaagaaatttgtttttaatatttaatgaaggtagtaaacacagtgtcttactttggacttctctgtcatttgaaacagaactttattgcccacaaaattaatactactaggccaggcatggtggctcatgcctgtaatcccagcactttgggaggctgaggtgggaggatcacttgaggccaggagttttgagaccagcatgggcaacacagtgagaccccatctctacaagaaaaaaaaaaaatcaactgggcgtggtggcgcactcctaagaaggctgctaaggcaggcaggagaattgcttgagcacaggaggttgaggctgcagtgagctgtgattacaccactgtactccagcctggatgacagagtgagacccaatctcttaaaaaaaaaaaaaacaaaaaacaaaaaaccactactaattacatatgtttagttttattgtgatctgcttattactttttattcatttatttatttattttttgaggcaaggtctctgttggccaggctggagtgcagtggcacggcacgatcacagctcagcagcctctacctccccaggctcaagtatcctctcacctcagcctaccaagtagctcggactgcaggcatgagccaccatacctgcctacgtttttggtactttttgtaggttttgccatgtttcccagtatggtactgaattcctgggctcaaacaatcctctctccttggcctcccaaagtgctggattacagacgtgaaccactgcacccacccttcttgttcttagtactgcaatttttgcttaagttcaggagcaggaaattattatgtctgtccccccctccccctgctttttttttttttttttttcccccactacctcagatattgttagtacagacagggattttgatactttgattttcagatgcttgtataaaatgtttactatgaaatgtttttcattcaataatctactccgaatttttctgtaattatttttagttcatccatttcagtttattccaacatttcatatttttctctgaaacatttattagtcaacaacatttatttggggtctgttatgtgccaagtgttcttctctgttaagccttaaggtaaacatagaattatgtcatatgaattagatgagttaggaggaagtaacacaagcacttcatgtctgtattatgttattggttactgggagtatggtgattttctgtttcttgtaactaggaatttaaaataggtgcatcatattagacacctctactcgattcaactcacatatcttgagtttctactatgtataaagtaccatgttaagtactgaatccttcacaacctttatgagaagcacttgagcattcctaaatgtttattcacttcttacagacaattttatatccacttagtatcactgaggatgttccttatgagttgcatgcatatataggaatgcctctaatgagctgtgtactgttttcatcgtgtcagtacactacaaaagaacctggaaggaagaagggcttgctgtctctcccagaaatcatgcatggttttatttttaataaatagctaataataagctacaactaaatatcatcctttctagacaccctcttctaggaggacttactccaaaaaaaaagaagaggaaaagaaccatttctttaagagacaatggttgaggtaccaatgtggccctgtaaattcaaggaagggccaaaatatggaccttcttagtcctgtgaggaaataagatttgctacaacgtttccttatctcagtgttcagctattcatgttgaataagagtttggccccacctggagaaagctctgagagcccaaccagtataccagtaaggaagcaaggcctgtcctatctcagctccactgggttagacatgcccagtgtaaaggtgatagtaagacagccaggagctaccatgtgggaatggaattaggggagccagcagctctggcagggaggaggagctgcctaaacaccttctgatgacatgtagataaattcgttcaagttgttataattatttttttttaatgggtgccacttaatttgagcaaaggtgttaaatatcttgcataaagaagcacaacccaaaatgactgtttctgtaaacaatagattggtcgtggattggtgccatctacaggcttactcacggtgtcctgtgtgacccgcgaggctctggtgttctctgccgccccatatatacttgaaggagcaactttattatagcagcacttttaaatttgagtttctttctaaaaggaaaatgtgattgagtctatttgggtttgtatcatatcacagatgaacatgaaattaattttgagaaccagcctgggggttagtagctgttttaatgaattcagttaaaatttcagtgttttagtgtaaattactaaataatttataaaataaaacattttaatggagtccttatatctttaaaatgtgtaatttattgtaaaagtcaattcattcctaagatcagggattattgttacatttttattgttttgataaatttattcttaatttattatcacataattattggttatttttctacttattgctgcacatcgagaggtgatggcacatctagagattctggcatctgttgaggagatctgaatctctttctaggcaaagtaaaaagtgaaagtaatcttaattacaagtagcatgatgtaccactctaaagagcacagtatcaaaacatgaaagaacaaagttggatcctggtcctggatttgcttcttgctttctttgtggaaatggacaggtcatttactcatgcaaaagatatgatcctttaactaccttcaagcttttaagattctctagcagggtgttttatagcatgaatttatctagattaatgtctatatagatttctacgtaaattttacactctgtcagtctgctaagattttgtgtgagattgtgttgaatctgtagataaatttaggaagagctgacatcttaacaatgagtcttcagatccatgaatgcaatttatttctccatttatttaggtggtctttaatttctcacagtaatgttttgtaattttcaatgtttaagtcttacacaaattttgttaggtttatccttacgtgtgtttcatgtcttccaagggaaatgatatttaaaatttcattttcactttgttttactgccagtatatagaaatacagttggttttttcatattgaccttttctcctgcaggcttgcaagaattagttgtagtaaccttttttgtagattacttacaattctctgcacagacaatcatatcttctgtaaataaagttttacttcatttctaatctgtatgcatttcctttcttcttttgccttgctgtattggctaagaccttcattataatgttgaatagtggtaagagtgagcatcctgactttgtttctagtcttagggagaaaagcaccttttaccattaaatatgatgttaatgagcacatctagcagccagatctgggtttctaactattattctccaataaaaggaaccaaggctccttgaggacgcgactgatttcagcactagtatagggggagaaaaaaagatgagcgtggagaattttgtggtgtcagaaagtaaggagggagccttaaaaaaaaaaggcaagacctagaaaacagcccaagctgaagggtcctgtagcagaagctgaaacaatttcagtaataaagtaaatatagtgttagtttatgatccaaaggatgaaatatgtaatcatgagtctatattgcataaataagtgattgattgtctaaataaagtgttgagagggacatgtcttccttacagatgaattccaattaatgtaaaagaggtgagtagagtagaaaatcaaatcaccattagaactccagagtgaaaattgctcattcagaattcacctatgaatattaaaattagtaagcaaaagtttaggaaagaggatatttccatactctcaagatatctccctgtgaacatttatcatttacaaaggtaaaatgactaactttacagtggagagatctggaaaacacagttttaaccaagtgatcacggttaacatcaccagtaagtaagatgttgacttcatggaacccatgataagatgctctgagaagggcacagtacttttgaagtgctctcctccaagatgcataacctcagtataatcatgaggaaacctgaagaactcacagggagggacattcctcgaaatacctggcctgataactttaaaagtgttagcctcatgataggcaaagaatgatgatggaacactcatagattggagagactaaagtggcatgatgacttaactgcgatgtgggatcctgggttgggtcctggactaggcaggggcattggtggaaaaactggtgaaattgaaataaagttggtagtttagttaatagtattgcactgatgttaatttctttgttttgatattcatactatggctatacaagatacagaggaaggtgggtaaagggcatatggtaactatgtgtactatatttttgtaagtcttctctaagtccagaattatttgaatatgttataaaaacatgatgttataatatagatgttttatgcctcctttatcagattgaggaagttctagtcctaggttactgagagtttttaaaatcatgaatgggtattgaattttattaaagctttttctgcacttactgcaatgatcatatggcttttctcttttatgttctgttaaaatggtgaattaacattgattttccaaagttgagtgaaccttgcattcctgttgaaaaaaaccacttgttcatgatgtgttattatatattgctagcgttggtacattgtatttctaaggatatttgcatcctgaaatcctgagtgatattactatgtcatcttcttttcctaaaatgtctttgtataattttcacttcaggatcatgtttgctttttaaaaacaaaaggggaagtactcctcctttctctttaattttattgaattgtttgtatgggatttgtattatttattaatgaaatatttggtgggatttactagtgaagctctccctagacctggagttttgtctttgttggtaagtttttcactgtgaattcaatttatttaatagttacagggctgttgtggttatctgttgttactcagatgaattttgctctttgtgtctttcaaggaatttatcatctaagttaagtttctctctaaggactgttagtcatgctttgcacattttgatgtgctgtgttttcatttcaaaagagttttaattccccttgtgattccttcttaagggttatttgtaagtgtgttgattaatttccaaatatatggatttttcagatatctttctgttactgattcctagcttaattctcttttggttggagaacatattttatatgattttaattgttttacactttaaaagatttgttttatggcccagaaaatggcttatgttgctgtatgttctatatacacttgaaagaatctatacattgacccttgaacaatgtgggagttacgggcaccatgctcaaaaacccagtaacttttgacttcctagaaacttaactactagtagcccactgttgacgaagccttaatgaacagttgattaacacatattttgtatgttatttgtattatatactgtatttttataatatagtaagctacaggaagggaaatattattaataaaatcataaggaagaggaaatatatttactattcatgaagtggaagtggattatcgtaaaggtcttcctcctcgttgtcttcatgttaagtaggctgaggaggaggaggaagaggagggattggacttggctgtctcaagaggtggcagatgcagaagaaaatccgggtgtacgtgggcccatgcaattcaatctcatgttgttcaagggtcaactgtattctgcttttattgcataaattgttctaccagtgttcattaggtcaagacagctggtagtattgtttatgtcttctatattcttactgattttctgcctacttgttctattggtttctgaaaaagatagttgatgtcgtcaactatgatcgtggactttatcttttaggttttgcctcatgtgttttgaagcctcattgttagttgcatacatatttagattaaggattgttttcttggtgaatttacctcatctttttttctttttctttttttttttaagagatggggtcttgctattttgtgcaggctggatttgaactcctgggctcaagcaatcctcttgcctcaggcttttgagtagctgggattgcaagcatacatcactgcgctcatctttacctccttatcattaggaaatgttcttctgtatagatggcagcaatatttgttttgacatctacttcatctgatattaatataagtactccacctttcttttgcttttgtgtaatatatcttttcccatcattatacctttaacctatgccaattatatttaagtggatattcttttagacagcatatagtcaattcttgtttttctgttattcattagaaaatacgacttaatgtaatgggtagcccgttttcatttaatgtacttaatgacatacttgggtttaaatatacaatcttgctgtttgttttttttttctttgttcctttttttctctttgtctgccttcttttggatttgttgaatattttatggttccattttatcactgctattgtcttcttgtatgtctgttttattgtttggaggttgtttctagagtttgcagtacacatgtttaacttagtctaccttgagtcataaccaattctcatacaacagcatatttctgtttcctccatctattctttaggctattattttcttacagtttactttcacatatgttaataaacaccacaatacatggtaatggtaattagattttgctttagataattatattttaaagtggttgaaaatgctacacattaaccattattagcactctccattcctttacatagactatgcttctacctgccgtcattgttttcttgattataaggctcctttaactccacttccacctccctgggtttggaaaaattcatggaaaaatgtgtttgaaggaatacaggattgggaaatgaaggaaatgggacatttcagaatgggaaaacaatgtgagaaaaaaaagtagtaacaagagaagtgaatgaagatatgctgactggaggaactgggaatctgtggtggatagaatctggatgtaaacagcggacaggtggcctgtgaatacactgcggcttcttgaaagtcgacctcgtatgtttgcttgatccacttaacagaactgtagatgctgaagtaaggaaatgacacgcagcaactggattttttcaagttttgttggaatagactcttatggagaagagcctggaaaagggaatctcattaagagactactgcagtaatacagtgttaagtgacagagctcttactaaagcagaacataggcaacaaagggaaaggaagtgtgaattccatagaaattatcaagaaattgaggactcctattttagtctgataatactggggaaaatactgggagaaagtttaaggaagaggattatagctggtttttggtaattaatttcagatagaattgtctaatggctagaaatatagcacttctgggagttaaaatggaaataaatatgtctggaaattcagagtttaattagagctgtggaaatgattaaggaggagagggctaaggaaatggataggagagagggaagagaaaatttgaaagggaagtcaggagggagggaagcagtgagaatgtggaaggttgggattgagtgctggaaaatattcatggtcaataatggaagttggtttgaggacacatttttgcaaggtgtatcaagatcatttgtgaagcatcgtgccagagttgaagtggaactttcctgagttgtgactttctactttctggttgagatattcagcctgaagagttcggtgattgatggcagttacgcagaggttaatgattgtaagctactgctttacaagtgaagcaaggccagaggagtagaacagatgcaccagcggaagagagatgaaaggctgaaaataggtttctatttgatacttcccttatcacactcaaataatggcccacttttaaacttggggtcaaagaaagatgtgttccaaatacctgctagacattctgatggctaagccttacaattagtgtcttcttttggtcatgaggcattgtacttaggatataaaaacacaaacagctgtcaaaaccagtgttatttctggcataaaatgtatacagttaaagctttaaaagccttcaaattgggttaggaaatataactagatgttccttacaaaaaatctcacctagaataaaattacacagcaaactggaaaaaataagaatgaggaaaagcttaatcatcaaatgacacaaaaagtaaacagaggcaacaataataatttgaggctaagtagatttcagatattaaacgtgataagtagatcatgtgtagcataaatgagaaacatatttatttgcaccaaataacagcatctatatgcacaaaacaaacactattaaaaatgcaagaattaactcaagatggattggagacataaatgtaagacctgaaaccataaaaaattctagaagaaaacctatgaaaaattcttccggagattgacctaggcaaagaatgtgtgacttaagtccccaaaagcaaatacagtaaaaacaaaaataaataaatggggcttaattaaactcacaagcttctgcacagcaaaagaaatcatcaacaaagtaaatagacaacttacagtttgggaggaaatatttgcaaactttacttctgaaaaagggctaatacccagaatcttataaagaactcaaatcagcaagaaaaaattcaaataattccattaaaaagtgggcaagcaacatgaatacacatttctcgaaagaaaatatgtgcaaatggccaacaaacatgggaaaaaatgttcaacatcacaaatcatcaggaaactaccaaataaaaccacagtgagataccattttaccccaatcagaatggtcattttaaaaaagtcaaaaaacaatagatgttaatgtagatgcggtaaaaagggaatgcttacatgctgttggtgggaatgtaaattagtacaacctctgtggaaaacagtatggagatttctcaaagaactactagtagatgtaccattcgatccaggaattccactagtaggtatctacacaaaggaagtcattctatacaaaaggatacatatactcatatgtttattgcagcacaattcacaattgcaaagatagggaatcaacctaagtcctcatcagccaatgagtggataaagtaaatgggatgtgcacacagacacaccttggaatatcactagccataaaaaagaacaaaataatgtattctgcagcatatagatggaactgaaggccattatcctaagtggggtaactcaggaacagaaaatcaaatactgcatgttctcacttagaagttggagctaagctatgggtatgcagaggtctacagagtagtagagtggacactggagactcagagtgaggggaggatggaagagggaggtgagggatgaaaagtcacctgttgggtacaacgtacactatttgggtgatgggtacactaaagcccagagtttaccattatacaattcatccatgtaaccaaaaaccactgtacccctaaagctattgaaatttttaaaatatattttaaaataattttaaaatatattttaaaattattttaaaattttaaatatattttaaaatatattttaaaatttttaattttatattttaaaatttatgcaagggagctgatagaaatacacttacttaacatgtctagaggtttatcagttcattgatatttacaaagatctggcttttgcttttgttagtttttctccattgattttctgttctctgtttcattgatttccgctctaattttaattatatcttttcttctccttactttggatttaattttctctttttctagttttgtaacctgaaagcttagattatttgttttcgatcttttctaatttgtgcactcaatgctataaattttcctctaagcattattttaactgtatctcacaaattttgatgttttattttcatttagttacaaatagttttaagttttattgaattatttaatatgtgtgttgtttagaaatgtgttgtttagtctacaggtattttggagctttccagctatctttctgttactgatttccagtttaatttcattgtggtctgagagcatacttttatatgatttttaaaaatttgttaaaggtgcattttatggcccagaacatggtctgtcatgatgaatgttctgtgtgagaagagaagagttacatattctgcttttcttggataaaatattccataatgttgatattaaatccagttgattgatggtgctgtttagttcagttatgtccttaactgactggggggacatgttgatgtgtccaactataatagtagagtcatctgtttctccttccagttctatcagtttttgcctcacgtattttgattctgttgctagacacatacacattaaggactgttatgttttcttggagaattggcccaggtatcattatgtaatgcccctctttatctctgatagttttccttgccctactttgtcttaaattaatatagctcctcccactttctttaaattactatgagcatgcctatcttttttccatccctttacttttaatctatcagtgtctttatatttaaagtgggtttcttgtagaccatatagttagatcttgttttttttatctactctgactgtctctgtcttttagctgatgtctttagaccactgacattaaaaatgataattgatacagttggatttcttacaggtttttttgtttttctttttgtttttggaaacggagtctcgctctgttgcccaggctggagtgcagtggcacaatctgggctcactgcaagctccgcctcccggcttcacactattctcctgcctcagcctcccgagtagctgggactacaggcgcccaccaccacgcccggctaattttttgtatttttagtagagatggggtttcaccatattagccaggatggtctcgatctcctgacctcgtgatccgcccacctcagcctcccaaagtgctgggattacaggcgtgagccaccgcgcccggccttcttacagttttttatccattgcccttgctgtttctttgtgtgtgtgtgtatcccatttttattctgccttctctggtttaattgagcattgtataaggcaacatttttccctctcataacatattaattgaataaattatgcttttttaactttttttaactgccagcccttgagtttgaagtatacacttataactaattcaagtcctcttttaaatagcaccattcatttcacagatagtacaattgccataggtactttgctcttgtgtagaatattctataaatgtcagtgatagaattggctaatagtgttaagtcttctgcatctttactgatagcttaatggcttgcttttatcagttactaagagagaagtgaaaccttcaactataattatggcgttgactatttctgtttatagttctatcagttttgacatttttttagttccatgtgtagatgcacccaaattgtagtattgttatatctttttggtagttttacctcttcattattttggttaaccaatttattggtgtaaagattacaacggaaataaatgaaatcgataattgaaaagcaatagagaataatgaccgaaaccgaaagttggttatttgaaaaatcagcaaaactgacaaaactttaaatggattgactaaggaggaaaaagagaaaaatgaaatactgaatcagaaatgaaaaaagatattactcctgacttgagagaaatagaaagggttataagatgatactctgaagaagtgtatgccaccaagttgagtaacctagatgaaatggacacattcctggaaatacacaaatcaccaaaatgacttaagaataaattgaaaatccaaatagaccccgtaactcttaaagaaataaaatcactaatcgcaaacctcccaccaaagaaaagcccagggccagttggctttactggggaagtctacccaacacttaaagaaaaattaatgccagtccttctcaaactcttccaaaaatttgaagaggagtgaacactctctcacttgctctatgaagggagcattatcctgatgtcaaaactagaggcattataagaaaagaaaactacagaccaatgtccctaatgaatacagatgcaaaatttcttaacaatactagcaaaccattcagcagtataattaaaggattgtacaccttaaccaagtagatttattccaggaatgcaaggatgttcaacgtatagaaattaatcagtgtaatgtcccacattaatagaatgaaggagaaaacttgcatgatcatttcaactgatgggcagcatttgacaaaattcactcctttatgataaaaacagtaaaaagaaaaaaaagctaggaatagaaggaaactgccacaacattataaaggtcatatatgaaaaattcttggaaagactgtcctttaagggatcatttctatagtttggaaaaccctcagctcacattatattcaatggtgaaagactgaaagtttttcccctgagataaggaagaaaacaaagataccactttcaacatttctgttaacgtgacactggaagctgtagccagaggagttaaataagagaaataaaaagcaatcaaatttgcaaggaagaaataaaactacccctactaataggtgacatgatcttatatgtagaaaaccctaaaacatacacacacacgtgccacacttgtgcttagaactaatacattcagtaaagttgcaggatgcaaaagcaagctagaaaatacattgtatttccatatactagctatcaacaatgtaaaattgatcttaagaagatcaatttcatttaaaatagcatcaaaaaatgtcttaggaataaatttaaccaaggaagcacaagacttatacactaccgactacaaaacattgctgaaagaaataaaagaagacataaatgaatggaaagacatctcatgtttatatattggatatttaatttaagatgagagtactcaaaatgataatacagattcagtgcagttttttcttaatcttatggtagaatactattcaagaataaaaaacaactcaaatttataagtatcaatattgataaatctcaaaaaacaaacacagaaaaacaaaatactgaggatatttacagaataccgtactacaaaaactgaaaatgcaccataaaaagcattgtatttatgacaaaatatatatatgggagaaaactataaaaacttgcatgcaaatgatatgaagtaacttcaggacaatatttgcttgaatcataggtgattgccattctcacaggttaaaatggttgaacatttccaggtgcagtgactcattcctgtgatcccagcattttgggaggccaaggtaggaggattccttgagcccaggagttcaagaccaatggcaaaaccccacctttaccaaaaataacaaaaaattagccgggcatggtggtgcacgactgtagtctcagctactcaggaggctgaggtgggaggatcatttgagcccaggagatcaaggctgcaatgagctgtgatcacactactgctctccaagcttgggtgacagaacgaggcctcatctcaaaagatagagagagggatggatagatagatagatagaatggttgaacatcaatgagtaggaagaaggtaggtatttagcagtaactattttacatctgaaaaaaacagatgtttgaaaatacatatagtacaatgttaacatccattagatttggttatcttattttctactcttaatgcttaaactagttctttttttattttcaattcaagtgtaagttaaaagaaatagaacaccaagcttaggctactcaagaaaattgaagagtagtaatgacccctttgtcatttctgattgtgtttatttggatcatctctctttttcagttattctagctagcagtctattttgttaattctttcaaaaaaccaactcctggatttgttcatcttttgtactttttctgcatttcaatttccttcaattccgctctgattttggttatttcttgccttctgctagctttggggttgctttgctcttgtttctctagctcttctagttgtgatgttacattgttaatttgagatctttctaactttttatgtgggcgtttagtgctataaacttccttcttaacactgccttagctgtgtcccagagattctggtatgttgtatctttgttctcatttgtttcaaagaatttcttggtttctaccttaatttcattatttacctaaaagtaattcaggaacacgttgtttaatgtccatgtaattatatggttttgagagagtttcttagtattgatttctgtttttattgtgctgtggtctgagagtgtggttggtatgatttcaggtttttaaaaatttgctgaagttaaaccatccatgtttgcagacagtatggttctatatacctaaacaacccgattttctctgcccaaaagctctacaatccaataaacaacctaacaaaaattgacaaattaacataagcaatatctcaggatacaaaatcaatgtacaaaaatcaggattcctatgcaacaacaacatctaagctgagagcaaaatcaagaatgcaatcctattcacaatagccacaaaaagaataaaatacctaggaatacagctaaccagggaagtgaaagatctttacaatgagaactacataacactggtcagagaaatcagagatgacacaaacaaatggaaaaacattccatgctcatggttgggaagaatcaatattgttgaaatggccatactgcccacagcagtttacagattcagtgctattcttattcaaactaccaaggacagtcttcacaaaattagaaaaaaaaaccaaactatttttaaatccatgtggacccgaaaaagaacccgaatagccaaggcaatactaagcaaaaagaacaaagccagagacattacattacgcaactttgaactatactgcaggctatagtaaccaaaacagcatggtaatggtacaaaaacagacacatagaccaatgggacagaataaatagcccagaaatgtcacacagttacagacatctgatctctgacaaagtcaacagtaagaagcaatagggaaaggactccctcttcaataaatgatattgcgataactggctagccatatgcagagaaggtggaaactggacccctttcttacaccatatacaaaaatcaactcgagatagattaaagacttaaatgtaaaacctaaaattataaaaaatgccatataagataacctaggaaataccattctggacatagaccttggcaaagacttcatgacaaagactccaaaagccattgcaacaaaaacaaaacttgacctaattaaagagcttctgcacagcaaaagagactatcagcagagtaaacagacctctgcagaatgggagaaaatatttgcaaactatgcatctgacaaaggtctaatattcagaatctataaggaatttaaacaaatttacaaaaaaaaaaaaaaaagctccattacaaagtgggcaagggacatggacagacacttcccaaaagaagacatacatgtggccaacaggcatatgaaaaaatgcctaacatcactaatcattagagaaatgtaaattaaaaccactgtgagataccatctcacaccagtcagaatggccctcattacaaagtcaaaaaataacagatgctagcaagattgtgagaaatgggaacacttatacactgctggtgcaaatgcaaattagctcatccactgtggaaagcagtttggcaatatctcaactcaaagcagaattaccatttgactcagcagtcccattattggaatgtaaattcttctgccataaagacacatgcacacatatgttcattacaacactgttcataatagcaaagacatgggatcaacctaaatgcccatcaattacagattggataaagaatgtagtacagatacaccatggaatactatgcagtcatcaaaaagaacaagatcatgtcctttgcagcaaaatggatggagctggaggccataagcctaagcaaactaacacaggaacagaaaacaaaatcccgcatattctcacttacaagtgggagctaaacattgagtacgtatcaacacaaagagaggaagagcagacaccaaggcctacttgagggtggagggcaggaggaaggtgaagatcaaaaaacgacctaccaggtactgtgcttattatctgggtgatggaatgacatgtacaccaaacccccccatgatatgcagttttcctatataacaaacctacgtgtgtgccactcaacctaaaatttaaaaaatagagaaaattgaagagttaagaaaggagcagtagctaaagggagcatgtagaatgggtgatatttatttcatacactcaggaatgatccaaaagggagtgtgaaattggagctacatagaaacaagtaatatttaagataaaaacatacagatagtaagatgtaaagtgagtaaatacagaaaaaaatgtaagatctctgaagcatagctaacctatagaaaggaggtgggatacccttgtagtgacatcaattggaaagaagtaagacgcccaccagagcagatgtgtttataagcatttaggcagaaagttatggtatttaggcagaaagttatggtagtttctgactgaaggcctcaaattctctctctctctctctctctctgtgtgtgtgtgtgtgtgtgtgtgtgtgtgtgtgtgtgtgtgtgtgtgtgtgtgtgtgtgtgtgtgttttaagagatggagtcttgctgtaatgcccaggttggagtgcagtggcacgatcacagctcgctgcagcctcgaattcctggccttaagggatcctcccgaatagctgggcctacaggtataagtcccaccatctttatggcagaagttctgccttcttattaagagtgagaagaatgttttatggttgatattagaagttttaagacagtgactgtcacatgtagggataggctcagagggagctagagagaaacccaagtagggacctataaagaggtaccgattgctggagggcccagctgaggttgaaaatcccaaagcccaattttatgctgactgctaaagccttgttcctcgaaagaaaaaattataatgattataaaacataattatataagtattatataaagcacaacttagaaaagatttaagaggtattctaggaagattgatttagaatgtttggattattttgaaatggatcttaatacttattgcattcctacttatctttcagagatttccttcagaaaagaagaaaaaatcttgcctctagagagtaatttaggtactttatagtttattttggtcacttggttgatactcatttcaataggatggcaactgattacataagtaatatttttatctatcatgtgcaaggcacagagaggcctcaatgaaataatgtctcctctgaaagggcctaagtgaatcttccagaccttactatattaattttaagtgtttcggtttattcattaaacatctgtgtttctgtttgaagattaatcttcatatctgtcccagattctaagttaggactcttagtatttattattttcttacgtatttgctgtttccagtgttattcttttgttaattttttattgagataattcaccctttaaagtatacacttccatggtttttagggtcttgacagacttatgcaaccatcaccgctgtctaatttgagaacactttcatttcttcatttttttttcttaaagatccatgttttcgtctggaataattcctgttcagtctaaattttttttttttttttttttttttttttttttttttaaccattttttgtagtgcagctggcaaaaaatttgttttcttttatgggatgatgtctttattttgccttcattcttaaaggatatttttactgaatataaaattgtgggttgatagtttagtgagtacatatttaaatatttcttccttgcaagtcatgtggtatatttcactggctgttttcaagatatttttgtttgtgtgatggctttgtaatatgtcagttgactagactgagccacctttcccaggattccttttgctatttaagattctcgtgggagatttggaggatagacgtgacggaacagccattttgtagctcattcatgttgtctgctagaccatcttattggtacgtggcagtggtcaggcctgcatcagctccacctcctcctgcatcctgttagcccttgagcctacttctgggctggagtgtgtgtttagctccatgatgaaagtcccagcttttgcaggatatccacaccagcaaggtcaggcggtacgaattaacacgggtttcagtctatcctcctgggctccagcttgtgcttctagattccatttcatctttcctctcctggctttgcttgcatcttcgcttctcaacttactgtcctatggacatgaagcctcagcagtgaacttggagacaacagccttacagagacaacataactagctcccacaatcagggaaattcagttacctgtaatctctttacacacacacagagtagttctgcttctctcatggaaccgtgacagactctggttttaagccttttgactataatgtgtttaggtgaggttttctatttattctgcttggagttgcctgagctttttgaatctcttgcatatccttctttaactttggaaaacttttagccattatttcttgaaatatattttctgtcttattatctatctctcctcctccccctccctccctccctccctccctctccctctctctttctttctttctttctttctttctttctttcttacttttggaagttgtccaacaggtatgaagttctgcttgttttttcacattgttttcctgtgctattcaaattggataataatctctgctggtatatcaagtttactgactcttacataatctccaatgtgctccaagcccatagagagaatttcttatttcagatattttatttttttttattttaggtttttccatttggtccttttcctaatagtttctgtgtctctgctgagattttcaacttttttactcatgaacatattttactttacgtcattgaagataattataaagttgctttaaagtctttgtctactaatttcaacatgagatcatcagagcatcagtttcctttgatgtctttttctagtgtatgggttctgtttcctttgtttttttaatgctgagtcattttggaatatatcctgggcattgtgactggtattttgtgcctctgaattcggttaggttgcagcaaagaatactgaattttttattttcttaggccagtcatcatggatgaactcaaactgcaaacgctttcttttttccagtgggttaagattccaggctggtttatttagacttcactaggaggcttggagcctgccctgtgcatgtgtggttcaagagtcagagatctgggcagactttatactgagattttagggcttcttctctttggctgcctcttttctggaatttcacctccttcacttaaaagctgctgtacttgttcaagctctgtcctctgattgttcatggcagtagaactgtgggtttctaatttaagatttttaccctaaatggcataagctggggcccaccttcaggcaaaaagccgtaaaaatgagaaattcatttggtgccattccttattcctagtgcccacctcctctttagtacctgcctgtttttagttgcttcccagaacctttagattgttttcatgtctttctcctgaggttacagttatatggaggagggttaatccaatcggagctgcttgaccatgattgtaagtgaaactgagtatttgttcttaattatgcattattgcatgccagatgtacaccttttcttcatgtggcacagcagtgttttgtattcatgcaaggaagtatctcacagattcacgtttgtgcaaccttctaaagagcttgtgtgagagagcttatttaaacagtgtgaattaccagtgaatgttatggttagttcagtgcagccaaaacataattcatggctgttccccttctcttttgtcccaattctcagtaacaaattcagacctctttttagagaacgtgtaatttcattaccttttgacaatgccttttagacttcactagggagcttggaggcttccctgtgcatgcatggttcaggagtcagcagaggctggtgcctggtatgtatggttcaggagtcagcagaggctggtgcttggtgtttggcaccagtggccaaaacaccaaagaacctcctgtgaatattttcttgtctttactcaccaaatatttagtgcttttctgtaagtcatgcacaacataatgatgcttcagtcaacacaccgcatataccacagtggttccataagattataatagcgtatttctactgtactttttctacatttagatacacaaatacttaccattgtgttgcagttgcctaccgtattcagcactgtaacgtgtacagggctgtagcctagggcagtaggccatcccatatggcctaggtgtgttgtaggttacaccatctaggcttgtatgtaagtactctccatgatgtttgacaatgacacaatcaactaacatgcatttctcagaagagacccctgtcattaagtgacacatgactgtagtttatggtaagtattgtgccaacagctagccttgcagagatagctaagataaagtccctgtcttcaaacggttgcttacagtttagtagaagagacagataaataagcaggcgatttacattttcatgtgatgcgggttgtgtttcagaggtggtagaagtatttcagaggttgcctgacccagattttaagagtaaaggacctgttatagaagctgcagttaggattggattaaaattaattgggtggtggttgatattgtgatgctttagtatgactttagtatgaatatttaggggctcagtgttttcttcatcttaaaatgaggggattggactagatctataagattattttcaatgtgaatattttgtcagtttaaagacacattgaagagatgctcaaaaaacatacttcttttttctttttagggaatagagtatttcagatcatttaaagtcctgtttgagagtttaccaggctaacaggaagtactacttgtgatttctttgcctgttcctgttctgatgtttagctgcccagtacaaacctgcaaggggagccttggatatccaattggtttctgaaaggtgtgtgtgtgtgtgtgtgtgtgtgtgtgtgtgtgtgtgtgtgtgtgttcgtcctttttggagccagagcttcaaaacatagcttgcatcttctgtgtccttcataaaattccagttggtttcctgcattcacttaattagtacagcacctgggcatagtagctctggataaatacaggttcttttctccaatagcttccttgcagaacatagaaattgctgcctgcccctatgcctcaaattgaccttctacctcttcctcctcagcttttaaagcccctatctttccttctcaccacaagttcatcccccaacccaaatgttccctatcactgggtctctccagcattcatctggtgtggtattaagagagtggctgtggctgtcagtgctagaacctggacagagagagagagagggtcttggtcacgtcatctttacagaaatataataggaatttctctataaaaataatagatacttgttagaagctttaatgttatattttttatttatttctggtttaatagaccttaatgttactgcctagtaacctacctacattatatagcctttctgtgtatgtgtgtgtatctattgaaacaggtcccaagttttttccagtttatatgtaggctgcatttttcttttcttttcttttttaaatttttgagccagggtctctctctgtcacccaggggagtgcagtggcgcaatcacagctcacttcaccctcaaccttccacctcagcctctcaagtagctgggatcacaggcacatgctaccatacctgggtaatttttaaatttttttgtagagatggagtctctctatgttactcaggctagtcttgaactcctggcctcaagtgatctgcccaacttggcctcctacattgttggaattataggcgtgagccactgtgcccagccttacatatataggcttttataacaaaattagcttgtaagttggaaattgcctttatgtcatttctccccagtctgcatacttattcaacttttgctcatgttcttgaatatttctaagagaaatagtgattaatggctgccacactgctgatgttggacagagcctataaaatcagctgaagaagggagaaagtagattgtttcactaggctcttagtgaagttctgatagttataataaatgcaacttgtcctttaacactactaggtgcaaaatctttttgttaccctctcatgccttttaaaaaggctcccagtgtttcactaatgagagcccttttgttgtaatttataggtgaatcctctccaggtataactgagatcttcaaataatgtatcgtatctatggatgtttgtgaataacatcacctgggcataaacctacagtcaataggatgagtgcttatgaagttatttttgaatgagaaaatttatcacagaaaagaaaatacaagttccagtttctggggattactttttaaagtaatgcaaatcatccatatcatgtgttaacaaacccctcagaattccaacaaggaaagcagatgtattaattaaacatttaatgtcttttatagttaaagtactcattttggcaggtctaatattacgatacaatagtggtatattaatttgttatataccttgggccccttggtacattttatgtaggcacaagattaacagcatgaacttcaattattactgtgtagttttgtaaaaatgaaatataattattttagtttctagttttatgtcaagaagaattcattggtatggcacagcttagcatacaaagtaactaaataatgtatgccacatacccattagttttgttagaaataaatcctcttttatactcctgcttttccagtacatgcacacctacatatacacaaagcgtgaagccagtatttagtagagattaaataaaccagaatctccacctatgattgactactttctcatgttgtttcagagaagtgaaaattatagcaccagattactgtctctgggaaatctaaacatgcaatagtgttggcaattctttactgcaaacatctatgttcactggattttggaccctatatgccaacacaaagtggtggaaataaccacagttgttaaggcaattaagataccacaatcactgtccacatcagctgtcccagaaagtttcaagttctccagtctatttcttaagcccctggaaggaacaatagaagaaagaatatagatatctgatagtagcacgtgacttgttactaaaaaaggtctgtggaatctcttaccttcagagaccttggtgttcatgcatacactcatggaatcattccagccataccagaaataccaaatgtgacttactctaacaaccttcagaaaattatctctttgttctttcattgacacttttaggaagatagtaaatggtagagtgatttcatagcatttaaaatttgataaaagatcagtgtggaaagaatttagggagcttcaacgttgctgtcaccatacggacttgaagttgcatattttcagtgagatgaaattgatgtcttgaacccagaaactttatcctcttgtttaagatcactgaatactacattttctgaaagcaaattggttttcaaataaagatttgtttcaagtttagtgcatttgtcagaaaaatatgttgtttgcagttaatgacactatagctgttcattgagttgatccataaaagtagctgagatttacagaaatatatatgactatcttttctaaatgggaatttacattcagtcagttgacagaaatgttttgagagatgtggttagaggaaaagaagagatgaagatactggtttaaagctgaaataggaaattaatgtatttatgtgctagggctgctgtaacaaaataccacagactgggtggtttaaacaacagaaattcattttctcatatttctggcgaaagtccaagatcaaggtgcaggcagggttagtttcttctgaggtgtctgtccgtggcttgcagatggccgtcttttccctgtgtcttcatatggtttttccttagtgtgtctacttgggtgtccaaatttcctcttcttgtaaagataccagactgagttaagacatatcctgatatctcattttaatgcagttacttttttaaagaccttatctccaaatagagtcacattctgaggtacttggggttagggtttaaacatactaattttggagggacacatttcaacctataataatacaatatttgaaatttgttcagctgttgtttaaagtaaatatgaggggacttcaaaaagttcatggaaaatggtattaaaagataaaaacagaaaatataaactttatttctcaacataagctccgtcaagttcaagacacttttgtaagccatgataccagctagttagttcatccctaaagagctgaacatcctggtaatttacctatatcagtgcagtcttttttttacattattaagtgaagaaaaactaatactctttaaaagcttttttaagtttaggggaaaaataagtcagaaggagccaaatcaggactgtaaggtggatgcctaatgatttctcatgaaagctctcatgaaatacccctgtttaatgagagggatttagcaggagcattatcttggtggaggaggactctctggtgaagctttcccagaagtttttctgccaaagctttggccaactttctccaagtgcttataatcaggtgttatcattctcctgccctccagaaagtcaataagcaaaatgccttgagcacccaaaaaactgttgccatgacctttgcccttgacctgtccaatattgctttgactggaccatttccacttcttcatacccattgctttatcttcaggattatactaatagaaccatgtttcatctcctgttacaattcttcaaagaaatgcttcaggatctttattccacttgtttaaaatttccattgaaagttctgctcttgtctgcagccgatctgggtgcaatggttttggcacccatcaagtggaaagtttgctcaacttaaatttttcagtcagaattctgtaagctgaaccagatgagatgtctatggtgttggctgttgtttctgctgttaatcattggtccttttgaattagggcacaaacaagattaattttttcccttgcaaattgatgtggatggtctgtcgctgctggcttcgtcttccacattgtctcatcccttcttaaaataagttatccatttttagactgctgatttatttggggcatacttcccataacttttcataaagcatcagtgatttaatcattcttccacccaagcttcaccatgaatttcatgtttgttcttgcttcaattttagaattcatgttgctcttacaggggctctgtccaaactgatgtcttatccttcttagtccctcaaacttgatcctgtacagtcatgttataacaaatcagtatgagttaattttggtgcagaaattttttgaaatctgtgcatggttttttcataatacacattttccataaagtttatgaagactactcaagaatattatatattctagaaatttgtaatgaaatctgaagttggggcattctgatgatttttgtgggactgcttctgttcaagtactgtggcagtttttttttgttgtttgacgaggtcttgctctgtcacccaggctggagtgcaatggcatgatctcggctcactgcaacctccacctcccaggttcaagtgattcttctgcctcagcctcccaagtagctgggactacaggcatgtgccactacacccaactaaattttgtatttttagtagagatggggtttcaccatgttggccagtctggtctcaaactcctgatctgcctgcctcagactcccaaagtgctgggattacaggcatgagccactgcacccagccatactgaggcaattttttacaagccctacccgacaatgttccccatatacataatgtagggtctttgcttccctacaaatgtttatattccactgagttgtcttcaccttcagggacaggggaagtggaagggggaataatgcttcctagaatgaatatcttgactaatgtatagagaaacaatcaaaagcaaaagtagttttcattcaaagccttcacattgtaaatgctacagtaaaaagaccttgagatcaagaaacctaggtttttgccgctccagttcttattcgtataatttttggcaagccatttaaccagtgtcagctttaatttcctgatctctaaaaaggtacactacatgctcactgacgtcttactcagctgcaagactgaatgattgattcatttattccgcaaatattgttgaatgctactatgtggcaaggactgttttaggagttgggaatatcacattagtgcaacacaaagttccagaggagacaagtgggaaacaaatagcaagatggtaaatttaatcttactcgtatcaataatcacattaaatgtaaatgttctaaacaccacaattgaaagacagagattagacttggtaaaaagcaagaactacctatatgctgcttataagaaaccaactttaaatgtaagatataagtagattaaaattaatagaacagaaaattatatactatgctcaacctaatcagaagaaaactagagtgctatattaaatcatatgaagtagatttcaaagcaagtaatattgctggagataaggaggaacatttcataataattaagggagtcatttcatcaagaagtattaaccgtcttagttatgcatctaataacaaaacaaaatatttgaagcaaaaactaatataaggaaaaatagacacatttacagttactattggacagttcaatatccatcttcaaataattgatacagcaattggagagaaattggtaaggttatatagcaacttgggcaatactatcagtcagcttgatctaactgacatttatggaacacgctacccaacagcataagaacacttatttttctcaaggtcacagatcatttatcacagtgtaccatatgttgagcaaaacaactccatgaattttaaaggatttaagtactgtaaaacattttctctttgaaggaaatgaaattaaaaaaacacagatctatggaaaatccccaagttcttggaaactaaatattaatccatggatcaaagaagaaatcaaagggaaatgagaaagtattttgaatggactgaaaacgaaaacacaatgtgtttagctgtgatatacagctaaagcaatacttaaatttatagtactaaatacaatttatagtactaaaagatatttttaaacattagaaaagaagaaaagtgtaaaattaatgaccttagcttctatcttaagaaactaggactgggcacagtagctcacaactataatctcagtacttttgaaggccaaggtagaggagttcgagactagtctgcacaacatagtgagatcccatctctaaataacaaaatattagctgggcatactggtgtgcacctgtggtcatagctgctcaggaggctgaggcaggaggattgctcaaggaggctgaggcaggaggattgcttcaggaggctgaggcaggaggattgctcgaggccaggagttttgaggcttcagtgaactatgatcacatccctgcactctagcctgggtgacagagccagattttgtctctaaaaaacaagaaaaagaaaaaggaattagaaaaataagaacaagttaaacacagtgtaagcagaacaaaggaaataaagattgggatagcaatcaatgaaatagaaaacaaaaaatcatagagaaaattgatgaaaggaaaactgggcttttgagaagatcattaaaattgatgtatttctcacctgactgaaaagaaaagtgagaagacaaataataaatgttgacactgctacagattctattggtattaagtggataatatggaagcattatgtataactttatgccaataaattcaactatttagctgaaatggacacatatgttgaaagatacaaattaccaagaagaaatagatgtcatgaatagccttgtacctgctaaagaaattatagttgtggttaagatccttctgacaaagacaccagacccacatattttcaccaacgaagtctaccaaacatttaaggaatattatcagttctatacaaattattccagaaaattgaagatgagagaacatttctcagttcattctgtgaggcaggtattaacttgatatcaatatgcaagagatttttttttttttttgagatggagtcttgctccgtcgcccaggctggagtgcagtgacgcgatctcagctcatggcaagctccgcctcccgggttcatgccattctcccgagtagctgggactacaggcacctgccaccacagccggctaatttttggtatttttagtagagacgggggtttcccatgttagccaggatggtcttgatctcctgacctggtgatctgcctgcctcggcctcccaaagtgctgggattacaggcatgagccaccacacctggcccgcaaagagatttttaaaagaatgctatagaccaatattcttaatgaatatatatgctaaaatgtttaatttaattttagcaaatcaaatctaacaatagatacaaagaatcactaccagtgtggtctgttctaggaatataagattgatttaacattcaaaaccaatcactatagttcacctattaacagagtacgaaggaaatgattatatcaaatgatgcaaagaaaaaactaagaaaaatccatcctttttaaaacttatttaaacaaaaaatgaaacgctctgagtgaattaggaattgggttttttttttttttaacatggtaaaggaaaacaatttgacagtttctggaaaagtcaaatgtatacctaccatacggcccagccattccactccttagtatttgtcctaaataaattaaatcatatgtctacacaaagacgtggacataaaagttaatagcaattttgtttgtaattgccccaaactgggagcaggccctgtgttcattgacagatgagtgtgtccattgtgatacatctatgtactgaaatattacccagcaaagtgagtaaactattgatacatgtggtgacatggatgaatatcaaagtaataatgctaaatgaacaagccagataaagagtacatactctatgatccatttgcataaaattctttaaaatacaagcaaatcagtcatggcagaaagtatgtcagtcatggcctgcaggggatgggaggatggaagtacacatgggcacaagaagacatttgaagtggtagatgttttcatcatcttgattttggtgacagtttcatgggtatatacatatgtcaaaacgtatcagttgcatgttttttgtttgtttttttgagagggttttactcgttcgccccggccgggttggaatgcaatagcataatcttggctcacagcaacctctgccttctgggctgaagtgatccttccacgtcagcctcccaagtagctgggactacaggcgcccgctgccacacccagcccaagttgtatattcttaatgtgtgctgtttagtgtatgttaattacgcatcaataaacttttttttaaagtccttgccctcgtggaacttatattttattggtgatgaacattgacagtaacaaatacatgtatatcatatgtgtgcatgtatacgtgcctgtgtatcagatgtcgcaaagtcttgaagaaaaagcaatgtgaagatagaaagtgagggggaggatagctgtttaatgtaagaaggcggtcaggaaagtcctcagtacacgtggcatttgaaacagagactattttaagctcccctataatcttttgaaaactgtgttaagataggtttcagtttgttaaagttacaggtcatcattctctcatctaaaaggacaagtttcccctaacttgaaggcaaatttaaatttttgacatcacaaagaaccagatgaaaaggatggggcagaggtgagcaaacctactcctagtgcccaagagaagccgattccagccacaggaatttcttgtggttaacttctgattggaaagataaagacctattttgtgaacatctgtagaatagtaaatcagaaaaacccaaccagaattccagtcttcccgttttctgccagataggggcaattacccccttggttttctaaaaaaaataaaaaaaacaaaattgttccagcctctgtcacctctggggttccctgtgcgtgtgcatgtgatatgtgaggctggtgtggagaatttagcctgagagtcagagggagggtttctagcagtggagtgacctgcttgctcatgtccaggggatccagcagggcagctagaaagaaatatggtctggcacaatggcaggcttctccttgccactggtggaggagtttgtttcagtttagggattagtcgccattaccagctgatcagtggaacgtagagttggttcatccccaaaggagtgcttgctaatcatgaagaccttagaatagctgtgtgctgggggtaaacagaaagaattataaaaagaagagattaagaatgctttgtagcatgtaccataaactgaaatgtcccttattttgaaaacctgcttttaattctgctcatcccacgattcttaaaaatatagttctgtctagagaataatttaaagattttccttattatttaacatacatttggtgacagaaagagtgggaaaatgcactgatctcaagccaattgtgtatttgtttttgtaaaatttttataaaacatgctgatttctgtcattctgtttgccatgttcctatccccgtgagaactgtattctaaagcagcatcccctgttctgaatgatactctgcagagcacgcactctgaccctaatgctctgggactgggcatcctgtgctagaaggaacctgtgggttccacctgtccctcaaggctagagccctgagaagcaggagcctcgtgttagctccttctccctcccaaccagtggaggttcacagggctccggctcctgaaacctccagtagcccgagactttccttccacccccaccttccctaacgccatgcctgccgcaggtgcagtgcgaatgagatgattcctgccctgtcaatctcaggggagctactcttaatctcttctgggctgtggtcccctttgaggatctgatgaaagctgtgggcaagattttgcatgtaacgtcaggggctaccaggaaacccttttccagagcagggcaggcatcaatgcccatctcttatcagcaaattcttagcaaagtacaaagttgtagttctttacgaagggcaaaggcagcactctcatctgtaacctggtgatagctgtattattaagttgtatttttattactaccctcttcagctagcactagaaagaggttgcccgaggaagagcccacatcctggcacactgctccccatcaatatggttttgcatgtatgtttgttattggggaaaaaaaccagcacagatttttcaatatccctctcccgtcctattcaatggttttcttttgttgtttttcgtgatccattagattttatacagaaccaccaattacccaccggttggtttagactgttgactgggaagccaaatatcatgtctcccttacccagcgactcagcattgtagacttttgttctgttcatttaactacgtgctctctgcttttttcctagaaaggaattttcctgaattgaaatcagttaataaaactctttttctttctttttacagcttgtacctccttttaaacctcaagtaacatctgagacagatactagatattttgatgaagaatttacagctcagactattacaataacaccacctgaaaaatgtaagtaaatttagaaggcaattgataaatttctaatataatttctcctaatgtaattgaagaaaacagtcttttaaaaactcatctgatattttcaagatcaaattccacagtgacttactccattctatttaagaatattgaatattgaattgaatttaagaatattgagttcccagtggtaatatcaaaagactgcaagaaatgcttttctgggtaggacaaattatatagagagaaattgtagatgaaattacagactagctcttccttactgttcaccaatagattgttttgacaccaactgaaaggattgtgaaatagagactcccctctttcctagacttcgttcattcccacataaccttcagaattttgccagttttggtctcctacttacttaatagttttaaaattcatgtagagtcactcctttttacttagctctctcttaaatagtattatctgtgaagacataatttagtttgctaatacttttggatacctataaattacatatttatgaaaactgtgtgttcatgtaccacttcaagtcaattcatatacattagtatgtctcacacttggagaaataccataaataagtggagctgtaatgagggaaaaggtgatcagacataattgataaacattttcatgctgacagaggtctgtgtgtatcatcattaacttaagaatgtggataagattgcgtttcagggcaatatttggatggctgcaagaatgcttcaagttacacatctttgggttcacatcatagtttttctttccttttctttttgattccttccctatatgtcttctcctctcattccttttttggaggcagatttatccatagtgctgatgtggactcagtgtccgggagaggggcgattggaggctaatgctgtgccagagatggtcacaggcagcagattctactgtcgagaggcaaacaaggggtcatgtgggccaagaggtcttaatcttgggaccatggtctggccacaaggggattgtgaacaccctgaaagtgaagatatgatgacgtgtgtgtgcttttctttctttagattcacaaaaagttaaggtgctccaggtcctgaagttgggtcagccatagccagaagcagggcttaccaacttgaccgatgtccaggctaagttgtgaaataccaatccattgaagtgagctactcatggtcagtcctgtggtgaggcagagtttccactcaatcttgtgccattgctagaattttagaatcactaagagtcacagacaatgttggaaagcctgtggagtcatgggcaagtagctcagcgctgagtagaaatcatgggcataggccttggcctctgtccccagcatagactgtggcattagaattgtccaaaatgctgggtaacaccagtgagttttcggatcggcccatgggcagttcctgccatacagcctttgctaggccctttcatttggatataatcctaactgtaatcagaccacatcattcctctgcttaaaaccttccggtgccatcccattgcactctaaatccaaacttgctcacactggtttgcacagcactgactgatctgggccctgtccacctctctgacctcttcctgttccatcttcccccactgtccctgggttccagccacacctcgaacatgccacacgtcaccatgcctcgggctctggggacagtatttatggtgtccaggcctggaatgctcttcttccctgatcttacttggatggctccttcttgtccttcagctctaagcttacatgtcattccatcagagaaccttctttgacctcctagtctgaagagcatcagtctgacaacattccctctctctcttcattctctgcattggcaccttgacttgctggtatttttctgtttgtttggttagtgtctatttccgccactaacatgcagtgggttggagaggaaggatctagtttgtctcattcgttattagcccaagctcctagttagatgcctggcacagtgtgcgtattcaataatacttgttaggtgcatgaatacacagaatatggtgagggcctaggaacttcagagccgggaggacacccaggcttgcctcccctctgaatatccaaagcagatattgggataggaaggtcttgacaggtctctttcctcagtctcagcctctgagaaagtttccattcttaaatagagcatttggcatttgcgtacctttagagcaagtaaatatgttattttggaagtcatagaaataagaaggctctaaaatgtcaagccaggagtagatattttacttaagaaagctaaaagtgaaatcccaatttgggacatggagtgaggctgaaaaagcccaggactcagacctggggaacctgccttgtgtcctgcctgtgccccttacagttctgggcgatggccggtcactttgtcccctggaaaagcagggagcagggctgatagtctctcagtggcgtttttgtcctcccgtgtgcctgagaagccgtctctttaggagaggcaccgagagttctgccaatttgaatcaccctattttcaattctgctcaagcaccagattggctagtccatagtgttactgtatgctgtgggccagtccatttagggggatgataggcccaacgcagcaagcacctggctgcaggggtggtgtagtggagggccggcggacagggctgactaatgcgatgctcagaaatgtgagactagaaagaccagagcaaatcaaaatggatttgggtacaaataaggtcaattagaaactgttgtatatgactcttaggctagtcagtcattttttcatgattgacttgaatttcaaagccctagctttcaaggaccagaatctcttcgaaattcatcttacctgctttattccttactcgacacccgcggggcacttgtcctgatgagaatttgtcattagtgtgcattttattgctcaatctctaggacttctaaaatgagactgaaatgttagaaggtgttagaagtcccccagcacagtttctagaacataatttgaacctagttccttggcttcattaatcagcaatataaaagccatcaagaatgtttttcctggcatgtcatattttaccactgacagcacctctgttcttaaataacatgtgtcatttcagacatggatcatgctgtaaaagccctacaaccttggtgtctttaaatgataataggttcacttctagattgagacagagatacctaggaagcctgtacattgtagtaactttcaagatggttatcaaaatccacctgcaattgtaggaccacaaaagtctggcttttgtctaggcgcagtggtgcacacctgtaatcccagcactttgggaggccaaggcgggtggatcacttgaggtcaggaggagtctgagactagcctggccaacatggtgaaaccccctctctacaaaaaaaaatacaaaaattagccagacgtggtggtgcattcctgtgattccagccactcgggaggctgaggcaggaggatcgcttgaacccgggaggcagaagctgcactgagctgagatcacaacattgccctccagtctgggtgacagagcaagactctgtcttttaaaaaaaaaaaaaaaaaaaaaaaaaagtctggcttttgtgggtgtcagaaatggggtgtggtcctgccctgctcctgggccctggacagtacggaaacgagagcccagcaatgtcatctgtttctgacagggcacaccgcaattgaggggtggggagggcgctatggacttgctgtgtttttccctattcaggacctctgtagcaaggaaagtcagacggaagagctcagcagagtatgcccaggcaaagactagcatcgacgcatctgcaggcacctctgttcagcagcctctcctgctgtctgtgtggctcagcagagcgcagcgctcagcactgggggccatggggccctgggcttcctgtcttaggggagcagccttgatggtggttaactgcagcttctgggttcttctagggcaacggggcagtatttttagtttgacagttcctggatacatcctagattcccttaaggagcagataaaatgagaatcactgaaaccttgaacggtgattacattcaacataacctttttcttgcagctttgaatagtttaactggtaagaaaccgttgcagctccctaagtgctaacacacagaggttttgttgataaaagtccagggtagtaccattcgttagcaattgtcttcccacttgccaccttgcttgtataaaacagaatacagttattgtttagaacaaatcagcagttagaaaggcaaaatgttccattttctacaaacagctgcagtgacatgccagattgtcctcactggcgttaataatggaacagatttgggaatgtgtcatctttcgttatcgccattgatggtcctcctccttcctcttacagaaaaagagggtttctttgagatctggtcgcttttactgccatataatgccatttgttaaatgttctaagaaaatcaggcaactgatgttccttggatgcagggattcaagggatgtagcaagtagagttgatcattgtcttctttttccagataagtgtttttgaaaaacatagttcatgttcattatcatcactattccctatgcacagcctctcacagcaggaactaacttgtgtacattgacaggctccgactcagagtcagctgccacttcctccagctcccctcccaccgcagcccctgcccaggctctcagctcttttagggccatgatcagatgttcacgcctcattgtttccaagcctgacaacagaaaggggcaggaatgatggagggagatcattggctttaaagaatatcaaggattggggccctcagggatatctgtgaaatttcctagattcagaattgtgatgaatgtgttactgaagtgacagaatgaaggctgtctctcaattcttagctgacaccagcaagagtccctcctcttccaaaagggtgtctagcacctgcccctgttgagcatctggctaacctgggtgctgaacctcgccgggctggaatgagtcctggccatggccccaggagtccaggcagctcctgcccttcctggctgagcaggacaagcaccaggctccccactgctgtccagagccagctgcaggtttgctgtgcagaaacactgagtaaaataaagctgttggtgaggaaaattgtttatttgaaatgtgattggctcatgtcagaatctgaacattaaggttttagctgcccgtattctctagagagtttttatactctggggctcaaccacgggtacaccatcattcccagctccttccgtttttactgtagctaaaaatactgctgaaggtatttgatctaaaagatgtgtgtgacttgcttggtacaaatattggaaccaataactttataaggaggtagagatttccccaaatctcaataccttctagaaatgctgactgcagttacagtggtctatttgcagaagaagagagggcctccgagttcagtgtcttacacagagcagggagccacaaatgcttcttgatggatcagttctcacctaatacgaggatatcttctggtacattaggggtcagaaattttggctaatgccagcttgatcccatttctagaatcttctgcattaagagtgggatacagaaaagaaaaacagtgatacaagaatggaagtgtttattcttcagacaaaggcagagccccctcctcttcggagtgacagagtcagagcctcagtgcagtgggatctggcctgtatgctttctttgtttacacccacatccagcggatgctccctggagaggttagaatattcaaaaaaattggtaatgtacttcctatatgggtttgaggacatcgaattattttgcttgaagagaaaagggttgagtattggaaagattcactgatttccattgcaggacagcatatgattaaacaagcttagaggcaagcacgggggatttaaaatggagcacctcccccaggagactgtgaggccagggggcccttgggactttgttcaaagttctgcggtccttgggcctgacgggtgctcagcccagagcagatgcgtgggagcgcatgttgactgagtggctgaccacgtggccacataccaggaagagcttccaacagcacaggactgtcatcacaggacatttatgagaacagggtgctgatcatctgtgatctttgaaatacaggaaaccaggaaagctgacaggaggaacactgtgattgtcagcggcctgttttgatgcctttcaagtctcttccattgtttcctgatgagctaggactcagatgttgacatccttccctctttttctttcacttagtcccttcatgctaaagttttatcatagggaaattgggaaaggtgagttaagccagatgctagatgttgaatgaaatttcataagaagctttattttgcagttgcacttaaagcatcacaaagaaaaaatataagcacttgaagacattcgatgatgaattctatacagactttggatgctgtggatttcactgacttgcagttttgatatatgtggttacatgaaatgaaaggttactgaagactgctccttcttaaaaacttctgttttcttcaataccatttttttcactgtttcattgagtcttgaaattttgatgtcttagagatgattctatagtattatttcttcatagactatgtatttatgaaaatcagatgatttttgaagtataattactctacagcttattgatgaacacaagtttatgggagctattgcctctgttcatctttcctatgttcagagtttaaaaaacatagactagagataatgttgcaaaaaatgaatgtgtaaaattaaaatagatgtttcctgcccacagatgatgaggatggtatggactgcatggacaatgagaggcggccgcatttccctcaattttcctactctgcaagtggacgagaataagtctctttcattctgctacttcactgtcatcttcaatttattactgaaaatgattcctggacatcaccagtcctagctcttacacatagcaggggcaccttccgacatcccagaccagccaagggtcctcacccctcgccacctttcaccctcatgaaaacacacatacacgcaaatacactccagtttttgtttttgcatgaaattgtatctcagtctaaggtctcatgctgttgctgctactgtcttactattatagcaactttaagaagtaattttccaacctttggaagtcatgagcccaccattgttcatttgtgcaccaattatcatcttttgatcttttagtttttccctcagtgaaggctaaatgagatacactgattctaggtacattttttaactttctagaagagaaaaactaactagactaagaagatttagtttataaattcagaacaagcaattgtggaagggtggtggcgtgcatatgtaaagcacatcagatccgtgcgtgaagtaggcatatatcactaagctgtggctggaattgattaggaagcatttggtagaaggactgaacaactgttgggatatatatatatatatataattttttttttttaaattcctggtggatactgtagaagaagcccatatcacatgtggatgtcgagacttcacgggcaatcatgagcaagtgaacactgttctaccaagaactgaaggcatatgcacagtcaaggtcacttaaagggtcttatgaaacaatttgagccagagagcatctttcccctgtgcttggaaaccttttttccttcttgacatttatcacctctgatggctgaagaatgtagacaggtataatgatactgcttttcaccaaaatttctacaccaaggtaaacaggtgtttgccttatttaattttttactttcagttctacgtgaattagctttttctcagatgttgaaactttgaatgtccttttatgattttgtttatattgcagtagtatttattttttagtgatgagaattgtatgtcatgttagcaaacgcagctccaacttatataaaatagacttactgcagttacttttgacccatgtgcaaggattgtacacgctgatgagaatcatgcactttttctcctctgttaaaaaaaatgataaggctctgaaatggaatatattggttagaatttggctttgggagaagagatgctgccatttaaccccttggtactgaaaatgagaaaatccccaactatgcatgccaaggggttaatgaaacaaatagctgttgacgtttgctcatttaagaatttgaaacgttatgatgacctggcaacaaaaagtaatgaagaaaattgagacctgagtgaagataagaaatgatctttacgtggcaaaatgaacacatcttgagtatttaggaaatgggcagtgaaggctaagaacctggtgtgtttcttgggatcatggtacatttatcactgaattaagccatcagggaaaaaacaacaaaaaaagagaacacctccagcttttctttttctgtatatactcatgtcccccagattccaacatttctcactgaaagggggcatgtatgcaaacctcatctttctccttcattaatgatgatcttcagattaaaccctttggtgctaggagctgacaatttccaaagcagcctgtgaagtcctaggggctgggggccactcttgcggcaagcagaaggccatcctactccgcggagtgatcatggaaatgtattttagttaaactctgacagctcccaaacggaagactacagcatgacgtagtattatgattgcattgtatgaaagagcaagtgactttctaagtaggatgaatcatattcatatgcagatgtcttagcctcttgacgctggaagtgtggatttatagctatgaaaccactgctggcagtgggtgggccactgggactgacgggggttaaagggcattttactaaggcagctaagacatattcagacatcaacgttatccttctttttcatatttctacctgagtgaagttcatccttagtattgagtaggaagttacagtaaatggtagttcattcttacttacacacatagctaatcttttttttttcacttggaattatgttgaatgtttcattttgacaaaaaagtagactagaaggtatgttctttaagttgtcttgcatccattatataagaaagaaacaggtgagaggaagagcagaaagctgagactggctgatgttcagagcacttactcctctagagggaaagcatgacaccgaacactaagcacacagctttttgttgttttggttttttctcccgcaaatcttaaagtgattcccatgaccttggccaaggacacttcttaaagattaatgactggcactgacattgccccaggcgggccactcctcacactggctctcagttcccagccatgcctggggctcagtcacttctattccaccctctgagactccattggtgtcacacaaggtgtcttcttggctttgattttgagaatcccctattttcacttccagatctgtcagctgccatggaggaataatagaaaaccagaaatgcgtgtagagggagatttctaaaacttcccttgtgtcgcccatagttgtagttttgggttctggcaggtggaacaccctgaaacctggaatcattctatgagaatacagttcagactttgcagactccagcccatactaactgtcatgaagcttgacttcttgtcataatgcagccatcttggaggaaattggccatttctgcttagatggttggcagggtcgcgctcagctttgctttctacactaattacatagcattattcaagtattgttttccatttcccatccctgatttccagcttcttaaagctgactgttcttgcaggggccacttgcttctcctagagtacaaaagtaagggccttccttactaactgcagggtctctctattacacctcaacatacacactttgctgctactgtttgtactgtctacagtagaatttccttatcttgctcctggtagtgcattacaggcaagcatgaaatgtaaagtatttatttaaataaaaagaaaacctctaaattggtaattgaattacctccctgtagctttatagtttgtgacatttcttgaccttgctagttctttcattagatctgcgcaagatctagtcatctggttaaggattttaagcagatgcaactataaacccaagaaactgtattactattactgttggtcatactaaacctgtctatttcctgaagtatatgacccacaaggatgtggaataactaggagaaactgtttttgtacactgtacatccttagtatttttacacgtatatgatagggatgaacatgattttccttcgtacagacagcttaaataaagcactatgtcaatctgctacttctctgtttattgttgttggatgtggttctataatccccccaaattaaatcttctttaatgaaaacatgatttttaatagccccagctggtattaacctaccttgtataaaatgtgacaggaaaatatagaaataattccttgtagctcacacacacacacataggggatcatttttacttcagtgaaatggcagtagtgcggttgtgcaaactttgatgaacggctgcttctgaggggaaacgctgacctctcagcactggatttaggatggatgtactgtgaagccagggatgaaggaggtctcagaccctggggacattcagacccgaatcatctatacaacacacggtttggacccagaatctgaaggaatgtagcttttcattaacgtcttcctgataatgtactgctctgcatatttcctttcttagagtgtatttctaacaacatgtcatggcaaattaacaaacttagacgtgggtgatgtagatgggtaggatggctggactgcagtctgacttcacgttgaatcattctggatggggcctttttctgattttacctcataaagctactattgtagaaacttggctttgctcctgtgacgaagccagacagaggaatggcttttgggaccagagtgagtcaagcatgtatgtgtatgtcacacggccaaatttgagggcattctcacatgtgctcttctctcaaaaccactggggttgacagatccaggaggctaaaaaaaagtgacctctataattctttaaaggtgctatttttagaatattgtataatttattcacagtatatctaaaacagaattaaggacaattaaaatatcttatgtgacagcctttatgtctagcacatttgatgaaataaaaaacttctgaatctgaatagaagttctactgtttcaggcttgaaccttttacatgctcaagagattcaaatggtctctgtgtgtagatcatgccaccgcctccaaagcctaatccacatcacttctgagaggcaaggctgagcatatggtgacatcagctctgtgttgagatggtgatgaggatgatggctcgctggccaggcagggcagccgaaggtcagggacctgtcctaactaactgcagccttgcctttagtgtttgtcattctcagatacaacacggtatgtccagtgtccgtttttattactttaaagcatttgagggcttaattgtgtatagtagaaatactattttagacaaataattatctgtgtacagatatttgatatactctaagtaaattttctaatttcactaagtacgtttttaggctcctctcaaatactgcgtattgaagaaaaaaatctgacaccaccgagccaaagatgcttttttgtctgttttcgttgtttaacagaatggaaagagtaatgcatagtgcttcctggtgtctcctgattgattgattgtgcacaaagtaggacgataaataaataaaatggagtctgatgggacattgattaaaggtgaaggatgattgatatatagatcatgaaaagaaaaatgaatggcaggaaaaaaagtttggtccttaatatactttggcctagttaaaatatgtgcctttttggtgtgttttgttcatcactacaagataaaaaggaaacattacaactcaagtctttaaaaagttcatttattgaaaatcatatgtataacctagcatacgaatgagcagatttaaacacataacttcaagccatttctgaaaacatacaccaggagctctgctcagctagagtcagactccagctccagcccgactgcgtgcggggacagcgcccgcgttgatgaggaccagccccactgcaggctgaggcggtgtcaccctgggaaggtcgtggtgcgttgtggcatattaagtctaaaccagatgaatgtaaatatctctttgtaaatcatttatttcactctgttccatccaggtcagcaatcagattgtggcatgctgggtaactggaaaaaataataaaaagtaagtttcaatagctcatgttcttcaatgttatttgtcttctcatttgctggtttagtcaccttttatgatgaaaactgttgttggagaaaaaaacctgttgctaaaaatgtggaaattatatgaaaagtttgtgcctcatcttgtccacatcaaagcccttcacatatgaaataaggttaactggtttaatgggttaaatttgaagacaacctagacaaaagacacgcctgcctcttaaataaggacagtctggtgttaggacatggccagagagccatctcttctgtccgggaaaggacacattgatttgtgccataatctgtttactgaaaatttatctgaccttaacggcaggtaattctagaacaaaaacagggtgtaggccaagtgcccctaagaaattcctcgtgaaacaatacaagctgaaacacctccaaatttgtaactgcaagcaatttattgtaacctatgaaaaagtactttcacatggaaacctcacatgtgttggaagaggggattgggtgtactgaggtctcttagttttacgcagatacaaatgttccaaagtagcttcatgcagatcaggttgggggagaatcacaagttcagaaagtattgaatactgttcctggcctctgctgccatggctgcccaaattagtttaaaccacatcaggaactagagtcagaagccactggaaatgtttccactccacaaagcatgtctggagtttctactgtgcactgtgtgggaaggtgactgggccacagtcctcgccctctagattgtgaagtccagagaaaagccaggatggtattttccaaatcccggtttctacgtcagataaattgggacgcactgcagggccaggggcccaatctggtccctctttctttagttaggaaccatcttccaaaaagagaagtgggcctgcccctctccagtgaggattttccaagctggactccaagggaggactctatcaacctaatttaagccatcattaacatggggatttccaagacagggcaatgagtgaaactgaatccgcattcaagagaaatatatgaacatcagcctgttgccttttatgaaaaatgagaaaaagtaatgtttacatttcaagtagatttcccagtgtgtgagagaccctgaggacaactttttcttgaacaggtctgtgagtagtggggtggtctcagcagggtagttagagtaggtggggggcctggcctcaggctgaatgcaggtggggctccggcaggaggcctcactcctcctcgtaaacctgccatcccatgcacacagccctcccaggcccgtggagccaggtggacaatttcctgggcccacgggatgctttgttctccaggccctgtctgagtggcccatgaggagtccaccccatgcactatgccctagagccctgccattgcagaggggactcccttctgtcctcagtgggatactgacagcacggagactgccaccaacacgatctgattgtcaaacgcagggtttgcaccaagctgacgtgccctccaggccaggtgatcgaactgacccagcacagtcctgctaaatgactggtttgaatggccctccacccctgctccatggattggccacataaggcaggtggcctggtggcctcgctcttgacacagtggcttcctaactttagaaatgctaggatgactgaatacaaaagggataagcataaatcccaacagataacacttcaaaagaaaaacaacccaacagtggctcacacctgtaatcccagtgctttgggaggctggggcaataggatcgcttgagtccaggagttcgagaccagcctgggcaacatagtgagacctcatctctacaaaaaaaattgtaaaaattagccatgtgtggtggcgcacccctgtagtcccagcgactcaaaaggctgatgtaggagaattgctgtagcccagaattcaaggctgcagtgatgaattttgggtagagaacacacccacgtacacacaatacagaataggcgtaaagacctgaagtaaaagtaaaatgtgttgcggaattttttgataagctccaggaaacaggcatttctcatgatgagtctacataatgcctgtgggctcccaggccacctagcaatttatcactatcggagctgttccagaaacgggtgacctcctgattccgtgggcctgcatgggggtgacacagatgtacgggcctcaccaggaaccaatcaaaagtcagcctgattccttcctgcggcagatcagccatggccatctctatgggctttgtatttcctgcggttcaggtgagaagccccatatccatccccactttcacactgttgaacttaccgttcactgctcaacgcccccccccccacccgtgcctacagccgtgcctgacccatggtgagcgttcagtcagcactggagggctggataatttgtcctaggaggtcaccgttttgtcgcctccatttgctgactctttggtaacacacatttctctgaccgagacagaagccttagttactgcccacatctggcttgtctgccattagggatatccacgatgcttatttccaggaagtcctgtcatcaacaccacagtgatcatggtctcgtccaggagagtagagcgtgcgtatgccagtgggacatgagccctcagccagtgtctcccgtccttctgcccttccatttgtcatcatggcccttgctgtggccctcctgtggctgtcctgcagctcagaggggggcgacagggcgccctggccactgctcccctgccgtgctgtccacaggtggtggaaacgtgcccccatctgcaggcacacagctgctaacccattttctttgttctcattttaaatcctatcggagtcatctctccacaaaccctgcctcatttatttctaaagtttgttaagttctgagtgtaagaaatcagttgctctgggtgacctgaactgttccccaggcaaccacactgtggggtccagccagcctttgctgctgctttgttcccaaaccagccagaagtggcagcccggggagatggtggcacccctcgcccctgctcacaggagacctgcccgggcttcgcacttcactgtctccgtgggtggctctagccaacccttctgaaggtaacaaccccttccccccctgctgtccgctctgctcactggcacgctgtctctgtttggccaagtcaaaacgtggtcctgttccttgtgtgtctggcaataaagcatccatttgtaactggagagggcaggcccctccccctacctccatctggggcatttcaaagctggccctgagttgacagagctccagggcagcccctgcctcgcttggtggctcgcctcccgcctccgcctcgtgttctgggcaccggggccagggctcggcagctgttccagccaggcccggctccgcccgcacccgctcgggtacctgcccccatccacacatcctgtggcctgagaagaagttcatttccctgcccagccacttcccaattccattcacttcatttctctgggccttatttttctatctgtacaaaatggttatttatctcaaatggccctttcaagcccacaatgatctcagcactaatcctgttggtttcataatcatctgtgctgggctctgggtaatatgaggcacttccttttaaagggaagctggttctttctttttctctgccagaaatcaagtgacatgaaagctaacacatgtctctgaagcaacgcagagctgagattcgaatccaggcagtttgacctcaaagtccagactctcccatgcgaggctctcctgcttgctctggcagatgaggggcagccagtttgatatctacggaattaagctgccaaattgggaaggcaacctggatgaaataagccacgtgagctctggctcgccaccaacgcactgaggagagaggtgccctcagcatgctgggcagaacgtcggggaaacgcggccttcgagcaggaccgcccacctgtcagaagggagcactcctctacagagccgaggggcagtcagccaccctcaggcccctgcggccctgctgtccccagcacagcgactgaagttctcactgaggggcctcgtcccctccgggtcaggcctttccaggaacctggctctgccagctgcaaagcaggcgggggctcacggttaaggccatcgcagggcagcggccattcttccctcctggctgcccggctgggcccctgataacagcctccacaccgcagtcagagttcaaagccctccttcccttccaccgcagggcttggctttgctgcttctgggctccgagaaaggaacagggccgcagaaaccagaggaatggaaaggtatccacagagaaggccgccttgcagacatgaagtgggacgttccgtaagacagcatctcgagctggacttggcggggagagggaggcggccccgcacaggccagggaggccccagcacacatgaggccggggtggaggccctggctctgcggtgccacctgtcctccccagggcgcacccaagcccaagggttccttcccaaccgtggggtctgagtttgtcatcttccagctttctcaagtcccctgagtcatgagaacttcctctacacacaggcaggtctgtgttttatatgaaccatgtttccatggtaaatagattttaagaattcccaaaggacagacagtgtcaccaacagcagagagtggagcctctggctgcctcatgtttgaaagtgttaaaaataaagacaacactgacatttggggttgtaatgtgacggaattacagtcttttaaaggcaagaaccacttatctacactacatgcaatattcagtgttttgttcacttgtctaattggattaaaatatttagctccctttaaaatcttgattgtgaatttatattgtgaaatgtaatgtctgactcaggaagcaataagtagagtgaatgtatctgaaggaatataaaattcaattgacttttctcccatgattcttattctgaaagtactcactcttggacaaagtgaactgttaacggaagagcaagtctggctaaaatgaagccctatgcgcttttcaatattaattatacacggggcgctcagtcaaaaaacaaaaagtttaactgtctgctgttggaggtgtttggggaagtttctccgaaggtcgcgagatgcttatgttagacatgcagcacccagggtcttgtgtcattttttaaaaacactcaggcagcagggagttaatgacattttagctgcatatgttcaagtttatttaaaaaaatatgcaagtcactttggttgacagtgtcttgtacacagttttgaaagaatcagggcaaactttaacagagtcagtttttatttgaaaaatattttctgggaatgtatcagtgtttatttttgagactgacaattcgggtgaaaatcaggataaaaacaaaaaaacaacaatttggttgaaatcaaattgtttgttttcatctatttagaattctttccaaaaaatcttggttcaggaggaggctttttaatttattttattcaatgtatttgctgttctattcaagcgccatctgtcttacaggtagctaactttgtggtagctcctaagtcagctgggcgaggcccccagggctcctggaaggaccacagtaaattaggtgacacctccaaggcctaacatgggcagcctgcagcagctccgccttgcagccaggcctccctcggcagggagtcttgctccctgagagctgtcacttttctagaacctcccttctccctttgcttccagttgcaatgggcctttcctcccttcatcatcttctgtgtctctgtgtcccctgcttgttttcggctctcttctatgagtcctttggtataatgagataatgtcgatgatcttgaatataatcacatatggctgctggatccatgcacaagtttaaatcaaattagaaagtaaattcactgccaagaatgcttaaaagtcatagggccaactgattaaccactgacaagtcagtttccgactctgttttctaaactgtaagtgattcatatgaggggactaaaagggaatcactccccagattgaacactgcagacagaaccaagcagcctgctcaggatacgacggctaccagaaaatgcaagtcagccaaaaccgtattcattaccaaataagaaagcagacacagaaaatcatcttgatggttgagaccatcctctaagtggacagataatttctgttttcccctgtcccagatgccattctccccaagactcatgtttcctcaccagctggctccaaccttcctagccagatgttagagcccccaggctctgggccgcagacccctgaccctgctccaagctgtcaggccctgcccaaactcccctgagacccaccaccctcaccccgaatccccctccccccacccccaccaccaaggtttcagcctcccccagccagggcctgcctctcaagagggcgagagtgcgactacccagcccagtctcaaacaaaagacaggccagggtgtgtgtctggaggccctgaccctcccggaatacagagtgtggggaactgcatctaggcaaagctgggctagtgcttcagtgtctgtttctccacaaggacaagtaagagccatttcatgacatttaaaagctattttcttgaagttgtttccgaacccaggtgaggcaggagatcaataatgccattatttgtagtcaccctaaactaagaacaagccaagaggccgggcaaagctcatgcctgtaatgccagcactttgggaggccaaggtgggcagatcacctgaggtcaggagttcgagaccagcctggcctacgtggagaaacccagtctctactaaaaatacaaaattagccaggcgtggtggcaggcacctgtaatcccagctacttgggaggctgaggcaggagaattgcttgaacccaggaggcagaggttgcagtaggccaagaccatgccattgtactccagcctgggcgacaagaacaaaactcatcaaaaaaaaaaaaaaaaaaaaaaacagctgggcgcagtggctcacgcctgtaatcccagcactttaggaggctaaggtgggcggatcatttgaggtcaggagttcaagaccagcctggccaacatggcgaaaccccgtttctattaaaaatacaaaaaaattagctaggtgtggtggtgggtgcctgtaatcccagctacttgggagcctgaggcaggagaatcacttgaagccgggaggcggaggttgcagtgagcagagattgcaccactgtactccagtccgggtgacggagcaagactccgtctcaaaaaaaaaaaaaaaaaaaaaaaagccaagaaacgagccgagagcttgagccagtgccctgagtcctgcccaccgcagacagcgccggggagcggggaggatgggggttctcgtggccaaaagcatccatgtggcagctaccactaccaggggctccctctgccagccatgttgttgtgagtgtttcagaattcaagcagaaacaattagaataatgaagcctgccaacaggctagacacttcctgttggaggccacaggccagcctgagccccaccaccaggggcagcggggctcaggacccaggacagggagggaaggaaaggggtggactttgctttggaaccattgcccgacccattctcttctgggtattaagtggacagagatgtttagagtttgacatgcaaaattaagttaagcttaactcatccaggctgagaaaacggaagcctttagttaaaccatctctaacccggacatgaggacagctctaaccctcagctgcccaagatctggacccacaggccactccaggaaaacagagagggtggctgagcactccggagccctcaggcggcaccgcatccaaaatacctgctcgaacctacagcagcctcgcccacatcatggctcagcagaagcctaactcacaactcaagctgattccatgacaagaaggcatcgcagaggctgaagcccactgacagcccctacctagaggtgaaggccaggcttagccagaaaaagcaggctctgggtttagatattcagcagagagcttgcaaacctggatccctgcctcctctctgaccactagtatttgcaactgaaagccaacattccctctaccaaatttcttttgtcatgttcatattaaaataactccaagtgtaatatttgaatctgaaaggccgctttagagatgagccagatgggccagtatcagatagcacaggaatgggcaaatcattgctgttgcttcaggcaaaagaagaaagaaagacctgctagtttttctgaggattttttgaggtttggggtttttttaatgcgttttgtgaaaattttgcaactcatttggcaatagccagatttttaaagccctggaagaagcttctaagcatcggtgatccatgttaagatctaagtgtgctgtaaagcaggcagatggggagttaaaaggcaaagcccacgttctcctgatctagtccagagcccaaaggaagctgccgtgtgctccagcttccacggaagactccccacaacctgaggtctgacagagttcttggctttagaggctgaagattcactcatgccaggagtcacggtccctccctcctatgtgacaagagcctagtcacctgccaggagacctagtggctccagtggtcctgatctttggctggccaggcctaaagcaggtgctgctggggccctccctggggacctgcccacagggctgggttctgggctgggtctggtggaggatgagggggtcatcctgaaagcagaggggaggggagtggcactggtcccacagctgctgctctgcaggcctctgccttccctgaacctctcccaggaccctctgaagatgagggagaaaggaaacaccctcacacgtcctcagcctgtgtgcccaagggcccgtggggcatcccgcctgcactcagcactcccagtagcccgtgaagccaggcgtgcaccatgcccactgtgcagaggagaaactgaggctggaaaaaggcttaagttacttgtccgaagcgggggcaggggattcagcacagtgacacaacctggaataattctctgttctttccagctccaaacacttcagaggttttcaaaatgtagtgtcgtccagaatcatcccaacagcttggcaaaattcaggttccagggccctgccatggagcgtgccaggtgaggcctcgcctcctagattagctgtggcagtgcggctgtggctcggactttgagcggcccgctcccccacagtccctgggagcagtctcagaagcatggggacagtagaggcatttccacctccaggccttagctccgtggcgcctgggtgtgctcatttactgtctgtgaacacatgtttggcagagggattttggaccgagtgggaaaagtcagtacttacaggttccttgagcacagggtcattttgtgaggagaatgagactcctcttcgttttcatttccagatgcatttttcatattaatcattccaagcacttactgcctgaagtccccagggcactcacagagcacctgggtgcaatcctaattaaaggcggaggccttggtcagcccacggaccacctcattatcctaacaaactgcttgacggggcaaaatgcacagcctctctgacaggaagagaagcgatttagcaaacgaggtttcatactgtgttccaaattcaccgggacactttccttcctcccttttccctgctggtggccccggatctaacctgaatggggaaagcctgggctgtggagtcaggcttagcctccgtttgcggtgtccctacttgccagctgtaatgcttgtctgggccttagtttccctatctaaaccatgaagacaataaagtcagcatcgcctgcttgttcaagggtaaagggaattaatgcatgttctgtgtgtaacactgccgggtgctctgcaagcactccagatattagcccagtaatcagtcagctaatttaggatgagatgcctgccttccattcaagacgactttgctaattgggaacacctctttcctcaaccaattcaaaccatacacgaccttcagaggcagctcaaggccaccatcctccaaaaagcctgttctgccgcccacggccgtcctcccgcttctccctgctctcgcaccctccgcagcctgcacggcgcaacttggcactcggtgtggttcgttgattcgcgggccggggtctgttcacctgcacggactttaactccctcaccaggacgggcccatggctccgcttctctgggtcctgcactgtgcccagcacagtcttcgggacctccctcccagcttactgctaaccgatgtgatccgtgagaaagccggcctgttgaggtgcataaaagatccacctgtagacgcccgcccaaggactcccacctgcgccgcgttctgcacagtacctgggtccgcagccggtccacctcttccgacaggctctgcctctccaggagaagctggttctgcttgctgaggagctgcaccagctgctgggctgtggcctggctgtgcttatccagctgccttagcctggagaaaaatccaccgcagaattaaagagggataacgtcagcctttcaacaggcccaggggctgtgtgtatctgagggaagcccctgatagggaaccatgagcaggacgcctagggtgaccctgaggtgccaggctctggctggcactaggtccttggtacgcactgtgtgaaggtaacattctagcaaatgtgcgtgggaactgggagccatctcagtacactatcaattagaaaacacgcagataagtggggtaagtagaaggaaaaggaagctttgaactcccaagcagaggtcaaagatgaggggcctaaatgccgccattgttcagctggaaaggtctctggcaggctgagcagacggccgccccggctggggaagtgggtgagggccgtggaaacactgaagtaagggttttccattattaatcactcagtcaatcacgagctccggcatcgctgaccagatgtctttaaagatcctaaatttgtcattctgctgatgggcgctcctctccagacttgctaattcactcagaccattatcctcatctgtccacagtcggcttcctacagccagcagcacagtcacccatggaactgttggctttggattaaatgtggaattgaacgactacccagaagtgttctggaaagaagcgagatgtgtggcctgcctcaccgtcctcacccatcaaaagcaccagcaggcacgttaactcgaattctcacaaggaaaaggccattaaagctcaaggtgcatttcaaactccaggctac

SEQ ID NO: 193 - DNA, 43457 bp, Homo sapiens
  source 1..43457: mol_type = genomic DNA
gctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccggtaggaccccggggcgggttcgcgcgtccgcggcgagactagagctctcctcagtcgggcaagagtcgcggggcggggctcacagcaggccgtgcctgtttggggacagggttctctgaggggtgcagtgctcagatcccgggggtatgtggcggggaatgcggggaccacgcagagcccgaggtgaagcttgtttggtggcgtcgtgtgcgcggccagcatttacgcaggatctggctgcgtccctaaaaaaagcgtgaatcgtgttttcgggattgagccagtcggccaggggagcgcggactgggcgccctaggtgagggcttgttctggagtgcacaggtgcgtgggagtgttgctagggcccgtgctgtgtccgtggtgagagtttgccctgtgttcccttggtgccttggtgagtggggtgttcattagggcttggacagtacccgcggtaagggttgcagtgcgtctgctgtgccccatgtgctgggctgggcgagcaggggcctggccaggtgttgctgggagcgtgctgtgcgtaagtggcctgtgtgcagagttcactgtgggcaagacagctcaactgtttgctttgaatggagtgagcgcggactctggggctagggagggcatgttgagtgagagcaggctctcggtgcctggggttagagaggtggtaagggcgcgccatgctttttgtgccttctgtgaacagtctccgtgttacctgagctcctattagtttgtaaatggctgcttttttggggggtgggtgggccatcgagtcttcttcctgttcccaaccaatatagatagtatctgattccattgcctaatggctttttgacattgttttccttcttttcattactttgagtcatatttgagagatgtgaaacaacctaaaaaacaatggtagccaaacctagtgagaaattagtatcctaacaaaggaaggcagataatgttaatcttgttttcccctgcagctcataagctaaagcttaaggcctatcccactaaatttattttgtatttcattgaatggaatcaatacttttaaaaatgcatgctaggccaggcgcagtggctcacgcctgtgatcccagcgctttgggaggcccaggcggggtgattgcctgtgcccaggagttcaagatcaacctgggcaacatggcaaaaccttgtctctacaaaaaaatacaaaaattagctgggcatggtggtttatgcccgtggtcccagctactctgggggccgaggtaggagattcacttgagcccaggaggtgaaggctgcagtgagctgtgatcatgccactgcactccagcctagatgacagagtgagaccctgtcaaaacaaaacaaacaaacaaaaaaaaaacccgctaagaaatacatgcttattgtgcgatacgaacagaatcaaaagacagctatttttaatattttggcatatttgtttctgccttcatgtgcgcgtcatgtgtatctatgtccaaattatatttaggatccaataacatgtatagtttctacgttgcatttttttccttaggagcattcattcaacgaatatgggtcttgtatgtctggtgctattacactggtaggcaataacaaaccattcctattttcttgatccttttttcactatttgtttacacacacattcatgcaggaagataagcagggactttgttttgctcaatgataagtgctcagtgccgggaacacagtagataaccaataaattatttgctaaaatgtattgggattggcagacattaaaatccaaaacataatagtgacaaataaattatgaaccaagggaagtgctctggaggcaagcagtataattttcagatataaatctgacagcatttaacaaatgattggagagagggaaggcttctctgctcatcaaacagactttggggcatctgtgcttgctgttccctcagcccaggaacattctcctcctgacctgctgcagaaacagtctcgctcttctgcaaactcagctggaatgttacaccctcagagaccttctctgatcaccccacctcgcgacccccccatctcaggttgaacacatacaacccagttcaagtccctcttcacttgtaatcacccttttaaaatgaccttttctgttctttgtctcaccctgtcagaatgcagggatcctgtctgtcttgtcgcacttgtggttccaaaagcccgatttgtttacctctgtatctgttaaataccagaaaattaaatatactatttggctggggcttagagcctaggaaaaagttcctcctgcctccaagaggaaggttctttaaagagctatgctcaggatggtctttctgcggtacctaaaaagctagggcagtggcagctgagagccagaaaggatctgtctcccctatttgttgactctgcagggcttccagtacttcagtcttgcatctcactgatcattaaaacgttcattttgaaggagggtaatgggagtagggagtagtggtgataagaagaaaacaaaaggacttttttttttttcttttaagattaatgtttagaataggcttagtgctagaagttcagcctggacagcataagcagacctcacctatacaaaacatgtaaaaaaaaaaaaaaaaaattagccaggtgtgatgttgcatgcctgtggtcctagctacttgggagactgaagggggaggatcactggagcccctcatggtcaaggctgcagtgagccctgatcatactccagcttggataacagagcaagagaccctgtctcaaaacaaaacaaaacacacacacatacacacacaaacaaacaaaaaaagaaacaaaataggaagctgaagaagataatgaaagcgatttgaaatagaggaacatagaattatgaaatgaatagggtgcaacatggaaaataacaaaactaagaatgaagagaaggaaaagcaaggttaagtttgaggttcataagggtaaatcaagacaggtatgaaacctagagaaagtaaaaatgagaagtcacgatgctaggcagagagaatacgtgaattaaaataaacattcaatttttggagcaactcactctcacaaggagaaggtttcgtaagcagacagtgctgtgcatgggagacctgccctctcaaaggtagttgccaaatggttccagatagttgaaggaaacatgtatcaaatttcaggccagtctcattcctccagaagaggagctgcttttttggacaaaacccgcaatctcctgttgtgcgtggtctcttctgcctattttaggtgttttccttatttccagtgaaagaagccaagatcagtaagcacttacacagtagcgtctcagtttccttactgggcatactacaatgcaaagagagcagtccatatctggtcacctgccaggataccagaagactgggagataggcagcacaagaaatggcctaatcttctttctccattgtgctgtagaatgattattttcaatatgaaattgattacaatatattcttcacattgttttgtgtttgacagcagtggattttgaataccaaattttttttgaatagctactctgagtgacatattgtgctgggtgttgtggccacatggatgaatggagttggccttgttaactattaaacacaaaagcatgtgatagttacctgagagatccatgcaggggagagtccaggggaaggtgactgatcactgcttcccagggggaggcagaaaatgcttcctggaggagatgatgggtggattaaggaagatgagttgagcaggagttgtagctaccagccagggaggaagggtattcagagcagaggaagcaaggtgagcaaaggcaccaagatgtgacactactggactgccaagctattcagtgtggcagagtagggcaaaggaggcaagaaagaaggaagaggattaaatcacagggtgagtaattctgaaaagcaacagactcatcaggagtaaacactcaccatcataaattcagactttcacgttattacctgtccttttagggcaacttgagccttttgtttgacttagcacaacatgaatccaaactagggttgttttgattttcccaggcacggtagcagacaatttcttgaatacttatttgcagatagagtttgtcagtgtcagcatttcttgtgcacccacaaggtgagtatagtagaaaaagaagaacatggttcttgacccccaggaacttgccttttaagagaagacaccctgaagtgacaagctgttataagttagtgttttaaactatggaagaacaatctgagcagagtactctatactgtagaagacttcttagaggagaagttacttttgaaatgaatttagaaaaatgtggggaaagatgcatccatatatattttaagatcaaagacattaatgctgtctcttcagtttattgtcgaatgtttattcccaaacaaaccaaaagctaataggatgttacttaaaacatgcaagtcccatttcctccactgctatgagcactcaggtaaaagcatggaacagtcatttaaaatcttgccaagggcctttctgttttttctgtactacctgctgccagaccacagtccatggctgatgaaagtgatatcagtacttcatcttcatgttcctattctcttatccctagatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagtaagtaaacaaacctcttttttttttctgcttgctctagagatttgcatacattttggggtacatattccactacggtgatgatgattttcttcttgtaaaatgaggttcaagataacaatgcatttttgcaagctttgagaaatcaaaatctccaagaaatcattttcctggcaatagattgcctgggtgaatatgaatcttaagtttgcccttataataagtaaataatgaaaattatattcccacccattcaaaagagcactgcagaattttgattttgattcagatctgttttataactggattgaaaactatcaaaattattttctttcaggagaaacatgtccatatatacgggatcctttaaatggccaagcagtccctgcaaatgggacttacgagtttggttatcagatgcactttatttgtaatgaggggtaagttgctccttagaggaaataagggaagtgttagtaattttatttttgttttgcttctcttcttaagcattcctgtaaacttaattttgctttctatgtgacaagttatacttctagccaaacaactcttggatgttttatggagataggcaagatatatagtaaatagaaagtaattgatatttaaggaaagcaaaactacttgctgtttctgacaataagtctgttgtaagcattaagaatgtagtaatcatgagaatttgtccttcacaactgagtgtcccctatttaaatctgccaactcttagagttgaagtagggctcacaaaaatgagaaatagaattgccaactaaagatacacttgtatccagatgactctgtaaagtgttatcagaccaaaactgacgcggttagcctttaccatcatgttgatcaaaatctctcagttgaaaaaccttatttttgagactgctacagtgtgaagcatctcaagagcaggtactgagccctcggtaatagcctttgttctgtagggttttgaagttgtatatattggagatactagacatttaagataaatgtgcatttatagagtaaatgtaagtattctgctataacagaatacttgaggctaggcatttataaagaaaagaaatgtatttggctcatatttctggaggctggagagttcaaggggatggcagtagtgtctggcaagggcttttgtgctgcatcataacatgctggaaagtgaaagggaaatttagcatgtgcaaaaaagacaaagcacaagggagggggttctcgctttataacaacgtgctcttatggtaatgaatccaagcctacaagaatgagaactcattccctgaagaattaatgaagaccctctagaaaggcattatacctcttaatgacctagtcatttcttaaaggccccaccacctctcaatgctgttacactggcaattaaatttcaatatgagttttggtagagacaaaccagattcaaacaatagcagtaacacaccataatatagaaaaagtaagtgagtcttggaggaaaaatcagctgtgactatgtaaggcaactgacagtttttaaaatttggtcaagtagaaatattggaatattcagttgacacatactgcttgctaggcacaccgagggataccaaaactttaagacagtgaccttcctaaaagaagttctaaccttattgagaaataatatatactgagagcaataaaagcaaaatactaaatgagaaataccaaataagtagaattattcatgataattactctaagagtccagaaggaggagagattcctgtgaatttaaatcagggaagatttcattgagtataggggtatacttaatgaaagtattcttatactcagtgagctattcctagaaatacactctgttctaaataatattaatagaagctaaaactcatgtagcactatctatgtgccaaatgctaacttatctaatcccctaaacaaccccatgtactgttatccccttttaatcaattaggaagctgagtgaaggaactttaagtgacttacccaagctcaagaaactagataagttgagaagcagggacttgaatctatccattccagctctagggcctgttctctctacacagtccttgtccttactgtgcaaagtggtgtgagaaaaggcacagaaatgaatgtgtaatgtgattgcaggaggcagcaaagaggctgggtggaaaggcacagcagatttatttagacatctttgctcttggccaatatatattcaaatggggaaactctatttgattaaattgcagatttatttagcactttcgttatatagtatgttgtttaagaaaccaccccctcaaactactgtagtgtagaaaagaaaccatataaaaaattccttcattattatgtgtgtcttattaattgctatacaaaacagtaaccctttcttttctcatttagttattacttaattggtgaagaaattctatattgtgaacttaaaggatcagtagcaatttggagcggtaagcccccaatatgtgaaagtaagtaaattctttttttttaaatttagaccagtagtcctcaaagatttttgcctcctttacaccctttacactttaagattaacaaagatcccaaagaggtttcttttatgtgggttatatctattggtatttatcatattggaattcaaacggagaggtttttaaataattattgattctttttggttttgtttgtttttcctaagacacggtctcaggctatttcccaggctggggtgcagtggcacaatctcagctcattgcagcctcagcctctccagtagctggggcttcaggcatgtgccactatgcctggctttttgtaatttttgaagagacggggttttgccatgatgcccaggctggtcttgaaatcccatgctcaagcagtctgcccccgtgggcctcccaaagtgctgggattacaaatgtgagccaccccacctggcctgattaatttgtaagaataaatgcaatacaaattaacatatgtaacataatttttatgaaaaataataattttccaaatcaaaataaaattagtgagaatagtggcattgttcacattttttgcatatctcttcaacatctggcttaaagcaagattgtatttggcctgttgtgttatcacacaatatgtagcctttggaaaaatatcactatattcttattaggatcagagtgaaaaaagacaataatattttggtggtattgtgaatcaccaatttagaaaatggatatatttataaattgcaaaggatttcttaactagcaccgagttaagcatattttctcattaattgtcagcatttcttgtgatgactagaacagaacttagcatggccttccaaataaatacaggcgtattaggccgttttcgtattgctctaaagaaatacctgagactgggtaatttataaagaaaagaagtttaattggctcatgtttctacaagctgtacaggaagcatggtgctggcatctgctgggggtttgggtaggcctcgggaaacttaacaaccattgggaaagacagaaggagagcaaggtgtctcacatggcaggagcaggaggagcaaggtggggaggacgggaggtgttgcgcacttttaaataaccagatctcccaagcactcagtatcacgagaacagcaccaaggggacggtgctaaaccattcatgagaaatccacccccatgattcagacccctcccaccaggccccacctccaacattgtggactacaatttgacatgcgatttggtggggacacagatccaaaccatatcaataggtatttacactttaagaaaatgagatttgttctgaaagttagttactacattaatggtttgaatttgggatgatatatttgctcatagaaaccttcttttaaatccatattgaattcacaaacagcttgtagaaaccctatattgacaaatttattgaagacacagaaattttactaatgctgtcttaatcttttacatttcctttcctctttttcttcatttttaagaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaaggtagtgtttcaatttatttccttcttcatttgtaaatactatggaaacattttgtaaatagtttcatctacagataaacaaagcaggtgtatgtgcttcctcctcctgtataattggtttctaatttattttaattcaggtcaattcaagtcaaaaaatagttctagctagagttccctatttctcacccctacatgttcttggcatttcattttatacagtgtgaactactgtgtacctgcatgagttagaagtttttgtttgaaagaaccaaaaaaaaaaaatacacactggcttaaagaaagtttcatcttgtattacaagaaatctaagagttctggctatggtagtggtaaactgtgacagactaatcgtctcacaaataaaaatgataaactctggataaaaaaaattttttttttaaagaccaaatgtttaaggcactctggagtgaccaaaagtatgaagaccatgtaggggacttgcccatttaaagaaagaaatcactgaataacagtgatttaaaagtatatactccccaagtacacatgaaacattctccaaagtagaccatattctagacaataagacaacttttaacaaacttcagaaaattgaaatcattcaacatgcattatcacaatagaatgaaagcagaaatcaataacaaagccaatccccaaagaattggaaagtgtacaggacacttctaaataacccatgcataaaagaagtagtcagcagggagattagaaagtgttttgaattgaataaaaacacaacatctcaaaatatccaaatatgtaggatgcagctaaagcattgcttacaggggaatgtatagcataatatacttgtgttagaaaaaaagaaaagtctcaaatcaatgatctaattttccaccttaagaaactaaaaaagagcaagttaaatcccaaactagcagatgtaaggaaatgataaaaatagagccaaaatcaatgaaattgagaaaagaaaaaaaaatagaggaaatcagtgaaaccaacagttgctacttggagatcaataaagtgtgtaaacctgtagccagactgacaaaaaaagacgcaaattaaccaatactgagaatgaaagaagtggtggccaggcgcggcaccccagccagcttgaagaccctgccctcctgcagccggcaggggcagtcactcccggacttgtccttttagaagttccagctttaccacttgctggtggagcccaaccactgccgcagggtcctcatcgccaacacgcctggcagatccaagaggagatggcccaggatgagacgtggcacacacaggcacccgagagtgtggggttggcgttgttccactgcctggtttctgcagagatcctgtgcctgtggcctgtgcccgccatgtggaagccagagggggtgtgccatgccccccgctttggacactgctgcgtgaaggggccagttttcagacctttgctctgtcacctcagcactggcgccaggagccctgaagagcagcatctgggagacggacagccctggggaaaatagaggaggcgttcagaagtagctagatgagatatttgaaatactgaagaccaaaaaccccagtttgcatggaagaactggcctcagatgtggtcagttcctatgatgacctggacacacggtgctgacccacacgatgggaggtggccctgcaaagcattcagaggcttgggcctgctgccgtccggcctcccacctccagctgcaattgcattctgacctgggcaagtaggaacacgtagtggagatcctgatggagacctgagccaggcgtcccggagtgctggccaggcgtggagtacgggatccagctaagggagactggccagcctatagccccccagccttgctggctcctctgctaattccagcagggtctgcagccccagacccatccccttccttcccgtctgcagagggcaggccagaggctggtctcagtgggagctagggctctcctcaagggctttttgaccttgggccagtcttgacatccccacagccctgcgcccctcatcacttttcgtgtctctcggagacggcgagctgcaactgcagcaatcttgtttaaatttaggtaggtgaatttcttagaattaagtttcatatgttttgagcaataagttttcttaagatatatatattttaatctttttagttttatctctgaatattttttattttttttcaatgtattttttttctggaaacattctgtgctgctacattagagcctacacagtttagttggtacatttcattcttttaaggttcaaataagggattttattttccagtgagtttccttgcattgttaacaagtcaacagcgttaacgtatgattttttggttttttttttttgtatactttaaatttgtgtgcaacccttctcatttatgccctgtgttacagtgagagcttggtcaaagtggggaaaacacacacagctgctacactttttttttttttttttgtcattggaacatttgtgccatgtcttcctagacttaagtgtaaattatggagggttttatttgacaatttatatgtaaatgtcattgaaggctaaggttaaatctttggaaatcacaggcaccagttgatctttagagacctcagatcccctcaggtggcgccttgtgataggcggtgttctgggaggcttcctgtcaggttccacagcacaggcacctgctctgggcacggactgagctcctggggtgtgcacggagctgcggtgcgccagtcacatgcgcttggaaacagcgtgtgctgctggattggaaatgcctacgttgctctgttaaattggtgctggagccaaaacctaaggttaaatttaagtctagaatgaaagaaatctgaatccatgtaattaatggccgctcgatcttgagagtccttgacggccctgcctcaggaagtgaggtgggggtgcctacacctttcactttccttcctcacgtccaccccgtatgtgtttctcatcctttttctgacttccccccatcccttagccaaaaagctttatattcttttgtgcatatggtcattctttaatatcagtgatgtaaactttacttgattactttacaaaattattcaacagacaaacaaaagaatgaaaaagagaatatcactaaatatcctacagacatttaaaggatgacaagggaatattataaacaactttatgcctacaaatttgacaactgaaatggacagattccttgaaagatacaaaatgtcaaaactcacttgaagatatggataacctgaatactcctatatctaccaaagaaataaaatttgtagttaataacctactgaaggtccagatggcttcactggggagttctaccaaccatctaaggaataaatcacagcaattctacacaagcgtttcaagaaagtgcaagaggagggaacacttctcatcccattttatgatgatagcattgtccttatacgaaaaccagaaaacaaaaacattataagaaaattacaaataatatccttgatgaacacaggaccaaaaatcttcaacaaaatattagcaaaccaaatcctgtgatacataaaaagaaaagtaaatcatgaccaagtaggatttaccctatgaatgcaagattagttcaaatgcaaaaattaatcagtgtaatttgccacatcagtagactattaaggagaaaaaaaatcatgtggttatcttattagatgcaaaaaacaaagaaaatgtttgacagaattcatcatcttattttttcatgataaaacttctcagcaaactaggaacagaagggtactatctatcttaccctgataacagacatctacaaaaatctcacagctaacattacacttcatggttcaaaaaaattatacttagtggtaaaaagtaacattgtacttagtggttaaaaaaaccttacttacatttctgtctaattaataaagacctaattctggaaggaaaacagtgaggatgtccactcttaccactccattcagcattatattggagatcccacccagtacagtaaggcaagagaaagctattaggcacacatgttggaaaagaagaaataaaaactgtctctactcacaatgagatgccactaaatacctattggaaaggccgaaatgtaaacacacacaccccaaactgacaataccaggtattgacaaggatatggagcagatgaaactctcatatactgatggtgagaatcaaagtgcaatgaccactttgggacatttttggcatttcttataaagttaaacatactcttatcatacaactcggcaacccaaataaactgaaaacattttcacacagaaacttatatgaggatgttcacagcagccttattcataatcaccccaaactgcaaatcgccacatgttcttgagttggtgaatgaatgaaccacctgtgctacctctaaaagatggactcgtactcagcaataaaaaggaatgaactgattcatgcagcaacacaaatgaattttgaaagcatcatgcttagtgaaataagccatactaagaagactgtaatttcatttatgtgacattctgaaaaagtcccactatagggataaaagcagatcaatggttagctggttgtggaagtggggatgagggggaagaggggtaactcacaaaagagcatgaggaaattctggagagtaatggaacttttctgtatctttactatggtggtagttacatgattatttgcatttgtcaaaactgatacagctgtacacttgaaatggtgaattttactgtatgtaaattatatccaataaaccaacctttacaaataacattaggtacaattagacacaacaaaaggtcagtgaacctgaagacaggtgaatagaaattgaaccttatttaagaagaaatgttgactaaagaaagagagaggcttacagacctgtgggagagtatcaagcagtgaaacatacatgtaattggagtttcagaaagacaggagagagaatggtgtaaaatattatttgaaaaaatattggccaaaaattatccaaattagatccaaaacaacctcagatccaggagattcagtgaaccttcagcaggatgaataaattattaaaatttaccaccaccaccacccccctgcagtagtttggtaaaaactaccaaacaaaattttaaaaagcagccagtgagtggggaaaacaacaaaaacccgtattacatttaggagggcagggacaagtaagaatgacagccagccaagttttcttaagaaaatgtggttacaatatggttatctctgttagtgctgaaagaaaaataaaacaccctagaattctgtatgaaggagaatatattagttaacatttaaagtcttttaaaaaatgtttttaacatcttgcattccattccttgtctctgttcacactggaaattactactttgtactactttttctgctaaagcagatatccattaattctgaggtttctctaattttccagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaaggtacaaaggttatcttttttctgtcttggtttgttattgttgttgctgttcattttagactttatttctttgatattaactatcagtcatacaaaataactgaaaagaaacaattttagtatttaactctgtcttgtattcatttctatgccagatgaatgacacgaaattcacataaaattctgctgttgtgattttttgtgcttttccagggttcttagcacgttatgtacattgcatgggtatatgcttttaatatttttatgtataaaaagtgaattacaacaactttttggaattgaaacatgggcatttttatctaagtaagtcaacaatggcataattcatataaatgaaatgagagcaataactcccaagtggttgatcttctaacattattttgtttcctagtgctgcctccatctagtacaaaacctccagctttgagtcattcaggtttagtagcttcttccttatatgtcttcttccttatatgttacaagatataaggaattcctggagaaattgccagcaataactcccaagtgtttggtccaatctacattattattttgttttccagtgtcgacttcttccactacaaaatctccagcgtccagtgcctcaggtttagtaatttcctgcttatagtttttcaaaaatcctttaaattcctggtgattttttataaaatccttcaaatttctggtgatgttcacttatttttagtaatgaaaggagggaggacatttgtatagccattttagttgttatacatagtgattctaaaattatttgccataatctgatataaacaggaatatgaccttgggaaagttgtataaattttgaatgtgtttatatatatatgtttacattatatatagagaaattgatttagtaccttccttattgggtattagtaaggtataagtgggatgcatttaaagcacttagcacagtgcctggtgtagagaaagctcttagagctagccaatatgacttatcctacacttaaattaatgttagggaaggggaaggttcatgtatgtttgttagtatgtgtgtgtgttaatatgttaatatgtttgtttgttaatatgtatgttttgtgtcatcaactttgctattttattcttttcagaagtgatctgttgacacctttactgagtttgttcctattgcaggactctttcatttcctggaatgcaactagtttgagtcttctgatgtaaaacatttaaacagggaaatttctgctgtcctcagaacaagatctgtatttctgcctcttccctacccacccctcttccacacctcataatgttatttattttttttctctttagtgggcagttttatctggcaatagcaactcaattttatagcaactgaaaggcaggaaaagtccttatttactgaaataaaatagaagacttttgcagggactcctggtcaaccactgtgcttatgactggagagattattttgatatgatggaaggaattatcctgatttcagcactaccatctctggtttcactttgcttccagcagaagcaagagacaatagtaattgtgggtagcacttcagtctgggcagactgtgcttagttaacatcatttctgtggtcttcagtttccctttagtataatgtgagtgttgaactgaaatctcaatcactggcttctaatttggttatatatttcctatctccctaatattttaaaggatcgaagagaattatgcatgttaacatagtaattaagataccttcttataggctgggtggggtagctcacacctgtaataccagaactttgggaggccgaggtgggtggatcacgaggtcagaagttcaagaccagcctggctaagttggtgaaaccccatctctactaaaaatacaaaaattagcggggtgcggtggcaggcacttgtaatcccagctgctcgggaggccgaggcaggagaatcgcttgaacccagtgggcagaggttgcagtgagccaagatcatgccactgcactccagcctgggtgacagagtgagactctgtctcaaaacaaaaaccttcttataattcctgtaagagcttggtaactggtagcctcctgagttgagtgctgtagggtttgaggggcaggaagagatgagttttttagtggactgatacatgagcaaaacaagattgcatgtgaaatttatactcagtgaggcatccgggcttaactcacatgctcctagtgggtatatgcactaatactacgtttgttgatacagtcttttgaaagagttgatgataagcatttcataaagtatttataaaacactggtatagcttagtgttggagagcagaagagagaattgcttgggattgtcaatgatttcttatcatctgctagaggaagactaaataacaacatcatgatgttaaggtagatctaaatgtgttaacaagaagaaaagttgaggaagtcctaagtggaaaagagaaagatgtaaattatgtagtatcatactacttacagtttttaaaaagatacatatgtttaccccaagcacattccctttttttttttttgagacagagtcttgctctgtcacccaggatggcgtgcagtggcgcggtcttggctcactgcaacctccgcctcccgggttcaagcggttctcctgccacctcagactcccaagtagctggtattacaggcacccaccactatgccggctaattttttgtatttttagtagagacggggtttctccatgatggcctggctagtctcgaactcctgacctcaagtgattcacctgcctcggcctcccacagtgctgggattacaggcgtgagccaccacacccatcctcacattactttcatgatggttatcttctaagatttccattataaaatacagagtgtggtgagcattcttgtacatacatcttacatacttgtgcaaatatatatgtaggttaaattctaagatgtggaattgcaaagtttgtaaagtgtgtagttttcatttgataaacttaaaaaatcaatatcaaaattaaagtcataattttatattgataaggccctggtgaatttataaaatcaaacttatttttctaggtcctaggcctacttacaagcctccagtctcaaattatccaggttggttaactctttatcctactgatattgttaagaatttatttatttatttttattatactttaagctctagggtatgtgtgcacagcgtgcaggtttgttacataggtatacgtgtgccatgttggtttgctgcacccatcaactcatcatttatattaggtatttctcctaatgctatccctcccccagcccctaacccctgacaggccccagtgtgtgatgttccccaccctgtgtccatgtgttctcgttgttcaactcctacctatgagtgagaacatgcggtgtttggttttctgtccttgtgatagtttgattagaatgatggtttccagcttcatccatgtccctgcaaaggacatgaactcatccttttttatggctgcatagtattccatggtgtatatgtgccacattttcttaatccagtctatcattgatggacattcgggttggttccaagtctttgctattgtgaatagtgccacaataaacatacgtgtgcatgtgtctttatagtagcatgatttataatcctttgggtatatacccagtaagggattactgggtcaaatggtatttctagttgtagatccttcaggaatcaccacactgtcttccacaatggttgaactaatttacagtcccaccaacagtgtaaaagtgttcctgtttctccacatcctctccagcatctgttgttcctgactttttaataatcgccaatctaactggcgtgagtggtatctcattgtggttttgatttgcatttctctgatgaccagtgatgatgagcattttttcatatgtctgttggctgtataaatgtcttcttttgagaagtgtctgttcatatcctttgcccactttttgatggtggtgtttttttcttgtaaatttatttaagttctttgtagattctggatattagccctttgtcagatgggcagattgcaaagattttctcccattctgtacgttgcctgttcactctgatgatagtttcttttgctgtgcagaagctctttagtttcattagatcccatttgtctattttggcttttgttgccattgcttttggtgttttagttatgaagtatttgcccgtgcctatgtcctgaatggtattgcctaggttttcttgttgggtttttatggtgttaggtcttacatttaagtcttcaatccatcttgagttaatttttgtataaggtgtgaggaagggatccagtttcagctttctacatacggctagtcagttttcccagcaccgtttattaaatagggaatcccttccccatttcttgtttttgtcaggtttgtcaaagatcagatggttgtagatgtgagttgttatttctaaggcctctattctgttccattgatctatatatctgttttggtaccagtaccatgctgttttggtcactgtagccttgtagtatagtttgaagtcaggtagcttgatgtctccagctttgttctttttgcttagggttgtcttggctatatggactcttttttggttccatatgaactttaaagtagttttttccaattctgtgaagaaattcagtggtagcttgatgtggatagcattgaatctataaattaccttgggtagtatggccattttcccaatattgattcttcctatccatgagcatggaatgttcttccatttgtttgtgtactcttttatttcgttgagcagtggtttgtagttgtctttgaagatgtccttcacatccatcccttgtaagttggattcctaggtattttattctctttgtagcaattgtgaatgggaattcactcattatttggctctctgtttgtctattattggtgtataggaatgcttgtgatttttgcacattgattttgtatcctgagacttcgctgaagttgtttatcagcttgtggagattttgggctgagacgatggggttttctaaatatgcaatcatgtcatctgcaaacagagacaatttgacttcctcttttcctaattgaataccctttatttctttttcttgcctgatcaccctggccagaacttccaacactacgttgaataggagtggtgagagagggcatccttgtcttgtgccggtttccaaagggaatgtccagtttttgcccattcggtatgatattggctgtgggtttgtcttaaatagctcttattattttgagatatattccatcaatacctagtttattgagagtttttagcatgaagggctgttgaattttgtcaaaggccttttctgcatctattgaaatagtcatgtggtttttgttgttagttctgtttttgtgatggattatgtttattgatttgttaatgttgaaccagccttgtatcccagggatgaagccaacttgattgtggtggataagctttttgatgtgctgctggattcagtttgccagtattttgttgaggatttttgcatcgatgttcatcagggatattggcctaaaattatctctttttgttgcacctctaccaggctttggtatcaggatgatgctagcttcctaaaatgaattagggaggattccctctttttctgttgattgaaatagtttcaaaggaatggtaccagctcctctttgtagatctggttgaattcggctgtgaatccatctggtcctggactttttttggttggtaggctattaattattgcctcaatttcagaacctgttattggtctattcagaggttcaacctttcctggtttagtcttgggagggtgtatgtgtccaggaatttatccattgcttctagattttctagcttatttgtgtagaggtgtttatagtattctctgatggtagtttgtatttctgtggggtcagtggtgatatcccctttatcattttttattgcgtctatttgattattctctctttacttctttattagtcttgctagcggtcatttttgttgatcttttcaaaaaaccagctcctggaatcattgagtttttgaagggttttttatatctttacctccttcagttctgctctgatcttagttatttcttgccttctgctagcttttgaatttgtttgctcttgtttctctagttcttttaatggtgatgttagggtgttgattttagatctttcctgctttctcttgtgggcatttagtgctataaatttccctctacacactgctttaaatgtttcccagagattctggtacgttgtatctttgttctcgttggttttaaagaacaactttatttcagtcttcatttcattatttacccagtagtcattcaagagcaggttgttcagtttccatgtatttgtgtggttttgagtgaatttattaatcctgatttgcactgtggtctgagagacagtttgttgtgatttctgttcttttacatttgctgaggagtgttttctaccaattatgtggtcaattttagaataagtgcgatgtggtgctgagaagaatgtatattctattcatttggggtgtagagttctgtagatgattagtaggtctgcttggtccagagctagttcaagtcctggatatccttgttaactttctgtctcattgatctgtccaatattgacagtggggtgttaaaggctgccattattattgtgtgggagtctatgtctctttgtaggtctctaaggccttggctttatgaatctgggtgctcctgtattgggtgcatatatatttaggatagttagctcttcttggtgaattgatccctttaccattatgtagtggccttctttgtctcttttgatctttgttggtttaatgtctgttttatcagaaactagaattgcaaccccttttttttttgctttccatttgcttggtagatcttcctctgtccctttattttgagcctatgtgcatctttgcatgtgagataggtctcctgaatatagcacaccgatgggtcttgactctttatccaatttgccagtctgtgttttttaattggggcatttagcccattttcatttaaggctaatagtgttatgtttgaatttgatcctgtcattatgatgttagctggttattttgcccgttaactgatgcagtttcttcatagcatcgatggtctttaccatttggtatgtttttgcagtggctggtaccggttgttcctttccatgtttagtgcttccttcaggagctcttgtaaggcaggcctggtggcgacaaaatctgtcagcatttgcttgtctataaactattttatttcttcttcacttacaaagcttagtttggctggatatgagattctgggttgaaaattattttctttaagaatgttgaatattggcccccattcttttaaggctcgtagggtttctgctgagacatccgctgatagttggataggcttccctttgtgggtaacctgacctttctctctggctgcccttaacatttttttccttcgtttcaaccttggtgaatctgacgattatgtgtcttggggttgcacttttcaaggagtatttttgtggtgttctctgtatttcctgaatttgaatgttggcctgtcttgctagtttagggaagtcctcgtggacaatatcctgaagagtgttttctaacttgattccattctccccgtcactttcaggtacaccaatcaaacgtagatttggtgttttcacatagtcccatatttcttggaggctttgtttgtttcttttcacttttttctctaatcttgtcttctttttttcattaatctgatcttcaatcactgatatagtttctttccacttgatcgaatcagctattgaagcttgtgcatgcgtcacgaagttcttgtgccgtggttttcagctccatcatgtcatttaaggtcttctctacactgtttattctagttagccattcatctaatcttttttcaaggtttttaccttcctcgagatgggttagaacatcttagcttggagaagtttgttattactgaccttctgaaacctacttctgttaactcatcaaactcattctctgtccagttttgttcccttgctggcaaggagctgtgatcctttggaggagaagaggcagtctgttttttggaattttcagcttttctgctctggtttctcccatctttgtggttttatctaccttttgtctttgatggggttttggtgtggatgtcctttttgttgatgttgatgctattcctttctgtttgtgtgttttccttccaacagtcagacccctcagctgcaggtgtgttggagtttgctggaggtccactccagaccctgttttcttgagtatcaccagcagaggctgcagaaccacaaatattgctgcctgatccttcctctggaagcttcgtcccaggtggggcacccaccacctgtttgaggtgtttgtcggccgctactgggaggtctttcccagtcaggctacatgggtgtcagggacccacttgaggaggcagtctgtccagtgtcgaagctcgaatgccatgttcagagcaccactgctctcttcagagctgtcagacagggacgtttaagtctgcagaagctgctgcgttttgttctactatgccctgcccccagaggtggaatctatagaggcagtagcccttactgagctgcggtgggctcctccagtttgtgcttccagttctctttgtttacactgtgagctactcaagcctcagcaatggcagacattcctcccctcatcaggctgcagtgtcgcaggtcaatctcagactgctgcgctagcagtgagcaaggttctgtgagcgtgggacctgccaagccatgcacaggagggtatctcctggtctgctggttgttaagactgtgggaaaagtgcagtatttggtcaggagtgtactgtttctccaggtacagtctgtcacggcttcccttggctaggaaagggaaatcccccaagtccttgcgcttccgggtgaggcgatgccccgccctccgtgggctgcactcactgtccagccagtcccagtgagatgaaccaggtatctcagttggaaatgcagaaatcacctgtcttctgcatctatctcgctggagctgcacaccagagctgttcctattcagccatcttggacaagatttttttttacttaaaatttttttaaattaaaaacttaagacatatctaaaaaaatgttaagaatttttaaatgatgggtgaaaaataacatcttgttttaatttgcatttcttggttcttggtttttagttgtttttgtttttgcttttttgagaccgggtctcactctgttgcccaggctggagtgcagtggtgcaaccacggcacactgcagcctcaacctcctgggctcaggtgattctcccacctcagcctcccaggtagctggaactacaggcacctgccaccacacccagctatttttttgtgtgtgaattttttgtagagacagggttttgccatgttggcaagtcttttctccaactcctgggcttaagcgatcctcctgcctcagcttcccaaagtgctaggattacaggtgtgacccaccatgcccggccaatttacatttctttaattatcagtgaatctgaactttttttgatctacatttatttattcatgtgctttgtctatttttctgttaggtttctaaaatatttttcttagtgatttttgagagctcattatgaattaaagcccttttaatatgaagtgaacagttttttccaggttcttttgttttgtcagttttaagcttgttatactactggatatagattactttttataacttttaattacatgagtagtgtatgaatatacttttgtagaatttcaaacattacaaaagtatatagagtaaaagattagttttatttttaactcattacccaagttaatcactgttaatagtttagggtttctttttaaatctatttttgtacatcaacatctttttttaaaaagttttattttagatttgggggtacaggtgaaggtttgttacataagtaaacgtgtcacagggatttgttgtacataactatttcatcacccaggtattaagcctagtacccaatagttaccttttctgctcttcttcctactcccaccctccccggtcaagtataccccagtgtctgttgtttccttctttgtgttcattagttcttaccatttagcccccacttataagtgagaacatgcggtatttgggacgttcctgctgaagacatgcgctcgttcttttttatggctacgtagtattccacggtgtatatgtaccacattttctttatccagtctgtcattgatgggcatttaggttgattccttgtctttgctattgtgagcagtgctgcagtgaacattcatgtgcatatatctttatggcagaatgatttatatttctctgggtatatacccagtaatgggattgctgggttgaatggtagttctgcttttaggtctttgaggaatcgccatactgcttcccacaatggtggaactaaattacactcccacgaacagcatataagtgttcccttttctctacaacctcaccagcatctattattttttgactttttaataatagccattctgactggtgtgaaatggtatctcactgccgttttgatttgcatttctctaatgatcagtgatactgagcttttcttctgtatgttttttggccacatatatgtcttcttttgaaaagtgtctgttcacgtgctttgcccactttttaatggagttgtttttctcttgtaaatttttttaagttcctgtaaatgctaaatattaggcctttgtcagatgcatagtttgcaaaaatgttctcccattctgtaagttgtctgtttactctgttgatagcttcttttgctgtgcagaagctcttcaatttacttcaatcgtacttgtcaatttttgcttgtgttgcgattgtttttgatgtctttgtcatgaaatctttgtctgttattatgtccagagtgatattgcctaggttgtcttccagggtttttatagttttgggttttacatgcaaatctttaatccatcttgagttgatttttgtgtatggtgtaaggaagggatccagtttcaatcttctgcatatggctagccagttatcccagcaccatttatttaatagggaatctttttcccattgcttgtttttgtcagttctgtggaagatcagatggtcatagatgtgcagccttatttctaggctctctattctgttccattggtgtatatgcctgtttttgtaccagtaccatgctgttttggttagcgtagccttgtagtagagtttgaagtcaggtaatgtgatgcctccagctttgttctttttgcgtaagattttcttgactattcaggctctttttggctccatatgaattttaaaatagttttttctagttctgtgaagaatgtcgttggtagtttgataggaatagcattgaatctgtaaatagctttgggcagtatagccattttaatgatattgattcttccatccatgagcatgggatgtttttccatttgtttgtgtcttctctgatttctttgagctgtgttttataattctcattgcagagatgtttcacctccctggttagctgtattcctaggtattttattctttttgtagtaattttgactgggattgcctctctgatttgactctcagtttggctgttgttggtgtataggaatgctagtgatttttgtatattgattttgtatcctgcaactttggtgaagttgtttatcatctggagcagcttttaggccaagactgtggggttttctaaatatagaatcatgttgtctgtggacagagatagtttgacttcctctcttcctatttggatgccctctgtttctttctcttatctgattgctttgcctaggaccatcaacatacttttatgtgtaattatacatgtagtttggtgttttctcttttcttaaaaatgatattatgctgtacatatttttctgcaactttttccacttacactcttagattgtagttgtgtttagatttattctcatactttctaatgatgacttaagtatataccataccttatttaactattctcctatcagaggtcatttatatgttcagacgttttatattaataggtagttggatgtattgatcttttccctaatggctatgactttggtgtctttcttactaaaactttaggtcttctgtatgctgaaattgtatgaagatttcaaccatgtgttctgactttggtctttgcacttaaatcattagtaaatctgaaatttattctggtgtatataatgagatatatggttccacctcgccccaccccagcaaccaccatccaatagctaaatagcaccattttttgaataagttgtcttctccccaactgatttgaaatgtcaatttgtatcatacattgcattcataggtgttccatcctcttttctcctttgaactttgtccattcttctattcttgtagcaaaagcaagtctttttttttttttttttttactgtagtactatatgttttaataactgccgggaacacttccttttcagaaatttctaaggaactctatgttattttttccaaataaactttttatcttatcattttgaccattttaagtttacaattcagtggcattcagtacactgacattgttatgtaaccatcagtaccatccatctctagaatattataatcatcccacactgaatctctactcattaaacagtaactctccattcctccctatccccatcacctgatgataaccactatctactttttgtctcatgaatttgcctattctaggtaaatttatataattataataagtggagtccacttatatggcatcccactatttgtccttttgtgtgtggcttattttacttagcataatgtttttaaggttcatctagatctatcttgtgacatgaatcagaacttcattcctttttatggctgaataatagttcgttatatgtatatactatatttcatttattcattcatctgttgctagacacttgggttggtttgtttttaccttttggctattttgagtaatgctgttataaacataggtgtacacatatctgtttgagttcccgtattcagttcttttaggtatatacctgggagtagaattgctagatcataagggaattctatttttaatattttgaggaactggcatactgtattccacagtggctgcaccattttacattcccaccagcagtgggaacctttaacaaaggttccaatttttccacatctccaccaacacttattaaattgtttttttagtaatagccaagtgtcttagtctgttttgtatgtgataacagaataccacagactgagtaacttataatgaacagaaatttatttcttagagttctggaggctgagaagtctaatatcaaggcatgggcatctgtgagggccctcttgctttgtcataatatgatggaaggcatcacatggtggaaaggaaaagagacggtgagagagagagtaagagggacaaaaccatgccctaaataacaaacacacccctgcaataacgacattagtccattcatgaggacagagccataatgacccaaacacctcttaaaggcgccaccccaataacattacattgacaattaaatttcatcatgagttttgaaggggacattcaaaccatagaccgtcctaatagatatgaagtagatatgcatactagatatgcatttccctaaaaattagaaatgtgttgagaatcttttcatgtgcttattggtcatttgtatatcttctttagagaaacatctttttaagtcttttgcccattttcaagttgggttgacatttgttactgagttttaagagttatttatatgttctggatattacttccttatcaaatatatgatttacaaatatttcctctcattctgtgggttgccttttcactctgttgatagtgtcatttgatgcacaaaatttgcttttaattgatgaaatataatttttttcttgtcttgcctgggcttttagagtcacatccaataaatcatagccagatcaaatgtcaagaagcatttcctctgttttcttctgagagttttatagttttacctcttatgtttaggtctctgatctattttgagtttgtgtttgtatatgataagggtccagcttcactttttttgcatgtggatatccagttttaccagcaccatttgtagaagagactccctttccccatttgactgttccttgtcacgcttgttgaaaaccgtttgaccatatatgcaggggtttatttccgaggtctctgttctattccattggtctgtatgtctgcctttttgtcattaccattgttttgattattatagttttggaatcagaaagtgtgagccttctcaactttgctctttgtttctaggattgttttggctatttgtggtcccttgagatttcatatgtattttggaatggatttttctatttcagaaaaaaaaaaccaaaaaataccatcatcaggattttcataggggttgcactaaatctgaagattgctttgtatagtattgacagtttaaaaatactaaatttttccaatccataaacacaagtgtctttccatttattttatatctttaattttttttagcagttttgtagttttcagtgtacaagtctttcacctccttagtttattcctaagtattttattctttttgatgctattacaaatgatattgttttcttaatttccttttcagattattcattgttagtgtatagaaatacaactgagttttgtatgttgattttgtaacctgccacttaactgaattcatttattagttctaagagatttttgcatgtgtgtgtatatgtgggatccttagggttttctaaataaaagatcatgtcatctgcaaacagagcgaattttatttcttcctttctaatttgaatttctttttcttacctaattgctctgattagaactttcagtcctatgtcagatagaagtggcaaacatggacaccctgtcttgttcctgatcttagggaaaaagccttcattcatttaacattgagtatgatgttagctgtgggtttttaatatatggcctttattatgttgaggaagtttccttccatttcaggtcaactctaaagcatttatttttattaatccctcttttttttttttttttttttttttttgagacagagtctcgctgtgttgccagactggagtgcagtggctgtgtctcggctcactgcaacctccgcctcccgggttcaagcgattctcctgcctcagcctcccaagtagctgggattacaggcacgcactaccacacccagctaatttttgttttttttttttttagtagagacggggtgtcaccatgttggccaggatggtctcgaactcctgacctcgtgatccgcctgcctcggcctcccaaagtgctgggattacaggcgtgagccactgtgcccggctaatccctctatcttttaattttaattagaatcacattggatttatagactaattttgagaaaatagtacagataaatttgcatgttgaaccacagaatgttgtcacagaaaatgtgagtggggaggaagaagaaagattatgacattaaatgtaagtttataaatttttatgatactactttgagaaacattaatatagtttataaggaaaattatattttaagggattttctacaaaggtgaaaaaaaatcaccctatgagtttaaaggattttaagctttatatttaattctttccttcttttattaatttaatctatatttcttcttttttcctaggatatcctaaacctgaggaaggaatacttgacagtttgggttggtatagctatcatgacaaatataagtggtagtatgtgtagaaacgtgtaggtaattagtttttatgaggtgcccaaacataggatccttggtagggtaagataactttcttaaatgctgtgtttgtatgtaggttaaaatatataaaacacaattttctttccacattatattgttattttgtgatggtaatctgtcgataaattttctttctattcatatcttatatacatgaaccttaaagcaatctaagttgggtttattttttctgtaacacgctgatttaacacacttgatgtaggcttacgcagtttacacaatgcatgttaaaaaaaaagatgaagtgcagttgtgatataggccaatgaaaaataaagatttcttaataagtaaaaacaaaaatctattacctttcatttcttagactagtttggtaatggttaatcattttatataatgcaccttaggcttgttttttagtatttgccttacctccaaaatctgtggtccaagtaaatctgttgccatcttaaactgttaaacacttgataactgtttatgagatgagaagagcagagttgaacatagcactttatgctttgacttatagcaatttaataaaagtaatggcagtttagaagcaaaggtactagggacagaaacagttctaaaaattaagattttataggattattttgtgttctctagatagtcaaaaatgtattctcaaatttctctgtatattttttatccatgtgccctggtgtttcatttattatgggaatcctattggtatttaggactatgtcttaattttggggcagggcagagtatggaagtagagaggatgggaaggggattgataagataaagtattgtttgtgaagactttgtaaataccatctgggcaatagaataatagaaatttatttatgactcactctacagatcacttttggaggaaaaaatacaaattaaatgtctaccaaaataagaaatgacagaatgactgttgaactaaaccaactctcatgggataatacttttcaaaaatcattttcctttactatagtgaattctaattactctaataactttaccgctaaataacctgatgtggtagctatagagaaaaacagtgaaaaatgaggttcccattaagagtttcacaagtggaacccttaacctggaaactggttagaagggttctatgatcaaaatgacctggatgccctagcagtcatgctaaaactatataaaaaatttttttttcctctgtagtcttgtattagtccattctcaatgctgttgtaaggaacagtctgagaccgggtaatttataaaggaaagagatttaactgactcagttctgcagggctgaggaggccccaggaaacttataatcatggaggaaggggaagcaaacacattcttcttcacatgatggcaggaaggagaagtatgagaaccaagtgaaggaggaagccgcttataaaaccatcagatctcgtgagaacttactatcatgagaatagcatgggggaaactgcctccatgattcaattacctctcatggggtccctcccacaacacgtggggattatgggaattgcgattcaagatgagatttgggtggggacacagccaaaccatatcaagtgtttagatgatctgattgaaataaatgctatctggagatccatgtgttcaacatcttggaactgttttctttctcagatgtttgggtcattgctgtgattgttattgccataggtaagtatcacaaattttgacaccacttaagtcaaaaaattattgtgaagacatgcattttaaaaatagtttttcagtttctatagttttttcagcttgtaaattggttaaaccgatttaggaaaacctgactttttatttgatatacttaactacctaccttgtgttagtgattttatactctgttatattctgtatatctacttagtaacaaagcctaagtaatacatattttctcaagatgatcagtaatattagttggcttcccaaatgtgcttttgatagttttctaaattaagcaaggacttttctctgacttactatggactgtgtaagtgattatggggagttggatttagatagcaaagagtctggatggaatataaatgtgtaggtgcttaaataacatttgaccactgaaatgtaaccaacatttatttcttctgctagatgttgaatcttggtgattagttttcagaattatatgtcatttgtttcctggtttcttatagttgttggagttgcagtaatttgtgttgtcccgtacagatatcttcaaaggaggaagaagaaagggtaaattaaagcatgtttcttttaacttcttggtccttcttatacttaacatgcttttgtgcagcttcagtttgtaatctgtattgcatgctatcttttttttttttttaaaaaaatgcctgcattagtttgtcctaccaattgcatttctttgctaaaaatattttcagctacttctaacatcactgcaacataaaaacatctgtgcagagttcctacagctattatgactttaagaaaaatttcttttggatttgaggtttaagttatttagcaaatcatggaccactcactatgaggccttctctaccctattccctatttccaaaattgcactaatggccaaaattaaatttaaagtatttcactgtggagactttgacagttgtattcactggaatttttataatgaaagtttccacttgtctatatagcttagctagttgcaagaagctatgtaggcatatcatttaaatacccaatttggtgtcttttcatttaaagttgttatttatacatgttaaactgggggattcaaaacaacactatccgatttccctcttatgttctctgaatttaccagattgcagtaaaactgatagggttaaagttaaaattgctgagaggggttagatctataaggtacctcaattaactgtgtcttttaatatataaaaatgtaaaaagtgagtgggtttagaatagaagaaaaatgtacaagtacatatcttctaaagaaaatagggttttaaaacatcaaactcaaattttagttaaagagcttacagtttaacaaaagacttagaatgaatcctggaacacagactaagattaggtgctttgaaatttctgaaagataatatacattcatttttactgatttttaaaaactgttttcccctatagttttagaaatagctttgaaatcaaacctaataattttaagacttttggtactcatggttttatgatatatattccttttatactgatcatcaggtttgggctaagtcataaaagtacaagctttactcataaggaactcaaacttttttcatattacttggttatcttttgaaatacccataatcccttcacttgaatcttaaatcttgtattaatggaacacgatatgcatatttgatttatctatcagttgtatattctaaaagttacatatctacaacgtgagtacaaaatattatcaatggaatatttttacaaatccataaggtttgcgtagaaacaagttctaaagaaaacaaaacaaagtcgcattctgcttattttccttctttgtttaaaatatcactgcatcagaatttttaaaggttcattaacaagtattaatcaaactctctctagctagcagttaatggtttttctgttgttgttttttgcttttttgtgatggagtcttgctctgtcacccaggctggagtgcaatggcgcaatcttggctcgctgcaaccttggcctcctgggttcaagggattctctgcctcagcctcacgagtagctgggattacagtcgtgcaccaccaccaccggctaatttgttgtacctgtactagagatggggtttcaccatgttggtcaggctggtcttgaactcctgacctcaggtaatccgcccacctcggcctcccaaggtgctaggattacaggcatgagccaccgcgcccggccttaatgggtcttttaaagctcaacagttatctgactgttacactcccaaatgaaaggttcaatagcagtagtgaactgagattccaaaattaatttgtccagtgatttttttttaaagcccatattttacagcatagggtccaactgacagttgccattattaaaattttaaaatattttgggaaggtatgatatctttagccaatgcaacataattaatcctgcaaatagtagcacaacttgaggaaaaatagtccagaaaatggtgtgagagacgaaactcctaattgcctttgaactttaaaatataaactgcgtgggaatcttttagaatagatgttaccctttttatgacaggaacatactcgattggaaattcagcatatgtaatggctgaatccaaagctaggctctctttatggatctattattttgtagttccatgttattttgatagctgaactgaatgtgagggtggtttatctttcttcttcagagtctagaggaatgtttctctgactttaatgtgcacattagtcacctggaaatctgttaaagtacagattctgattcattgggtttggggtggagcctgagaccctgcctgtctagtgagctcccagtgctgatgctgctgctgtgcctgggctacactgaccagggtgttgcccactactgatgtgcctatattgttgaagtctgaagaaacactatgaagcttattggcaaatttttctaatatttaagataattgaagtttttaagattcctcatccatgtgtatccttaaaaaaaggctatggggtaataaatagtacttggcttttcttaccttctttaactcttaaaaaacaaagatttccagccgggcctggtggctcacgcctgtaatcccagcactttgggaggccgaggcgggcagatcacgaggtcaggagatcaagaccatcctggctaacacggtgaaaccccgtctctactaaaaatacaaaaaaaaaaaaaaaaaaatagtggcgggcgcctgtagtcccagctactctgggaggctgaggcaggagaatggcgtgaaccccggaggcggagcttgcagtgagcgagattgcgccactgcactccagcctgggtgacggagtgagactccatctcaaaaacaaaaaacacaaaaaaaccccaaagatttccattattttctttgcactgtttaatgtccataatcttgtccccccagattggctgttgtggccttagaaacttcttataaagactataaaatgtctggaggcacttctccacttccgggggtaactggaagcaggctagcaggcacaaataatctcaaattgttgttaaagcctggcacaaaatgtatttcttgtaaactggtatttatggtgatttgggaacgtaattactcttctgcagccttcatctcaaaatacaaaaatagtgtaaggagtcattttaagatcatccaacatcatttacattacttgataaaaagtgggcaaaaggttaaagtattctgccacttttctgtttcatagctctcagctgagaacagtataggataccagtgggtccgaaacaggtcccatccacatgctccctccttttcccttcccatttcctttctttactaattcttctaccatactttttagtcttggaagccacagccctgtctttgctactgcttcagtcctgtattgcatggcatgactgtgcttctgaacaacagatgccttttgtttacataaatatttaagtaatggttttttttaaatgcatgattattttttaactctagttaagcatccctggataagtgacagtttggctaagttagtgaaagttatttacataatttatatatttattacctgtgacaaatagtttttccttttttccattaatggtatttattattttgtataacctaaactgacttttaatgttacattaatattgactgacccaattactttattaaaaatagtggtcagttcaggtaattggggcatatagtgacatggggcaaaaaaaggatcaaattaacttaaatgtttttctagttggcccttaaattcttgagcatttaacccttcaaaaatttttgagcaactacaaaaatgttttgtaattagtttagaaagcatccttacaaaattagatccatctcagaaatatgagacgccatgtaatacaaagttttgcaacgatgtctcctcaggttgaaaacagatgtgccacaggaagacacttcttaatgtaaaagtccagagacatctgaaaatacatgatgtcataaagttgatttctagataatattacatggatttgatacatactcaatgtattccctcaaaattgagggtgttaggccgggtttggtggctcacgcctgtaatcccagcaactttgtgaggccgaggcaggccgatggcttgagctcaggagtttgagatcagcctgggcaacatagtgagatgctgtgtcttgaaaaaaaaaaaaaaaaaaaaaaaaaaaatcaagagtgctagagaccggtaccatttctccccaacaatctgttattccttgaaaacattttgacatgaatcacttcatgcaaaatggcttcaaagataaacatattaaacaggaatttccagtctgtttatctgctggatgatctatatgacttcaaagttcaagtagcttctagcacaaaattcatgtttccagtccttcagtgagaatgagaaagtcttaagttatgaacctaattctcagctttcctgctactctcttacactggattttatcccacttgttatgctactcgtttctttttggtttgaagtcactattttattcagccgttttctcttcctctgttcagcacatacctaactgatgagacccacagagaagtaaaatttacttctctctgagaaggagagatgagagaaaggtttgcttttatcattaaaaggtatctgttttctgttgtttattttcagatgtcctttcttttgaaaaatattcagtggatatatagatatcaataacctgagcaaagagatattggcagtaaatatcaaagaggaaatttacattcctgttccctttgctaaattattgatgtgttcttataccattccctttgaaaacataatgtgtactgacaggctttgacgtaggctttaaatagagttatgttcccctagtccttttatcagacgatctcacttctaccttgtaaaacagctgtgaatccaaaagtaagaatttgtgagccaactgggaaataaccacagaatcaactcattttaagtgcaaggaggaaaaatgcccttttatagaaaccaaaatatattttacttagttttgtaaatttattcaattccaacgtataaataactctgtaaagacattttatcagtttccctgggctgggatatttttagcatatcaaaggaaaacaaaaaagtcctcagattttgaaaagtaatggattgcattgccttaaacccttggaccctgtccaccttctgtctttgaactgaactggaattattcctctgtttgtgctagaatgtgtgtccgcagagctgggaagagatggagatacatatcccacctcttataatgtgaggccctaacctaggttataattaaaagtttgggagcaggatctacaaaggccagctggaaggacaatttcttagtaaaagcaaagtgatgtctttggttacaggaggaaagggaaagacaaaacataccaaccagaattggcggtctgggcctacccagtcctatatacagtagttccttcttatccacgggggatacattccaaaacctctagtggttgcctgaaacctgggagagtactaaaccttatatatactgttttctcttaagcatgtatacctatgatcattcaatttataaattaggcacagtaggagattaacagcaataactaataactaataatatcaattataaaaatatgccagcatcactactcttgtgctctgaggccactaagtaaaataagggttacctaaccacaggtactgtgataccgtgacagtcaatctgataaccaagacagctattgagtaacaggcacatagtgtccacagcatgggtatgctggacgaagggatgatttatatcccgggagggatggagtgggacagtgtgagatttcatcatgatactcagaatggcacacaatctaaaacgtagttctgtaattttccatttaatatttttgaccgtatttgactatgggtaactgaaaccgtgcaaagtgaaaccgtggataagggaagcctactatatcttcttagtctcttaggacacttttgagactaaagccaactaggaaaatagtttttagactctctctgagcttcagggtatctgtaaacatttgaagataatttaatgaatgctgtagttaatattttgccatcttcaaaatagcttcattgttatatccaataaatgtttctttaaatttatgttaatgccttttatctttggcatagattggatttttatttaaaactttatttaaagaaagagattctactactatgggaaaaaaatatttacttagaaaaatatagtggtggccagtcctggtggctcacacctataatcccagcactttgggaggccgaggcgggcggatcacttaaggtttgagaccaggttggccaaaatggtgaaaccctgtttctactaaaaatacaaacattagctgggcatggtggtgcacacctgtaatcctagctactcaggaggctgaggcacaagaattgcttgaacctgggaggaggaggttgcaagtgagccaagatcacaccacactgcactccagcctgggtgacagagcaagactctgtctcaaaggaaaaaaaataaagaaaagaaaagaaaaatatagtggtcttggagaattcagtgacaggccaaaccattaagtctgtcatcacaacagtccttagggaactgcaatattataagtatagtaatgacgcagtagagaaccataatgatggcctccccggcaaagaagaaccaacccgtttacgcctgaggttgcaattttttgaatttttgcagtcagaccctggcgatgaccttgagcagtaggagataaattccacatgcttagcgttccagtaatggaacactaggcataaatgggttattaaagtatccagaattaacatgcttagctgtgacattggaaaggcaatgtgtttgctgtggcacacatactagtaaataatgactggtccgaatttggttttcgtttgtctattaaagtcaatttactaaggcagggagggcccagagctgtgctgtccagttcaatagccatgcgtgactgctaaggacttccaaagtggctagtccaatgtcaggtatgctgcaagtgtcaaacacacactggatttcaaagactaagccaaaaaaatgtaaaatacatctcaatattttggttatactcggttaaagaaaataaaattatttttgcctttttatgtttttaaaagtggcttctggaaaattttaaattacatgtatgactggcatcatctgtctttggccagcactagactagaataataggttttataaagatgtctattgttatactaaaagtgtgacgtaaactttagttatttaggagactcttagtggaatacatgattttcttgacagtgaggggtagatgaggcatcacatacttgaacagttagaaccactatctttttaaaggttctgtgccagagctacagctttaaaatggagggatcaggaaagcatgcgtttgtctccagtctttcccattggccctacatcaaaatgaggacatagttactaagtactttgtgtgctactgctctatttcttgttttggaggggatcaaaaatataagacagggataaaggaaggttttttttacagtgagaccagttgaacatttgaaattattttaaaagaataatttatttcccaggttggtggctcattactatatttttttaattgttcattttctgaataggcttctggaatttaatttctgtacttaattatatttatctttgacatgatctttataccttggtttgcaggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 194 - DNA, 29819 bp, Homo sapiens
  source 1..29819: mol_type = genomic DNA
tgggggctctgggcgccagggtggccggggacacacagaagcggcagccaccgaggagggagcagtgccgggagccccgacggcgccttgctgcatggagctgggccgctgacagctgtcgctgcccgcagcctctgacctccctgggaccccggcgtctgaggctcatagtctgctccctgtcttctgtcagcctcagggcatccagcgtctcaggccgacctgggtccctgggacccggcgtttcggcttctcagccatggagcggtgcagccgctgccatcgcctcctcctcctcctacctctggtgctggggctgagcgcggccccaggctgggcaggtaagaggagtcctgatgcctgggtcctcggagtcaggctggagctctgagtgtctctgggaaggggccagctgatgcctggggcagcagcttctgagtctaacaaggagatttggggcttcaaggctacaggctggagggcaggacacctgtgttccttggcatcagggtaggaatctctttgtccttgaagtgactgggggagggcagatagggctgaaaggtggaggaccactttagagaccctgaatggggatggatgcttgtcttgagtccttgggaagagctgaagatggccagggccagcccggtccagtcattgctggtgtggggatggtagacgccaatgttgatgggtgaggcgtgtgtgtcttatggcctttctgtcgatatctctgggataaggggtgagcacctgtgattcagagcagagcccagtaagcccagaaagaaaggaagccttgactacctgtctcattggcctcctggacagggtccccctccccctccctgtgccctcgatgctgccacgcagctggctctggggagcactggggctggctgccaacaggacggccctccggacaggccaggatcaggtgtctgaggccagagccaactctttgcattcctgcctagcccctcctccctctggccagccaggctcccctgggaccctggtgcccacaaccctgatcttttccttctttttcccaggacccagaattcctggcttctaggaaaggggatttgatgtcaaggagggggctgtgagcaccaggtcctcagcaggctggaaaaagcccatttctggagacactgagggctgatttatatttaacttgactattcaattcttctctgctttagagagaaaatggtcagaatggcagcacaaaagatttagattagattacagaaggaagaacttccaagatgtgaggacagtgaagcccagggccaggaaattgaggcgtatggtgcctgtagactctaggagtctttcttagggggaagagggatcctctggcatggaggcagggggatggctaagatgactgtttcttatttcaggggctgagtgggtagagatgggactttagggaaatgagttactgtagaattcctaaggttagagaataaggcatttggggggccagaggtagagtggtggagggtaatggggctaccagtggagagcctgtggggcagatgaggctggatacaggggggcaagtatgtggcctggtgtgggaagatggtgggcggacctgtgggtaggttgtccatatgatcgaattgtactcccttgggatttggtggagggtggggacctccgaggtctccttggcctggggtctctgtgagtctctgtgtctctgtctcactcacccttcgtctctcaaagcggcccttgtgtgttggtgtttgcggagctgccacacgcgcaggggccaggcttaggtgggggttgggggggaaggccgtggtttcccggctcctggactcaaagggccttttctctgcctgcccgccccacctcacccaccccacccagctccactctcctgattgctctggcctctgccctgccccacacttctatgaaagttttgctggaactctctttgggatttttccaatctggagctgatggtgtgaagagtatgtgtataggggagcaagtgagggcaaggtgatcttttgttttccagggagtttgagccctaggaagctgagttctagttagacagggctggtgggctggatcttgaatctttgggtcccaggtggtggggttggtgggggtggtgagacaggattgaggttccaggtgtggggagcttgcctgggttctgggcaagcactctgatgggatccacagatgtgtggctcagggccctggacctgttccggctcctcgtggcagcttcagcccctgccccccattcctccacccctccccaactcatctcctaaaccaggaggcacagactcctgggagagctttcttgtatctttttcctcagcatgctcagggttgttcccaccccatcccccaaacctgggatctgtagctgcttgaagcccctctcatagagctgcttctctgatctcttcctcgtggcccccctgcacctcctgtgtccaggatgatcgattgcccagatgttgtttgtgctggagacgggacagatgccagagacccagagagtgagagatatggaaagagagtgagagcgagggagagaaaaagatggacagaatgtgagagaaatggaggaagacagaagagacagagacagaaagaccaacataaagagacagagagagtaagagagtgagagagacaggagacagatgaagagttgagagaagtattcagagagtacagagagagacagattcataagctaaaagacaaagagagagcgtaagagaggcagatgctaggagagacaggggcaggagtgtcatggggttgaatgccagctgatgctgccctgcctccaggtacctttgcatttcccatccattcaggtactgttcagaagcaagtgagggtgaggtgacctttcccttgcagggagtttgagccctggaaagctgagttctagatcccaaatgtcccctatttatgccctcctgagggcatgtcccttctcctgataatcatggactctcccaggtgcaccccctgtggatgtgctccgggccctgaggttcccctccctccctgatggtgtccggagagcgaaaggcatctgtccagctgatgtggcctaccgagtggcacgacctgcccagctcagtgcacccactcgccagcttttcccaggtatgggtgacatggtggggtaggcctggggggaggtaatgggatggggcctaggatcagacaccaggaggaaaggggttgtggcggctccctttgcctctcactctgtgtgtatctctctcggttactaggaggatttcccaaagatttctctctgctgactgttgtccggacccgccctggtctccaagctcccctcctgactctctacagtgcccagggtgtccgacagctgggcctggagctgggccgacctgtccgcttcctgtatgaagaccagactgggcggcctcaacctccctctcagccagtcttccgaggcctcagcctagcagatggcaagtaagtttgtttgctcctctggtctgcctggcccacactttcaggaggaagtgcccccaaacccctacactctaaactgtgaaacccttgagaccctttgggccacaccacacctacccactgcccaaacttcagtcacttctagtccagagtttgggctttagagtgtacagccttctctgcatgttgaactagcctgtaccttgggcaagttacttaaaatttttgagcctcagtttctacatctgtaaaatagacattaaatagaattggcacaaataagaaagtgacggcatggtgtctggtgcactgtaaacactcaataaatggtagccattgttattactgctcttatcaccattggcttcaactcttatcactgctctccaaccatgttgactcccctacttcagtcagccaagagttcacttgaacctcttccaccatttccaggtggcaccgtgtggctgtggctgtgaagggccagtctgtcaccctcattgttgactgcaagaagcgagtcacccggcctctcccccgaagtgctcgtccagtattggacacccatggagtgatcatctttggtgcccgtattctggatgaagaagtctttgaggtaaccagagcaatcagaggcaggattgacttctggtcccctatcttgtgcccactacccttctggccccagcatgtcatcttcctattccctaggccttcatttttttttcttatgaattttcatttctattttctatcttcagggctactgttctctgcaggagaactagatgcctacctatatggcaggactgtccacagccacttactctgtccttcagtcttcatcagttccctcatccatccatcctttcaacccctctctctcctcacccacccatcaattcactcactcctcagccaacctatgcacacatccaccacccactcccccatctatttactcatctatgcatcacacgcccacctagtcatgcatgaaggcttatatccacccacctgtcaatcctccccctgcttaaccactctccccttcaaaccacccatctatgcttccacccatctatcctcttcaactcctccatccagctattcactcacccacccaccctccccatctacccatgcacacaaggatgcatgcatccattcagccaccatctatccattatccttccaccaactcaaccactccctccttcaatatactcactcacccatctcctgacccacttacttcccatccgaccagtcattcacccacataagttcacccatctacctattcacccatttgcttccatctactctgtaacccctgttcatctgcccaccagtccaccctcccatacgtacatttattcattcactatttatcaatgctcccattcattaatgcatgtaagcccccagccacccatccactcatctatccattcatccatccctccattcacccatccctccattcaccctccaagccagtcaacattttctgaatacctgctggacaaggagaacaaagaagagaatataaagtctctatcacccccaagagctcccaggtgggctctggaaatgagacaacatccctaaattacggtgcaatggagagtatgctaagcaccatgtgtgggcaaaagtaaatgccattggaactcaggaatgggttctccccactccatttctagaggtccagagaattctcatcatcactgccattggaaggccaaggcatctaaagctgagccctgtctctggaagccactgtggaagggctcatgcattgccacaaagcgcagaggggaggcaaagaattctggaaggcctgggatctggtcctgattctgccactctgggtgaccttggggcagtcattgcctttttgggcttttctgaatggaacgtatctgaaaaatgggtagaaagaaagatccttgttctgccaactttcctggttgttatgaaggtcctatgagatcccttgaaaactgaaaagggctatgcatatggaggactgacagtgaccttctcccatcttagggttttacctaggattggcctcctatactctttctcccggatgataccctctgcctctctctgaatctctccgctccatctctctcatgtctttgcagggtgatgtccaggagctggccattgtcccaggggtccaggcagcctatgaatcatgtgaacagaaggagctggaatgcgaggggggccagagggaaagaccccaaaaccaacagcctcacagagcccagagatctccacagcagcaaccatcaagacttcacaggccacaaaatcaggaaccccagagccaggtgagggagctgggagaacccccaagtgcagcacaccccagagagggaagacacccaggcatctctcctccttagttgtcctccccaccctcatctccctattcccatcaccccctcctcctagtcctcattcatcagcctttttattttcatctaaaaataaaaagagttgttatgaagaatttgtggctgggagctgtgttccctgctctgcgtctcctcttccagtcttcctggaactgtgtccctgggttttcccttccttctttgaattaagagattgggagacagtgggagaggggtgagagctggggaggcaggtaggagaggggactgaagccaggagaaagcagtcgggatggtgagaccaaggaggaggaatgggaaggagtagggatggagggaatatcaaaggaggggtgggtctgcagaagtgtgggagtggggaacccagtctctggcccccacctacctggaggggcaggaaaaggggaggtagtagggggaagggaagggaagggaagggaagggagcctgggttggatggggtctggagagttagaatacagataggctctggggtcagtggtctaaagatcagagggtcaatctcttaatcatgtctgcttctgccccacatgtggaaccccttccctctgttccacctctccccacctccctcctgaccctcaacctctcctttcatcttcaactctctgtttcccaactccacacctcccccgtttcccaactcccacaccatctttatatctccctctcccgcccttcaccccacaccttccaattaccccatccccttcctgtctatgcccaccccccaatcccagcccactgagtctctctactatgactacgagcccccctattatgatgtgatgactacggggacaacccctgattatcaggtaaactcaagggaccccttcatttcttccctttctcccagcacccccagcaatcatctcctaggacaccttcctcccctcccccatgccgtggggagaggcacagtgtgtttagattatggggatttacttagttcctgccccctccctgtctctctgctgcagcgccctgggagcccccaccacaggcctcccccttcccctagggggcatcggacccctccctgaaagcctaccccacctgccaagaggtcaatgacctggcaggcgtccccctcaccaggccggaggccctctccaactgcaggctttgacccagcatgggagcagcctcccctttcccgatgcccagctcggagggcagcttcccccactgcctggccccgccccaggaccagaggcagcagttaccggcaggtagagccggggcatccagatctctgcccccaaacctctatgaccttggaggttcactctccccaaactatccccctccaaaggggctgcaagatctgagatttcccccatcccccagcacagacagaccctgccctcgggggacaggtgctgctttgcctcccttctgctaacctttctccttccttcccaccccgtgctactcttctccttctctccttggggtcaggaccccaccccaggtgaagaggaagaaatcctggagtcgagcctcttgccaccccttgaggaggtaactctatgccccaccctcaccccatctgggggcagtgggcacctgtgactcactcccctcagcccatgacgtcttgatggaccagcccctcctctggccggagggttcttcctcatttccatcgatggcctctgtctttgggtcactctagaactatgggcctgcttgactctctaagtccagcccgttcccttcagtatccaggcctccttccatgattctttgattcctgagtgacttcgtctccatgttggtgtctaatggtcttactttctatgtcctatttctgttcccgggagccactttctgtccagtgttgtcaccttttgtcttccctatctctttggtcattcctggactcctttgtctgtcattgtgtccatggactgtccactctgcatccagtcctctggccacccttcattttatccaccacttcttcccactggacccactttctggacatctctccccatttttggcctttgatggcccttccatttatatacaaccactcccatggctattcttgggagaaaaaatccagttctgattaaccttggaatcctttgggctagaagttgtcacaccctggggtccagggtaagcctcctctcagccctaacatccccatctacccctctccctccccatccctgggaaggagcagacagatctccaggtcccccccacagccgacaggttccaggcagaggaatatggggagggtggcacagacccccctgaagggccctacgattacacctatggctatggggatgattatcgtgaggagacagagcttggccctgccctctctgcggagacagcccactcaggagccgtaagtgaaaggagcttctctttcattcttgactaccagtgggagctacaagaattgcttcttgttggtttcgatccttggctgttggctgtgagctatttcccatctgtgacttgtcattttctgttcacatatgatgtatatgttgcttgaaaagattactacctgccttcctttgccaaatgtcttaccttgtgactcttgtggatacttctgaagctcagggcaattgggaattaaaaaaaaaaaatatgtagccacttcctgtctttcttgatcacttcctgtctaactgaagctggatttcataaagcttttggtcaataaactactaccttgtgtccattttcagtgtttctctatcatttcttcttggtgaaataattttttgttcatgtttctaccaaacgatctaacttcctatgtcacctttttttaacctacaggccacttattatctgtcccttcctgccttctccagctgtggcatccatcttggtaactgtgtcaggttggactgcaaaggatttattatttctgttctggctctagtttttcatgctatcttgtgacaatttcctttgacaataagccacttcctgtatgtctcaggtcatttaaatcataaagtttccattgtgggcctcgatatttctcatggctacttcctgtgtgtcctagccttgatgtttgtgttttctggaagaattacccttcactgtcatgattccctttgcaggagtcacattctacctgttttgtgcctttcttttctctctgggtcacggtagccatgttgttgttgaaggttcacttcctggatcctctttccttcactgcttcctgtctgttcagccacttcctgtttgtccagtttgttttctagccatgttggccatgtttaattttcttcggccctggcatcattcttgcttccaagtgtttgtcattttgttctgtgtcccttagttgttctcatatcttccagtattccctgtcagtgggactgcttcctgtctactccgctccgtcttctgcctgccttgcagttctggctgcctcctctaccctgctgccgcatcccatacctcccctctcttgcctcccttgagcttctactgcctttcctttatgctgctctctgggtatttggggttgatatgggatttcagagaattttgaaacggatcattgctgtttggtcagaatgaaggtggagaggggcattctgaagatctttgttggggggagttggggtggtggtgaatgtctcccattctccatgttcttattttgtttctggccctagagttgggaacaggtatctgagtggaggtgtgcaagggagggaactggtgggcttggaatgtacttgagggccagaggaagggcaatgcattcagtggggactgctctccaattttttttttttttgaggcagggtctcactctgtcacccaggttggagtgcagtggcaggatcttggcttactgcaacctctgcctcctgggttcaagcgatcctcctgcctcagcctcccgagtagctggggttacaggcatgtgccactgcgcccggctattttttgtatttttagtagagacggggtttcacatgttggccaggctggtctcaaactactgacctcaaataagctgcctgtttcggccccacaaagtgctgggattacaggcgtgcgccaccgtgcctggcctccaaatttacttagagtatggatgcttaacctttggggcatatttaaacttgtgaaccctttgaaatcctaaataaaattctgtgcataatagcatatactttttcatttctggagaaagactcacagctttcatcagattcttttttttctttgagatggagttttgctcttgttgcctaggctggagtacgatggcataatcttggttcacttcaacctccacctcctgggttcaagctattctcctgcttcagcctcccaagtagctgggattacaggcatgtgccaccacacccagctaattttgtatttttattagagacggggttgcaccatgttggtcaggctggtctcaaactcctgacctcaggtgatctgcctgcctccgcctcccaaagtgctgggattatgggcgtaagccacctcgcccggcctagcttttatcaggttctcatgtgggtccatgccctcctcttaccccaaataaaaatctacccacaatcttagagagattcttttatgatgtattggggtaaatgtgtggaaggtttcttaaggttctagggagggagtttgggagatgggatagggtcctctagaagagggtttgggaaggtgggtggtttaaaatccctgaaaggggccaggtgtggtggctcacgcctgtaattccagcactttaggaggccaaggcaggcggatcacctgaggtcaggactttgagaccagcctggccaacacggtgaaaccccatctctaataaaaatacaaaaattagccgggcatggtggtgcacatctgtaatcccagtgtaatcccagctacttgggaggctgaggcaggagaatcacttgaacctggaaggcagaggttgtagtgagccgagatcgcgccactatacttcagcctgggtgacagagcaagacttcgtctcaaaaaaaaagaaaaacaaacaaacaaacaaaaacactggaagtttctggggaccttcctgaaagaggctctcagggagatggagaggttgtgtttgctgaggtggggctgggaactgggggggcagggaaccctgaggtctccttggcaggcttgaaaggtttgtgaagagggagttttaggggagggctgtggggctttcgggtagggctgaagtggtctcgagaggatctaagaatcaaggttggagttgagatggagaaaggcctagtgtcctggctgctcacgggccccactgggggctacatgtgtgtctccttcaggctgcccatggaccccgagggctgaagggagagaaaggagagcctgcagtgttggaacctgtaagttatgctggtcacagggctgaggcagtggaaataggagaagcaagtggggttgagtgtgctggtcctgtcgcctctgatttttaacctttgactccacagggtatgctcgtggaggggccccctggcccagaaggccctgcggtaagtctagcagtgacctggtggccattcttttcttagaaaccccttctatgtgctcatctgagccttccccacatatgcccaggcctcctcctcagaactcgggagcatccctccaatcaacgcttcccagattcccagatctgttctgcacagaccactcctcagccacaggctgagtgtccacacctgtctgaatgcccacacctgacccctactcttttgttcctcagggattgattggtccccctggcatccaggggaacccaggcccagttggagaccctggagagagggtaagggggtgtcctccatgtgacgggggagcttcgggggagctagtggtatccaagcggggggctaccatgcccagtaatttcctgttaggtggcttgttaatgaatgaggggatggttgtgcttcccagcaaccagaaaggagggcagactctggttggggagggtgctgatctggtttctcaccctcaattttccccatgggggtgggagactcaggaaagagctagagcaatctacacttattctgttgaagaggatatttcaaaatcatgctaagatcttgatgtccccttatctttcaccccatcttttgcattctcttcccactccagggcccccctggccgagcagggctccctggatcagatggggctcctggtcctcctggcacatctctcatgctcccagtgagttgtctcttgggttttggaacatgctgatggggaagacaaggaattgtgtcatgttaccaagaaccagatgggcaggaaagatatggaggagtctctaaagatcatcaaagatcatcactccaaagggattcgtctttggggttggggagatggggcctcattaggtgacctagaacaaaacaccagtcttctaggactgggcagaacagcctatatttcaggagctctagaaccaaaagagagtctttctggaggcagaggctggacagtggaggagggcaggagttgagtttctggaatcctctaagtgattatctggaagccatgggaaatgctggatgggcagaacctggggcaaggggcagaaacgctggagaaagcctctggctgggagggtcccatggctttcttggaagagaacctggaccttctctccttgacctcagttccggtttggcagtggtgggggtgacaagggccctgtggtggcggcccaggaggctcaggcccaggcgatcctgcagcaggcgagggtgagtggggctgcttccctggaaagggaaggctctggggggcactggaagggttggctggagtgagtgtgcggcaggggaggcctgggttggtttggggttaacagggaggttggggagaatcctgggcagtggatgaggatcaggagaggaagggtgaatttggagagtgctggggctgggggttcccactgcctgtccctcagctctgctgtccccctgctcccctagctggcgctccgtggaccccctggccccatgggatacacagggcgccctggacccttggtgagtgagcagggtgctcgggtggaggatgctttaattgtgtgtggggtgtggatagttctggaaaggggcttcttttggggaacactccgaggccactgttggctgtgtccttccttacggccatcctctcttctctctcccagggccaacctgggagccctggcctgaaaggagagtctggagacttaggacctcaggtgaccactttcctccactgcacccccatatctgttcaccagctcagtctccctcactcccctccctatgcctcctaaccccaccccatctctcctctcaccagggccccagaggacctcagggcctcacaggccctcctggcaaggctgggcgaagggtgagtgccccaggggtggatgggtgttgtggggagacagggcctgcagggtaggggactgcggccctgcttgttctgacacttcccttgttctcccagggccgggcaggtgctgatggagcccgagggatgcctggagatcctggagtgaaggtaacaggcttgggcccctccctgaagcctgtagccttcagcccacgctgggctcagttgtttcttggggatgacctagttctccaggcttccccaggatcagcacccccccagctcagggtgcagtagggaggggtgggcttggacagggtcgtgtcctcactctggctatccttcctcctcctagggtgaccgaggttttgatggactcccagggctccctggagagaagggccatagggtgagtacattagtgggtgtgtgttgtaattggggatagatcttctatgggagtgaggataggtagggaagggaggctggaggcttggcaggagctcagtgaaagtaatggatgggctaagtgcagaggttcggtgtctgcctgtgttgggggctctgaagcccctcttatgagttcccccattttgcagggtgatactggtgcccagggccttcctggtccccctggtgaggatggagagagggtaagtgtagtggcaaatgtaggggctgggtgcaggggaggtctagaaggcacagcagctttaccgtgtcctcctcctccagggagatgacggggagattgggcctcgagggctgcctggagagtcggtgagtgtccaagggctggtgctgggggagggggctctggggaagccaggagggggacatgagcactaaagggacacagttttatccattcatgccgtctcctcccctcaccgtgaatgcagggacctcgaggtctccttggccccaaaggcccacctggtattcctggaccccctgtaagtgactccctgacttctgaccctgaggtgaccccttgacctctccaactctccacctttctagctgccttcctgctccctctcctctctcggcatgcttcccattccctgtgagctccccctgctctggccccacactgccctgcctcagcattcgctccccgtgcacagggagggccatgtggcgtggtgccctgagggctctgggcataggaaataaatcttcaagaaaaacaaaaccaaagcccacaagcccacagatccacagtcccacacactgcaggcctgggccagctgtgtttgcttgggtttgggatggattggaggtctgaccgtcacaccctcgggaatggccgggcctctgaaaaccacaggtccctccgggccaccttcaggctgctcacacccatcttgtgtttcagggcgtccgaggcatggatggtccccagggccccaaagggagcttggtgagtgatggataggagatcccacccccattcttatcccccgaggtccctgccagcatcctgttggccgccattttgacccctgcctgcttcctgctcttgccttcttggctatcgctgctgggactcagctccatgctctaaatgtgttctatctccatctccttctgacctgtgcctggtcacctgtttctagggaccccagggagagccaggacctcctggacaacagggcacccctgggacccaggtgagcggtgcccctactccgttccccaattttcatgacttcccttgggcttccacaatgggtgagaccctggaaggatacaggaaattaagggtttcaggcccttgttgctcatgctttgaatccgggaggctggatagaagagaccctgggaggcccctgtgacttctctttccctgtatgtagggtcttcccgggccccagggtgccatcggccctcatggagagaaggtaagtgactaagtgatttggaggacagggggtttagagtggggatgtagggagaaccctaaatgtctgctgggattttgtctgtgtccagacatgacccctctagtgaccctgagcctctttgtcttcctgcagggtcctcaagggaagccagggctccccggcatgcctggctcagacggacccccggtgagtgggaccccacttccgaatccagttccccttggccttccaccccagtgcatgacctcagagctcctttagtgacccttgcactgaaaggtcactggtggtgcttgtccatggacagttggcttcactaggtcacaggaaatttgggttggaagaagtgtagggaggggtgcagagagggtgacaggggccactggtcacattttctatcccttactcccagggtcacccagggaaggaaggtccccctggaaccaaaggaaaccaggtgagatcttccatgtctttatcccctgagggagtctccactcagactctagagcctcaaagtccttgggattcccttgtctcattattcatatggctctgccacattctcaattcctgtgccccgtaaccctacccagacagcaatgttgttacttccatttcttccacccctggaggcccccacagtgacactctgaggcccctttataaatgcctctcttttatcttccagggtccctctggacctcagggacctctaggatacccaggacctcgaggggtcaaggtaactgaccaccaggctgggagacaaagggctgtggtcaggggagctatatggggtcttaggagcttggtccttccaacccacctccatcccctgatcagtctacttctatcccctctctaattctagggtgtggacggaattcggggtctgaagggtcataagggtgagaaggtgagcaccatgcccccagcttcccagcacctcagtcctgccatctcctctcttcactgccttccctccagcctgccccgcactgccgtccagctcccgagcccctgcttccacctatgttctcagaattcccattagaaccccagccctctgtcatctgtggtgccctctcacctctatctttctcagggtgaggatggctttcctgggttcaaaggtgacataggcgtgaaaggtgacagggtgagtagagaccccacactggccccaattccgtgttctactgagcctccactctggagacgccaagcaccggtttattctcctgagtctccagactccacagttccagtgctgtgttcccttgggagcctgacccctacaggatgatagccccatggtctgtgtcatgcctgccctcccatcactacactatccctaccctgtgggcttcctgtcctgcagtggctcctgggacccctctagccctcctcagcctcactgttgcccatttctcctctgggcccagagcccacctccagtccccagcactcacctgtccttccctctcacacagggcgaagttggagtccctggttccaggggagaggatggtcctgaggggccaaagggacgcactggaccgactggagaccctgggcccccagggctcatgggcgagaaggtgatgggatgagggttctgtgcctgggtcctctgggggtgtgggcactggggtcaggatgggcatgggtgcccgccgctgaagtcagccagtcagttgaagatggccatgcattagtcatacttctgtctgtgtaaatggcatctctcagctgctgatgggcagaggggatatataagaagtcagggaaaagtccctgacacgaagagttggacggagacgaagcttagagagtagctgttgcttcaaggcagagtgaacatgcgttcggactccaagcagcaggagttctgagatgagagagtctaatagcagtgaggtctgtggtctccagagctgactctccccagcacttgccctgtgccaggtgctgtgctgatgcgtcctatctatcctatgaggtaggcatgtgacgtactgttttgctgaggttttacagaggcacagggatgcttgttgattacatggccagtgaagggcagagccaggggttatgcccaggcagtctggcttcagaatctctgcttctaagccctgctctgcagctgcctgggcaggatgagccctggagcctctggggaagggggcatgcacgggagtcggggtgtggtgggcaaagggcctgcagggggattggtcttggtgaagcaggagtgggtgctggggtagatcccacctccctcatggggtagatggagctgaggttgacatgtgggaagcagctagatcacagtgaccctgaaggacctgatacctctgtaggcgcaggggaggtgggatcccagcactagaattggggaaaatccactcacgggaaggagagacaacaaaagtcaggcagctgtggggcaagcaatgaggggctagaggctggggtgtgtggggtgtgttgctgggtgggggctggctgttatatgtgagggttgaggtctccaggggtggagtggcatctgggcctcctctcactcctaactgcttcctgtccctccacagggcaagctgggtgttcctggtctgcctggctatcctggacgtcagggacccaaggtgatgccatgccccatacgtgcccctcctcctcttccctcctcctcttcgcttccctgatccctgattccagaaagcacagatgcagggcagtgggggaccccagagggaatttagctgacccccattttacagatgaccgaaagaggcccagagagcagcaggggtttgtccaaggccacttagttcttggcagagctcgggtctccctggccactgcctttgtggcctctcctgaccccctttgccccttcctgaaccctacctttcataacttctcaatttccccccttctccgttctcaccaggggtccctaggatttcctggctttcctggtgccagtggagagaagggagcccgggtaagctggggggtgggagggcgtgagaagggaagggctggagaggtgtagagggggtctgtggggagtctcaccctgggtaatgttctctctgcttcattcccaccagggcctgtcggggaagtcagggcctcggggagaacggggccccacggtgagtgcaggggagagaaacaggtggctcaaggtccagaggggggcatttgggtttctctgacaactcctcttccctctgtagggtccacggggtcagcggggaccccgaggtgccactgggaagtctggagctaaggtgaatggtctctacaaggctccaactgccccctgcccactcagccccagctctccctcaacatcctgacctcggggacagctggaaagcagctcttcccactccttgactctgtttccccccacagggaacatctggtggtgatggcccccatgggccccctggagagagggtgagtgtggatcgaaagtccccttcccctgaggtccccagggagcctgggtgagccagctccctcctcaccccaggaaggaagctgagttcccccactcagcccctgcccccattctcctgactccccccacctctgtctctagggcctccctggacctcagggtcccaacgggtttcctggaccgaaaggacccccggtaagttgaccccgagctctgacccacctcgcttctctgagtccttcttccctacctgctttccagctgagagttcacctgacaactgaaccccttccagggcccccctgggaaggatgggctgccgggacacccaggccaaagaggagaagtggtgagtgatgctcctggctacccattctcagggggctccatcagaccctttaaccccagagctgtctggaaagcccacagggacgttctcctggcagagtggagcctgccctggtgctgctcagacccagggcccagggcttggtgtgatcctgcctgggatccttcctcctgggaatctgccccacagcgcccacacctgctttcactgcattctcctctcttcctcgcctagggtttccaagggaagaccggcccccctggtcctccaggagtggtgggacctcaggtaggtttgtccctaggagagaatggacccctgaccctagcattagtctgtctgcccctcttctctcggtcacacgcccctgccccggtccacctgacccagactcctggggctggggtcaatggtgggggctgggatttcaggcaggggtcctgaacttcagtctgttttggggcgcattctcatcgtcttgtcccccaggagaggcagttccccaacagagacacaaggtggtgtagttactccacatggggcaggagaaaacccagcagtggcccaggaatgccggggaatttcccaggagctttggggcagggataaaggggttctgaaggagtgttttagggtggccagggtgggctcttctggcagacagcgagatgaagggcctgagagcaggaactctctctgcttttgtctagggagcagcaggagaaaccggccctatgggggagagaggtcacccaggccccccggggccccctggagagcagggactacctgggacagctggaaaagaaggaacaaaggtcagtgaggggccaggcagaggggaagtgggggagctggggattggggtgctgaaaggaacaggtagttggagatttgagggggggctggagagctctctgtttaatttgggagcatggctgtggctcatcacctctcctttccttttagggtgaccctggtccccctggggccccagggaaggatggtcctgctggtctgaggggattcccaggagagagaggcctcccaggcactgctgtgagtgtgactcccagacccctgcctgtcacaagcaccaagcatcctgagtccccaccccgaccctgtccctgaccccctccatgtcactccccacttccatcttttggagcctgtcttccctctccagctctcacccttctcttttcgtgaagtctcatcttccccaaatgtctggttcatagggtggacctggtttgaaggggaatgaaggtccgtctggcccccctggccctgcagtgagtctggggttccggaagtggtaggaaggacccgggaaaggggtgggtgaggaagggtgggagtggcattctgataccaccaggggctgtggggctgggcagaggctgtccagggacagccagaatgcatctgattttgggagcttttgggaattgtggtctgaggttctctggtatgggcgggctggtgtctccttcctgggggtctgaccatctgctttctcagggctcccctggggaacgaggtgcagcaggatcagggggacccattggtccgccagggcgcccaggcccgcagggtccccctggagcagcaggagagaaaggtgtcccagtgagtgtgggggtattggggaggggtactggggaggggtctgtgagcctagggttgatgggctatgacaagtttcctgtggggtgtttgagggtgagggtcacctccaggccatgactccttcctcctgtcccacagggtgagaagggccccattggcccgactggccgagatggagtgcagggtcctgtggggcttcctggtcctgctgggcctccaggtgtggctggagaggatggagacaaggtgaggggaccccacagaccccgaccaatcttctttccagatgagatggctgacctgggcatgacccctggcccctgtcatgtcatccttcccactctacccatcacctttctctaatatcttgtctgccttctcctcccagggtgaggtgggggaccccggacagaagggcaccaaagggaacaagggtgaacatgtaagtgtccatgaccttgacttctgacctcctggcctttaacctcagtcccacctgatctctctccctgttttggtgtctctgactctcttctcttacccagggccctcctggaccccctggacccattggtcctgtggggcagcctggagcagcggtgagtgacccctccacccccaccgaaggcccagcagcctctggtcctccctcagctcccctctgcccttgtggctgggagtgggagcaggggctctgggcctggcacccagctgtgtgtggtatttgtggatagagaacacctgacccatgacccatccctgtgtccttgtctctgctttccctcaaccctgcagggagcagatggggagcccggagctcggggaccccagggacactttggagccaaaggtgatgaaggaacaagaggattcaatgggcccccaggacccattggcctacaggtgtgttgggggataggacaggggctgagaggtggggtcaggatggggtgatgttttgccccagactctgccagcagcctgccgatgcagactggagggcctgcggagtctgaggggaggggactgtggggcctatctgcctagggctgtgctttgggtggggtcgtcacctgggcccatgttttgtatacttgcacagggtttgccaggcccctctggggagaagggagaaacaggagatgtgggtcctatggtgagtgtgacccctactgaccctagccaccatactagtcacccccctccctggccagcccccaccccacaccccactgccaactccctggcctggctgctcctcctcctctctccaccattcatgctcagccatctcacttcccttcctcatctgtggtgtatctgtttcccccagggaccacctggccccccaggacctcgaggtccagctggacccaatggcgctgatgtgagtcatctcagcccctgtcccttgagaccaatgtgtctggtcttctgcctccctttcccagaccataaactctagtatcgtctcaggggccaagagaagcccttactcccgggaggcctccactgcctcactgctgtaaccttgggctgctcatctgggactttgcccctgaaatggcacctccatcctaagcaatgacacctatttctgttcctcttccagggcccacaaggtcccccaggaggtgttgggaacctgggtccccctggagagaaggtaactgggaagggggtgagtggaccagtcatggaagtgggggatgggagttggatttctgccaattttgggtggggagacaaaagagaatgagatgtggggaatatcagaattttttggctggggaaggagaggaggtttttgactctaatctctttgcagggggaaccaggagagtcaggatctccagggatccagggcgagccaggtgtcaaggtgagtgacagctccaaggccttactccccagtccccgtcacccgcctcaaccctgcctccacttttcctgtgacctccttgagctggaactcctctgcagcaagagtctctgctccctgccatcctctatgaggcctgatccctggtctgagtgagcccttcttcccctttcttgaagggaaggggactagggaactccccttgtaggcttgactttctgtgtatgtcccattgtcactgaggggagtaggggatggctgaaggtgtctcggaagcagaggctgcatccctgatcttcaagattccctgggccatctgtgtcctccgcttgttctgcagggtccacgcggggaacgtggagagaaaggagagtcggggcagccaggagagccagggccaccagggcctaaaggccccacaggcgatgatggccccaaagggaaccctgtgagtttggggcagtgggggctgagtcctctcaggccctgtgaatgacagacctgggaatatgggtgtgtgtgagggaggatcttggagtgtggggagcccgggagtttgggggatgctctgggaatggggcatccagagggatgcctggggtctaggatccggagagaaagtgagagatgccctgcagttaataccttgaggaattagacaacacgcagtgcacgtggtagggaaaggggtgcaggagacctcttcctggggggtactggtgggcactgcctctagagaggcagtggcgtgtgcctgtgggcgtctgtgctgggtgggcttagggagctgtgaccctgactcttattctccatctggatcagggtcctgttggttttcctggtgaccctggcccccctggagaaggtggccctcgggtgagtcttactcagagaagggaaggggcaaaaagggtggggcttctatgggggggtcctctgtgtggccgctgggcttgggtattgggaagccgggggtatggcagggtgggcaaggggatggggtattgacagttttggaggtgatgccagccaggttgggggcccacctctgaccttgcttcacttctgcagggccaggatggtgctaagggtgaccgaggcgaggatggtgagccaggacagcctgtgagtgcctggtgaccccaccacccccctgagcccaagcctcatcctctttacccctcttctgtgccccactcctgaggggtcccttggctggaggataaacactcagccaccccaattcctctctccctagggatcccctggtcccaccggggagaatggacccccagggccacttggaaagcgagtaagtgaggtggacccctgagaccttgggaggcagtccctgggctgtgtgggtggaggctgggcaatggcaggtgggatgggtggggaggtgcctggtgtctgcattgccctgggtgtgtgtgtgtgcaggagctggtgggtttaagggcgtgtggtatctcattgcccggggcagggtgtgtgtgcaggagctggtgggtttaagggtatgcggtatctcattgcactgggcgagtgtgtgtgcaggagctggtgggttgatgggtgtgcggtatctcgggcatgtttgttcctgggttctggtgtgtatgttttcaccaggggtagtggtggttactgacaaagcagaatggaaactggaggaggggctggccagcttttctgtgggccaggggtgaacctttttagtttctggggcaggagacgggccaccaggtagggtgtgggcaagtggcccttcaccaaatgtacagactacccagtattttcacaactgtcacagctgtatctgttctgcacatctgtgaatcggccctcggcgcgtgtccctgtgtatgcacgtgtgtgtgtgcatgtgtatgtgtgtgtctaggacaggaagggggaagagttgagcctggctgcccacggcctcatgtgctcttccttcccactccacctgcagggtcctgctggctcgcctggttccgaggggcgacaaggagggaagggagccaaggtgagggacaggctgccctagtgctggagcatcccctccgcctcccacccctcagatgcctccgtctccagatgcccaccccatctccacctctcccatgttgggcccttatggggacaggcgttccctgtacttgttcctgcgctaggggctcctagagtttggcccttcctccctgcctcctgcctcccaccttggaccctctgccccctgcccacaccccactcctctgccattcaggacacattccttgtgtgtgtttcagggagatcctggcgctataggtgccccggggaagacaggcccggtgggtcctgcaggcccagcagggaaacctggccctgatggtctgagggggctcccaggctcagtggtgagtcactgcagggaagggctgggctggggtgggagtgaggggccatgggaggggtgcagtgtggggatgctcctcctgacccctgtggccccctcaaatcttcagggtcagcaaggccgacctggagctacaggccaggctgggcccccaggtcctgtggtgagtgactgggattgggctgagtgaggggtgagggcagtgccctgggacagagctgaagccctggaggaagtggaggctgttggggagaacttggtcccacctctcccttaagagaatgacttcccatctctccacagggacccccagggctgcctggtctccggggcgatgctggagccaagggagagaaggtgagtgacagacagacacgtggccaggtgtctctcccatcaccctcgcccctgaaacctgtgggacccaagtgcccactgctctgcttcaggcctccggcagccagtcccagggagtccctgctcagtgagggccactcacggaccctgtgcccggctccctctccatgtcctcttggcccttctcccccatccacatgactcctctttgcattctcttgactgcctgcacccttctctagggccacccaggtctcattggactgattgggcccccgggtgagcagggagagaagggagatcggggacttcctgggcctcagggctcccctgggcagaagggtgagatggtgagtagagggcatggtcccggaagttgtgggggttgagagtggggtggagaggggtggagttggagttgggactcagctgtgggtaagcgagcaggtgctcaggagggtgtgggaggaggacccagttgaaccagccactacccttcctagggtatcccaggagcatccggccccattggtcctggaggtccccccggcctccccgtgagtactgcctctgttcctccacaaaatcccctaaacccctctgctgcccacccacagcctcccaacgacttccatggaactaccagcctaacaagcatagtcctcagggtcccccatttgtcctgtcaccaccagtacctcctccccatacttccagggctctgaatgtcctagtattcccacaagactgcccctcctgtagtaacccgaggctcctgtggacttgggaccttgcctccccgctcctctgagtcctgtccttcccctgcagtgaccgtctctttcttgttcctcatttcacagggacctgctggccccaaaggagccaaaggagccacagtgagtgacccccttcagctctgacctttgctccaccccctctggacttgatgatgtctctccaggacaaatagactccccccaaggagccccttattccagccaggaggctgatttgatctttctgtgaccttgatccatgcttgacctcttgacccctccatgacctgatttattccttgtcagggcccaggcggacccaagggagagaagggtgtgcagggccctccaggacacccggtgagtgaggagtcagggctgctcccagggccgtacccctctgctccactgctgccacacttcaccctcacaccaaccttgtctcttgccctctccatctgtccctgcacccagggtcccccaggcgaggtgatccagccactgcccattcagatgcccaagaagactcggcgctcggtggatggaagccgtctgatgcaggaagatgaggccataccgaccgggggagcccccggcagtcctggggggctggaggagatctttggctcactcgactccctgcgggaggagatcgagcagatgaggcggccaacagggacccaggacagccctgctcgcacctgccaggacctgaagctgtgccacccagagcttcccgatggtcagtgctagcctcagggtgcacaaacatctccccaacagcatgggtactgaacaagcagaatggatgctgggggagtcttggtgaaggtgttgggttaagggtgagggctgaggggctgggaactgcagctatttactaaccaggtcagaagtatcccaatactttagcaactgatctgggtcagtgtgtaccagttggttatcagcccagtgtctgcaggagcagataaacatacatacgtgcacacacctgtttgcacctgaacagatgaatctgtgtgagcgcctgcaaccacatgttgtcccagtatgaggctgtccatactcggacctcctccagtcagagggcctggggttactgttgggggcagaggtgtcacgtgatgaaagtgggctgcagcagtaggatgctgcagtagaatccagcagtagggctagattctagggctctgggagggaggaggaccaggagactaagagcatgatggggagggctgggagggaagagggaatgtgggggcaaagagcatcttggagcctggacctaggtggccctgacctcccctctccctcacccaacaggagagtactgggtcgaccccaaccagggctgtgctcgggatgccttccgagttttctgcaacttcacagcagggggtgagacctgtgtgacgcctagggatgacgtcacgcaggtgagagctggcccctcgctgcccctcccctgccccatagtgcaccccctcagggcttagtggtttctgggttttggtgacagtcccctggctgttgccccccccggagcctgccaccccttctccacttcttagctctttcttcttttccttttcaccggtcctctgatgctcactttgcctttcgtgtacccccagtctcctggctcccactcagcccctcacttctttcccagcccttgccttccagccattccctgctcatgactctggctcagctgtcctggtgccgtagatgctcctgaggcccgtctctgtctccctctgaggccagccctctctctccccctctgaggccagccctctctctccttccagttctcttacgtggactcagagggctccccagtgggtgtggtccagctcaccttcctgcggctgctcagcgtctcagcccaccaggacgtctcctacccctgctctggagcagcccgtgacggtcccctgagactccgtggggccaatgaggatgagctgagcccggagactagcccctatgtcaaagaattcagagatggctgccaggtgggaacaggaagagctgggttgggggctgatctcagactcaggctggaggaaggaggtgggaagaccccttgggcagggcacccagggggagcagggaggagtccgtcctgctggattgtcagggatgcctgagggagctcaaaagccggtgaggaaggtggaaaggatggaagccatcgggtgaggttcacttgggtacaaacaccagcgtcacacaggttaatgcagacgtgtacacagactggcacatggctgcccagcagaggcacacggtgggggagaagcaaacacacacgcatgggcacatagacactgccagtctgtacatcctgagtcaccctgatggggccaaggtgctcagaggagaggtgagcctgggcctgaggttagagggtggggggtgcctccatcctgctcacactttcttccttgtctccccctgaagacacagcaaggccggacggtgctggaggtgcgaacgcctgtgctggagcagctgccagtgctggatgcctccttctcagacctgggagccccaccgaggcggggaggggtgctgctggggcctgtctgcttcatgggataggaccgtctctgtctgatcctgtccattcggaaccaggcccacctggaatcccacaacatcagctctgtgccacctcccaagagggctcctcactatctagggagccctgggccagggcgtggagagccctcagtcggggcaggccaggggaggggtgaagtggttgcctggacaccccacgggaggagtggcatctggggctcttggccctcccacctggagcctgttacccgttagagagctgagacccttatttaaaactcacctcccaatcaccccaaacaaatggaagagaagagaaaggacatggcgtattttgtatttaaaagtaattgtattaattatttaaagtgtggaaagcaaaataacaaaaaagagaaacgccaacaaaaatcagcagatgttgaagacaggggtctcgggggtgggctccggcacccacatcctggagtcaggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggtttggcaggcactgcctgctacttgagggccaggatgctcccccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtctcctcccaggtgtctgtgtca

SEQ ID NO: 195 - DNA, 145619 bp, Homo sapiens
  source 1..145619: mol_type = genomic DNA
agccctccccacactctgggcgcggagcacaatgattggtcactcctattttcgctgagcttttcctcttatttcagttttcttcgagatcaaatctggtttgtagatgtgcttggggagaatgggggcctcttctccaagaagcccggagcctgtcgggccgccggcgcccggtctccccttctgctgcggaggatccctgctggcggttgtggtgctgcttgcgctgccggtggcctggggtgagaggcgggcgggcgtggggaggcgcccgggcggacgaggaacccggggccccgcagagaactcgcgtgcagcgctgagctgcgctgctctgcgcgcccgggtccgaaggcagcgcgatgggtgggctgagcgcgcgacccggcagggcggcgggtgtaggatccttctgcgcactggagaccctcgctgcttctgggtaagcgtggagttcccaggtgcaggggcttaagtcgtgacgagcgcagtggaaggcgcagatgctgagcgggtgccgcacgaaattccttgcctttgtgtattcacagcctcggctggctatagccaagacgtggcgttgatcctagtgaaagggaacttggggatccgacaaacctgagttctggtcctagaaacttaactgtgaggcaacttagcacacctgagtctgtttgctcttctgtaaaatggggacactggtatctctgcatcgtggagttgctgcctcagtggcattaagcctgtcgagtatctaacacagggctatgtgtccccgagtccatttctatcccccaaccgttacctctgtactttgctcccaatggtgtttagacaagcagtcctagggatgcaggtgttacctgacaactgccccgcatggaactgtcctcgccccccacaccaagccaccacggccatcatcaccatgcacttaattgacagcatactttaagacagatgcatgccaggcacttgcggattagaagagcaagggaagccccagaacatgcaatgtaaccgttgcaggtagaagggacagtagatatgtttacagttcgcattttagtgatgtgtttagtacaaaataacgcctattataattattatggaaattttgaggccacatctcttcctttttcttaacttcaaataggtaaacatcttcagttagaacccttctattattatttttcggctccccagaagtcttcttggttgcctagactcactggcaacatctcatttgaagtgacagtcttggttgtttttgtccagcctattcctgacaactccgggttcgcccttctctgccactagacattttacattcattatttgagtgttccttcttctctaaaagagtaaataaaataaaataaagtagaaccaagtcccgcaagagttgttattaatatttgatctccttaggcaccagaaagtaacctgtcaggtgcagagatgtgataaaacgtacaatcttatttttaggagagaagcatgcccagtaagttaagcaatctgttgtcaacgcttaggaatttgtgtcatctttgggagtactggccctcttcttactagaatgttgttttacttagcctatgttgattaagttactgttataaacaatcccagacactattaattgcaaaaaaaaaatttactgaggttatcacaataacttccaaatgtgaaacagcctaaactaaactacctagaaattttgttgctgacataatttaaattttaaaatgctgatggatgcttccagtgtgcacggtcctttggaattttaaagaagtataagagctctgcacccaaagtgtatgcatatagaagtaggtggtggagttttatgaaatctacttattaggaagccagcgttctgctttttccagcctctgctacttaccagctggtgtcttggacccagtaagttaagtcacatcactgaccttcagtgtccacatgtataaaatgagcacaactgacatcctgatctctgagagagacgttttgaaaatcagatggtgtaatgcatgtgacagtgttttgtaatctgaaaacccccatgcatgtctgaaaaaccatgactaagaagtcgtgcaagactgcaggatcaccgaaaagcgagaaatctcaactcctatgatcaggaaaggatgagtgaaaggtatatggctttactagcacttaaagagtgaatctagaaacagattgcatacgacaaaaaatagcagaggagctaggattgttttgttattatgagttactcacagtacccgtaaagtggtatagtgctatttgaaagaggacttagattagctgcaaatagatattgcaaatgtaggacaacccctgaaaaatgtgaaaaaaagaactataatttatatgttaataagtaagagagaattgcatcatataaaatgctcagttaaaacaataaagatggctggggacagtggctcatgcccataatcccagcactttgggaggctgaggtgggtggatcacctcaagtcaggagttcaagaccagcctggccaacatagtgaaaccctgtctctacaaaaacacaaaaattaccagggcatgatggtgggtgcctgtagtcccagctactcgggaggctgaggcatgagaatcgcttgaacctgggaggcggaggttgcagtgagtcgagatcgtgccattgcactccagcctgggtgacagagcgcaactccaaatcaaaaaaaaaaaaaaaagaaacaaacaaacaaaacaaaaaacaataaagggcaggaaaagaatggaagacaaaaaatagaaacagagaacaagagaaaaaaagcaacaaataaaaaccagtaacaaaactaaagcaactatatcaacaatcattttgagtgtcaatgatcgaaatgcaccatttgaaacagatcatcagagtggatcaagaaacaagacccaactatatactgtgtacaacaagaccgttttaaatatagacaatatatatgaaaagtaaatggataaagatataccatgctaatgctagtcacagaaagcaggaatagctgtgttaatttcaaacacagcagacttcagaccaagaaaaattattagggataaagaggggcatcatataatgataaaggggccaattatccaagaagacgtaacaatatcccatatgtatgcacctgatggagagacaaaatacgtgaggcaaaacccatagaactgcaaggagaaatagatggatttactatcatagttggagacttctatgatatctttctgatatcagaaaaggtgctgaagtctccttatcagaaatgggcagattcagcaggcagaaaatccgtaaggacatacttgaattcaacagcaccatcaatccacttgggtataattgacatatatagatgacttcatccacaacagcagagcacatattctcccgcttacattcatggggatagaccacattctgagccataaaatagtacacgaattaagctttaccaggcagtgtttaatatagggtggactctggcgccctcacgtggtcctcatataggatctggtttggttatccctgctaggtaaaggtgcaagatagaagggaagttccaatttgctttctgtgctttgtggtgtattttggtttacatatgctcagatgagtggatgtgtgatttatattatctattttaatctaaaataagcttcacatttggacaggtaacatcaaaagtgtcctacacagaaatgctgggtgaagatcccagtaataaaaccaactccagaaaacaagaaaatggtagagttgacaatccctctcaccctctccgcaaagacacatgtatacacattttttgtcagaggcattaagtagaagaaatgctgtcagtctaatcacaactgatcacaactcgatgaaaccaaaaaacctagaaagtatcatgaagactgtcgaaataagctttacattcactattgtgaacagagagactcaatgtgactgttttttgtcccgttagatgttagctaatgattgtgctaagtcatgatgattaacaaagcatttaaaatatttattttatctgtgttacatttcaaaaatttatattgaggcatataatttatgttcgtgtacatatataatttataaatttatatatttgaaagggcatgctctttttttaaactgatagaggtgcctaagcaaagcaagtgcaaatctattccttaaagggtaagtatgcagaatggaaagcagagtgttctttgggttgacagctcatattgcaacagacatgaaagtgatgatgtgttaattgtgcatatagcacagaatacatcaacttgctttgaatggaatatctgaaccaggagaatgtgaaagtgggctgagtcatacaagacaaaacccgaaatgagataacaatacatacccactagaatgactaaaatgaaaaagattgaccgagccaagtgttggcgataaggtggagtaactggaattataatatactgctatttggcaggtaaaattataacattaactttagaaaatagttcaacagattcttaaaaccttagacacacactcaacattttactcttaggtttttacccaagagaaatgaaatcatatgtccacacaaagacttgtacatgaattttcatagcagttttgtttgtaatagccaacacgtggaaacaatccaaatgtccctcaacaagtaaatggataaactaaattaagatatatttatgcaattgaatattacccagcaactaaaggaaacaatttgtatacatgcagcaacctagatggatctctaattatgctgtgtgaaggctaaaccataaaaaaaaacctgagtgatttcctttatacaataggatataaatgaagtgatttaggttatatgaaattttagaaagtcaaatcaatctgtagtaagagaaaaccacctgagttatttcctttatatgataggatataaacgaagtgattcgggttatatgaaattttagaaagtcagatcaatctgtagtaagagaaaacacattgaaggttgcctagagaaggaagtggatgtttggatggattacagaagggcatgagggaactctgtgtgggtgggatgtatgatggaaacgtttattgtcttcattttggtgatggtttcacaacgcatacatatgttataagtaatcgaattgtacacttcaaatactcatcaatcattgtatgtaatatatcttgataaagctataaaaacttttaaaattatggtaggtcttcagtttgtggattttatattaatatatttgtcataggaactagtcacaattgagggattggtaataaaggagagaaaggaaactacatcaagctttctttgttgaaggctcatatattccttttttgagctattatacaactttgctttttataattacctatactattcatatactactatgcaggtaagaatattatgtaattaaggggaaggaacttctttccaagaatggttcattcaatttgctttgttactttaggtctcattccttcctctcgttgcaagctttgctgtgacatttaccctctctcaatacagcttttggcgctaggcacttcacatggaatctcttcctttgtccggcatcaatggataagacaaatatcaaaattgtatttcatcccacatatcaactagaggaaaggtgaatgcataacactgaaaataacagcaactgttttactcagtgttttttttttttacagtatcctcaaagtgctgttatctatcaaaatcagctgtgaaaatttttaaaaatagactcctgggccctaacctagacccactaaatcagagatttgggggacatagcttggattcttgatttttttgagttttataagtaattcttcattttttgttcattgcaacaaatatgcattgagttcttataattgagtgttaagcaccaggactaagtattaatttagaggtacaaaaaaacacatcatctcttgcctttaaattatgcatatctaatatctattgagagaaatagatacttctaaaagcacacaaagataaaaagcacaaattgtaataacaaacaattattgatatgaaaggaaaagcaaagtgtcggactagaaattattatagggtggggcagagggaagtagtttagattccaaatccctaagagggtcagggaaggcttcagatgagattgggtgtgttcagggtggtatggccataggcaggctggggaaggcttctataagaaagtgacattttagcagatgcctgaaggaagaattgaagtcagagtgaagataaaattgcgtcacatagaaggaatgtcatagacgggaaaaatgtgtgtctttgggaaactgaaaaaggggaaagggccacaccttggtgaggggaccaagtggcacaagatgaggcagggaacatagacaagggcttccttgcttaacaactgctggcttaataaagcaaatgtgtgatgatggatacaggctgtctgggaaaaataagtaagaaatatgagctttcttggagcatcatcctttgcttcagtagaaagcacagagttaggcttccaattctgactaaagccattgacaacagggaaaaggcaaccttaggaattctcctctctgtccggggtcccgtgggcactatgatggagctcatgagatgcagatgagaagtcccaggctgaatccggggcacattcactcaggagagctgaggtcaccagtcactgaggtcatccagtgcattcccgacagcataggctcattccaagctagttctgcaaaggagcagaaaatgaactcttggaagcaaagcaagcactcccactttagcggaataatcgaatttaactcttagaagtccccttacccttttctaagggtaataatcgtaagtataatttatgaagtgccttctgtgtatgtggcagcatatactacttttgattctccctgcaaacctggtaggaaaatattattccctttatgaagatgaaactgaggctcagcaagattaagcggtttgcctaagacctcatagccactaagtagaagacattgggttcaagattcaatctatgaacccaacatttttaatactatataccattctctttttgtattaatttcctattgctgctgtaacaaatttccacaaacttagtggcttaagacaacagaaatgtattctcttccagttctggaggctgacgtctaaaatagatccatagggctgtgttccttgtggaggctccaggggagcaggggttttcttgctctttccagcttccaggggctgcttccgtcctttggctcttggcctccttcctctaccttccaaaccagcaccatagtgtctctgaatatccttcttctgtctcctttcaccctcttgcctcccttttataaggacccttgtgatcacatttaaggtccacctagataacccaggataatctgcccatctcaagattcttaatcacatctgcaaagccctttaaccattacaggtaacaatcacaggcttcagggatcagaacatggatatctctgagaggtccttacttagcctaccacacctttccatatagattctcaaaattttagctgagcctaataagggagttcattaccattagggtccggtttagtagcaagtgcttcctttaagtgaaaaggtgaaagttgtccacttaataaggaaagaaaaacattgtatgttgaagttgctaagacctaaggtaagaaggaatcttctatcgatgaaattgtgaagaaggaaaaataaatttgtgctagttttgctgtcacacttcaaactgcaaaagttacaaccacagtgcatgctaagtgcttagctaagaggggaaaggcattaaatttgtgggcggaagaggtgaacagaaatgtgttctaattgacagctgtcaggtttggtactatctgaggttttgggtatcggctaatgtcttggaacatgtcccccaaagataagtgggtgactactgtatattcaaaataagcatttatatactggggagtaaatctcccatgttatttgtgttttatttgtcccacaaataaagtaaacaaagtagaattttaggcaagattcatttctagaggcagagatattttattataataaagaaggttgctctaccataaaatatagcaatttaaatttttataatcctaataacctcaaaatatataaaataaaagatggacaacattataaaaagaaatagacaaatgtacaataaataaaatattttaacacaactcattatctagtaagacaagtactccccccaaaatcagtaaagtatctagaagatttgaataaatattaacagattggattcactgaccttgttacaagaaagaattatacatgatgataggagagaggaagccacagcacaggcacttactgattaactaaattttgaagctgtgaaatgcaccttatcctttagtgaaagatgatataaatagcttagttgccttcaaactggcagagactttttgaatggatggatgctgattttttaaaaaggagcccatttctgaggcatcttttaaagcaggggtcctcaacccctgggccatagactgatactgtccagtggcctgttaggaaatgggcagaacagtaggaggtgagcagccaagcattactgcctgagctccacctcctgtcagattagtggcagcattagattctcataggagcagaaaccctattgtgaactgtgcatatgagggatctaggttgcatgctccctatgagaatctaatgactgatgatctgagtggaacagttccatctcaaaaccatttccctgcaccctccattcacggaaaaattgtcttccacaaaaccagtcccaggtgctaaaaagggactactgttgtaaaggaataagtccctttgctattattatttttattaagatggaatcttgctctgtcacccaggctggagtgcagtggcacagtcttggctcactgcaacatctgcctcctgggttcaagcaattctcctgcctcagcctcccaagtagctgtgcacaggcatgtgtacaggcaagtgcaatcatgctctgctaactttttgtattttgggagaggcagtgtttcaccatgttggccagcctggtctcaaactcctgacctcaagtgatccacccaccttggcctctgaaagtgctgaaattacaggcatgagccaccactcctgcaccccttggctattattgaagtgttctttttcttttttgatcacatctatgaagtatattggagagaaagagaaggtagaatgggaatttcaacagggtcacggtggctcactcctgtaatcccaacactttgggaggccaaagtgggtagatgacctgaggtcaggagtcgagaccagcctggccaacatggtaaaaccccatctctactaaaaatacgaaaattagccaggtgtggtggtgggcacctgtaatcccagctactcaggaagctgaggtaaggacaattgcttgaacccaagaggcggaggttgcagtgagccaagatagcgccactgcactccagcctgggtgatggagccagtctccgtctcaaaaaagaaaaaaaaaagtatggtaatttctccattaactttgatgcttctatggtcttgatctccaggtcaatgcaatgccccagaatggcttccatttgccaggcctaccaacctaactgatgaatttgagtttcccattgggacatatctgaactatgaatgccgccctggttattccggaagaccgttttctatcatctgcctaaaaaactcagtctggactggtgctaaggacaggtgcagacgtaagtaactctggagtgggaacccccctgttagtcaaacatctgtaagatctgattcaatttgttcaaattttgtaactgagttgcatatgacaattagtttgccaaggtgcaatacatatgagaattattcttgtagatcataccttgttactgctttgagttcctggcgccttcattaaaagtttatttcatgagaaacagtcattgcaggacatgattgagggaaaatccccattcactgggggtctcccattttcatgactaaaattaagtaatgaatgacttgggacaagaaagagaagtggattaaataactaaaagatgtgacaatcttgggctttgagatctttggattataccagttgaattgaattacagataataacaaagtttacatttttctgggaggcataatatggggatgaaacagatctgaaaggaaagttttttttgaaagggagctgatcctgaggcagtctggtgagtttcctcaaggtagcaaaatctgtggaaccatcagaactgcgtgtgttcctcagtaagctacaggcaggttgagaccttatgtactaaaaaaagtttttagtttactctacttggctccaaaattctgtttctttcctgtaggtaaatcatgtcgtaatcctccagatcctgtgaatggcatggtgcatgtgatcaaaggcatccagttcggatcccaaattaaatattcttgtactaaagggtgagttggcatctcttgaaccaacatctcttggttcaagagttctaacacagccttactaccttctagtcacatgtcagaaaggacaactaaactattaccatctgctctttaacggcttcaacacagatgtttagctcctgactgaaatgagcaaaggtatgacaagatcgggggaaaatcatctgtatccttgctggaaaccaaggcagagcatatatgaaaagtgtggcattcattgggtgggaaggaagaaaatgggggaagagtatagtcaaagcacacaaacagccttaacgcagaggggacattgctggaagaaagggaaggccattgagtaactgtgtgagagaaatcttaacggtcatagcacaagtagtttgctagggctgctgtaacagagtactccaaaacgggtggcttaacacaaatgaagtttttaaaattctgttccggaggctgaaagtgcaaaatcaaggtgttggcagagccatgctcccctctaaaacctgtaaggatggatccttctttgcttcttccagcttctggagccccaggccttccttggcgtgtggcagcagaactcccgtttctgtctctgtcctcacatggccgtcttccctctgggtctgtgtcctcacatgctgttttcctgtctgtgtatggctgtgtcgaaagtgctctcttttaataaggacaccaatcataatggattagcgcccacactaacgacctcatcttaactggattgcctctccaaagaccatatttccaaataagatcacattaataagcactggggattaagacatcaatatatttcggggtaagggggacacaattctcattcattgctggtaggaatgcaaaatggtaccatgacttggaaagataatttggcagttttttataaaactaaacatactcttaccatgttatccagcagttatccttcttggcatttatccaaaggaattgaaaactcatgttcacaccaaaaaaaaaagaaatctgcacacagatgtttataacagctttattcataattgccaaaacttggaagcaatcaagatgtcctttagcaagggaatggataaactgtggtacatccatacaatagaatattattcaataccaaaaagaaatgagctatcaagccatgaagagacatagaggaaccttaaatagtgaaccttttttcaccatcactaagtgaaagaagccaatctgaaaaggctacataacatatgattccaactatatgccattctggaaaaggcaaaactatggagacagtgaaaatatcagtggttgtcaggggttagggaagaaggggatgaatcggaagagcacagaggattttgagggtagtgaaactactctgtatgatgccataacagtaggtacatgtcataataaatttatccgaagtcatatagtgtacaataccaagagtggaccctaacataaactatggacttggggtggccatgatgtgtcagtgtaggttcctcaattgcgaaaaacgtaccaccctggtgaaagatgtttataataggggaggttatccatgtataggggcagggagtacataggaaatctctgtatcttctgttcattattgctgtgaaccaaaaactgtgctaaaacacaaagtctattttttaaaactgcatagacataaatacatgggcatatgtgcataaacagacacgcacacaaataagtgcaggtaaaacaggaaatttgaacaaaatctgtggattataactgtttcaatatcttaatgttgatgttgcactattgttttgcaaaatgttattattaggggaaaattgagtaaatagtacctgggatctctctgtactattccctgcatgtgaatctgattatctcaaagtaaaaagttttttttttttttaaagttcctactaaatttccaaggggatgggcttcccctcagatcactaccccttttcagggagcaataaagtaatcttccttggaatgtagcaatctgtaaccaatcaaaatgctgtaactatgcatggtcccatatggaaaatataatcctgctaaaatttctctgtctctgcctatgtaagtgataccttatgtcctccactttggagtgctgaccccattcatttggagttggtctcttccaggtggctacccttaacctttgtgctcaaataaactctatccttaaatatattttctgaatctcattatttaaggttgaaaatgtgctaacctaaataattcacaggatttgttttttattctcattttttcctaacctatccacctggttcaaggcacatagattaagaaggaaaatggaaatgggactaatatcccaggcttcactgtccctcttcggggccctggggaggagactcccaaaagtctagacatgttcacccacatcctgtatgtggtttctggaaacgaaatgatcatggcttttcctgaaccatggcttaactttgtgaatccacaactctctcttccccaggagatccaaaaaggtagggtaggatgtaaaggcttcaatctgttcaagtggatatgagactccctggctccccttacaataagtagcatggattttgtctctctgccttacttcctccaaacattctgaatgagaagtgttcaaaccactatttgttcaattgcttaatctactttgggacacaagtttaataaattaaaatattcttctatctgttccccttgatcagtgaacataaagttatcttttgactcatatttaaaatgttcagtattacaacactgaacaatagtatggaggaaaaaaaatgccaacttaagtttgaacttgcttcaccattcctatcccaacccccatgattagaaaatcaaaaagaacactttgagaaataacctcagtggggtcaaaagccagaggagcctccaggatcccttgttcctaagacaaacaggcaggaggaggtgcacatataggattgcagctgttcttcacttcatttgttcacatacttcatacttgtgtttatgtctgttggcagtgcaatagaaaatgatttcatttttggtggtatactagaaggcattaaaaaacaaaataaggccgggtgtgctggctgtaatcccagcactttgggaggctgaggtgggtggattacctgaagtcaggaattcaagaccagcctggtcaatgtggtgaagcctgtttctactaaaaatgcaaaaatcagccgagtgtggtggcaggcacctgtagtcccagcagctaaggaggctgaggcaggagaatctcttgaatccgggaggtggaggttgcagtgagccaagatcgcaccattgcactccagccttggcgacaagagtgaaaatctgtctcaaaaaaaaagaacaacaacaacagcaacaacaaaaatcccaaatgatattgaagtcattaataattacatcataatcactagtataatgtaatagtgcatcaagtatcttcaaaagcacccactgttctctcactatttatttgatcttcatttgtcactgttttgttgtttgaataaagctttatgttgccaggttttcttacatactcataaagcaaagttctcagctataccaataaccatgactgttatttgacattgcttcattccttcatgtatagtactatcaagtttgaccctaccctcactatgactagtttcacccaaccatctatcacaacagagagtctaacgtgaagtaaaataaatgtcataaattattccaaatttatggcacactgtgaacagtttgagacatactaattgagaattgctgactttagtattttaagtataaaatgagtgttcaattctttttgatcagcctggatttcctttggttctagttatgtatccccttccttccttccttccttctttccttccttccttccttcctccctcccttccttcctttccttctttccttctttgctttctttctttcctttttactttcttttttttttttgatacaatgtcttgctttgttgcccaggctggagtgcagtggcatgatcagcactcactgcagcctcaacctccctgactcaagcgatcttcatgcctcagcctcctgagtagctaggactacaggaatgtgccaccacgcctggcttttttataaattttttgtacagacagcttctcactatattgcccaggctggtctcgaactcctgagctcaagcaatcctcttgcctcagccccccaaagtgctggaattacaggggtgagccactgtgaagggcctaatttggccttctttaatgaatcttattgataaaagcccatccatgcatccatgcatccatacttttaaggcaaagaaatacatacaacaggactgtatacacacatatacatgtatatatatgacagcttccctgcactcaagaactttgtgctatcttttaaaaaatgaaatttataggaaaaactacaattcatcttagatttgcataaaaaagtgtcataaggtaataaagaagagaaagctcatccaattgagaatgtatgaaaaagaaagtcaaaaagtcccaagaagaatgtgaaacttgggaaagtgatagatagtcctttgatgagtgtaaaaagtccctctgaatcctataagagtgtaatctctggaagtagtaatttaattgggtagttgacctgtgtctttagaatgtaacattccttattttttgcctctagataccgactcattggttcctcgtctgccacatgcatcatctcaggtgatactgtcatttgggataatgaaacacctatttgtgacagtgagttgaaatatcccttcctatttcttttaccgacacattctaatttttctctggaataataaaaatcttaactgaattccttctgtgcaatctgtccttcacacggctgaagactgcggtaatgttctcgaatattcctatggggttcctggcaactctttctttaagttcttccttatcctgggatgtgtcttttctaattccagaagtttaaatacataaaagccttcaaacttgattttacttcaataaacgtgaaattatgttgtttctaccacctccagtataataatcatcttgcttggcaaatcagtaaagatttttaaaattgatactcttcaaggttagcgaagctgtggaagaacctggactctcatgtaccacgagatcaacacatcctcttgaaaggccccatgcactataaacctcagaagtgaacatatattttaacctacttcttaaaatttatacttaggaaataatcacacactttttaaagtagtttggtataaacttttcattgcagcattatttatattagttaaaatgttagagtaacctaaatattttaaactatggtttggaaataatctactagtaggaaaaagatgtgttcaaatgaccattataaagaattccctaagaaacataaaacagctatgcagaatgaaaataagtatatccatacactggcatggtattcagccataaaaaatgacagcataaagaagcacttaatgactagaaagagatgtattttatgtggaaaaagaatcagatgaatggcatatatggcaagatctcactttattaaaaaataatacacctatgtagtgagggccaggctgaggctgagagaaatacagtgtataacatctttgtcttactcttctctttggataactggactcctttacttttcttcttggtatttaaaaatgttacttttactagaaagtttaagagcttcagaatctaagtttacaaatgacattggtcacacatttattgctgtttatccactttaagaaacagttttgctattttgtaaaacaaattgggaaaccttccatcttatttgaaatctgtaataaacatggaattggaataggaattttcctggaaatatgaaaaagattagtaaaatagagaaaacaaaaaatataataatacacctatacctgtatttattttttatctctgtttctacttctgtaacctctctgtatccaaatcctggtaaatggcctcaagtcttcttggaaaaggctaggggaagatttacaatacatgcttttgattgtgtagcatggtgcttcctcaagagaatccagtctcccatccgttggtgctgctctgggtctataaactattcaagtctaggaattgttgatgaacaatgaacttcttttgcaataattcaagtcagacttctattcacttgacctaaaactcttacacttatacaaatcaagtaacactttagtcggctatccgtctactttggttttagagactccatgatcaattagcccaataacaatgtcctcttcaatcaaatcattctgattgctgtttcagctcaaatatgcattacaagaacccccattgtctctggcaattaagtgctgccactgggactctgccaccctgaggtcctttggtccccaagtgaattcagagaatccagttcaatggcaacagttcccattgtcattcctggcctacagagaatgaaccgttgcagaggatgctgaaactccccatgtgaatgtatttctcaagcctctggtaaaaggtctgtcttctgaaccctctactcctgcactgtgcctcaccagctctatccaaggatacaactttcagagtggaatggctgttgcttaacttctgcctctcaaatatcaggctaatttctcatgctataaccctagtccagaaccgtacagagaaagtaagtctggaaaacttaattccaaattggcctggttgacatggtgccaaaccaccaaataattataattttatttaactctttgtcttcttttctttctttccttccctccctccctcctttcctccctccctccctccctccctccctcccttccttccttccttccttctttccttccttccttccttccttccctctttccttattttctttcttctttaccacgctggctaggaccaccagtataacattgaacattggtagcaatagatgtcatccttgtcttgttccacatctcaaagttaaagtttaaaacatttcaccattaagctggtgtttactgtaggcttttggtagataaccatttttgaaataaggaaattatcttatatattcttcattgctaaaaaatttatgtctttgaatcatgttgaagtttatcaaacactttagttacatatattgatgtaatcatatctgtttctctttttctgttaatgcaacaaattgttttgagtacatttttgaaaggcaaatgattttaaatttcaattttacattcttaaaataaatcaactcagtcataatatttaatcatttttatatatggcaaatatgcttttatgatatattttagatgtttctattaaaatataattcatgtatcataaaagttacctttttaaattatacaatttagtggtgtttagtatattcacaaagttgtgtgttatggtctgaacgtttgagtccaccccaaatccatatgttgaaatccttacccctaaagtgatgacattaggaagtgaggcctttgaaagatgattagggcatgagagcagagccatcacgaatgggattagcgtcctaataaaagaggcccggaagagctcctttggccctcccaccatgggaggagatgctgaatctgccagtgttggtcttgaactccccagcctccaaaactacaagaaataaatttctgttgtgtacaagctaaccagtttatagtattttgttatagcagcccaaatagactaagacattgggcaaccagcaccgccaattaattctagaacactttcatcatcccattcctaacatattttagagataagactataattttctttcttgtaatgtccttaataagattttgatatcaaagctatgacagtcttataaagccagctggtagtgtttcatatatttgtttccttgtaagggtttatataagattggcattatttcttctttaaaaataattcaccagaaaaggtatgtggcctggagtttacgttcttgggaagtttttttttttccaaccattttcctgtaccatgtagacttttggctgaagtataacatatatatatatatacacacacacacacacacacacacacacacacatatatacatatatacttatatgtatatatgtatatatacgtatatacgtatgcatacgtgtatgtatatgtgtatatatgtacgtatatatacatacgtacgtatatatacgtgtatacgtatatatacatatacatatataggtatatacatatatacgtatatatacatatacatatataggtatatacatatatatacgtatatatacatatacatatataggtatatacgtatacgtatacatatataggtatatgtatacatatatacacactatatatatatacacatatatatagtgtgtatatatgcacacatcttaatcatgcagttcaatggagttttacaaagtaaatgtatccatgtaaacgtcactcagattaagatatagaacattatcagcaccccagaagccttcccgatgccctttcccagttatcttcccaaagaaaccactattctgatttataacactaatagttttgttgcttcctaaattttatattaaaggaatcaaaaaatagatactcttttgtgtccagcttcatctcaatgttatatttggaagagtcatttttgtttttgcaggaaggattgttgggtcttctttattattatgttgtatttcattgatgatcttgagtaccttttcacgtttgtgaagtgctattccaaacttttgcctattatttattagtttgtctattgttttgtagaagttctttaaatattctcatgttttctaataaatgtaacacaaatattgtctttcaggctgtggcttttcttttttccttcttaatgatgtcttttgtttatgaaagttctacattttaataatattcaatttaggagtcttcttttttccagttactgctttttctattctacttaagcaattgggccaagtgaggtggctcatgtctataatcccagcattttggaaggccaaggcaggaggattgcttgaagccaggagttcaagaccagcctgggcagcagagtgagaccctgtctctacaaaaaaaataaatatataaaattagctgggctcagtggcacatgcctgtagtcccagctacttgggaggctgaggtgggaggatcccttgagcacagaggttcaaggcttcagtgagttatgatggtgccactgcactccagcctaggtgacaaagccctgtttcttatggatgggcaatagatctaatatcatctattaaaaagactattccttgcatagtgcaatgcgacaccaccatgaccataagtcaggtgaccttatgagtggatctcattccagagaggttctgtttcactggtttatttgccatactataagcactacattaagattttaattactatagcattacattaagatttgatatctggtagcatatatctcctaactatgtgcatcttcaagatttacttggtgattcttggccctttgcattaccatataaaatttagaatcagcttgtcaatttccacataaagaatcctacttgaatttgtattaagtttctgttgactcagtagatcaatttgtggacaagtaacaaatttacagttttgaagtttaaatttatgaatatgatatatcctcccattttgaagtcttctttaatttcttttaataatatttgttaatgtacattatagaagtcatgtacctatttcattatctttattctgacatattatttttaaaatttcattctttaattatttacttcttagatatgcacctgtttcatctcagctccagcaaatttgttaaatttacttataaattgaatagtttatctgtagattcttttgaatttgctgtgtaattatgtcatctatgaatctgacaaagtttttacatcttttcctttcttatgtcttttgtttatttctcttgctttattgcattggctagaacctccagtacaatattgaatagaagacatgatacaaggcttttaatagtcctcataaatcatgatgtatgctgtagatttttgcatgatatcctttattagattaaggaaactcccctttctttctaattactaaaagatttatgaatgttctttctaattgatcactgcatgtattgagattatcatgtttctttttcactctgttaatgtaatatattacattgattgatgtttaaaagacaaacgctgaattcctagaataaacctatgttgcttgtgatgtgttatagatgattatcctatgtatgggggatatgcgtgtgtgtgtgtgcaggattgctcatatttttattgtaacattgtaacattgatttaatatttaaaatcagtcaaggtaaacctcactttgatcattgtatcatcctttggaaatattgctggattcagtttcataatattttgttcagaaaatttgcatttatattctcaagagatcttgggttataatttgcttttattttaatgtccttatcaggtttgggcatcaagattatgttggcctgataaaatgtgttaaaaattatttattttttctagtgtctggaacaatttgtgtaacattatttttccttatatgtttggaagaattcagcagtgaagcaatctggacctgagggtttgttgttgttgttgtcaggatttaatatctttaatagctgtaaaactattattttatatcttattgaattagtttgggtaagttatatttttcaaggaatttactcattttatttagatttcctaggttatcagcataatgctgtttattatagtctcatattagcctttggatgcctgtaagttctgtagtgatacccttacactcattaatttctgatattggtaatttcttttgcttctttttccttgattagttttaccggggctttatcaattttactaagcttttcagaaaaacaacttttaactttcttgttttttctttagtttatgactattttctcttttattgatttctgctttaagctttgtgtattcctccagtcctaaattcttgatactaattaatttgtttccaacctttatttttctaatatgtacatttaacctatcaatttttctctaaaactgttttatttatttccaacaatctttatatttttattatcattgtacataaaagctttctaatttcacttttaatatctcctctgacccataggctgtttagaagggcattgcttaatttctaaatatttagagatcttctagttatcattctttcattaatttaatcatttgagacatggtttattgcccagaatatggacgattttggtaaaatgttacatatgcacttgaatgtacagttattttgcttcattttctagaaatgtcatttaggaaaatgtggtttagaacagtctttttttccccctccacttgttctctcagttatggagaagcatgtgtaaaatatctgtattagtttcccagggctgctgtaacaaattaccacaaacttagtggcttcaaagaagagaaatttactctcttaacagtttggaggccagaaatccagttaagatgtcaataggattggttccatctgcaagctgttctgtgcctctctccaggcttccttccagtggctgctggcaatcgttgatgttccttggcttgtagatgcatcatttccttctctgtctccatcttctcatcgccttctcctctgtgtgtgtcctttgctcttctgtctcctataaagacactggacatggatttagaggccaccctggcaatccagaatggtcacagctcgagatcattaacgtgattgtatctacaaagactctccaaactgggtcatattcacaggtttcagagatcaggacacagatattttttaaggaggacagtggttattcaacccattacaatccccaactacaactatgaatttgtctgtctttcctctttgttctagcaatttttactttatgtattttaaacatgttattaaatgcatgaaatttttggtttattctttctgctgaattgactattttatcataatgaaatgtctctctttacctctcataatacttcttaccttaaaatctactttgcatattaatacagctatataagctttctttattgtttttatattatatgtgttttaaatcttttactttcagcccttctttgtcttatatttaaagcttgtctcttataaacatcatatagtaaggttttgttgttttattcagtcttagttgttcattggtgtgtttggaacattaaaatttaataataaaaattaaaaataaataaatttaatatagttactgatataaagtctaagtcttggtatttgtttcatgtgtttgttcctttattcctcatttctcacattttttaattcatcaagtatttttattattctatttccccagtagcttttaagttatattccattttttattcttaaatgactactctagagatagacatccttgatttactatagtctgctaaaattgtacttttaccactctccaaacaacgcaagtaccgaaactattaatagttaattccatttatgtcctccccctctttttgtattgttgccatacgttttgcaaaaagaaaagcttcagctgaattaaatttaaaagagtttaattgagcaatgaacgattcgcaaatcaggcagcctcccgagccaaagtaagcgcagagactccagcccagctgcaatgggggaagaggatttaccgacagaaaaaggaaactgacgtacagaaaacagaagtgaggtacagaaacagccgattggttatagctcagcgtttgccttatttgaaaacagttcaaacagttggccacatttgattggccaaaactcggtgattggcgtaagagtagtctgcggtctgtttacatcttcacttgttatagtttgcagtttacagagaaacctttaggctgagcttaaactacgtaaggctttaggctaaacttgatttaacgatttacatatattctatatttcaaagacactgttgtctttataaaaacagtatttatttatatttacaccttagtgaattcttagaatttttatgttgcctcagcatccatttagaatatgtttagctttctcatgccagaagcagggcttagtcacccttaatgccctttctagttctgtacctcctcccaattttgcaacgtggtcgagccagatatctgccttatacaactgcctcctggtgaccacctctctatgggacagctagataaaacctacttgactagcgtccctgacctctgtgccctgcatggacttcgcagatatgctgccgtgaccacctctcagtcgcagcacgactgcctggaacatgtgcctgctttctttaaactcaccaattagaactccccatgggagataccttggcttgtagatgcaagatgctgggtcatactctggtccccaataaaggcattggctgatgggtccccttctctctgtctgtctcctcgcgctgaccaacctctgtgtgatcttcaggcgtgccatacccccagcccgtaataaaatctttactgccatcttgtgtttcttgtaatgactgaagaggttttctctatcataaagatcctaaatgaaaacatacccgcatatgagctctttctggtgtgtttccttcttattgcaattctgtcaattctatatgaaactattttccttcagcctgaaaaagtctctttggcatttttgtattgtagagcttctgacaacaaattctttaaacatttttctaagtgtggttcctctgaaggttattgtccatgtttcctggctgcttttaaaatggattacactttaaaacagattttttacaatattattgtgttgtgtctaggtaagaatttctttgtattgcttgggtttgcacatttttttttttttggttgtttttttttttttttttttttttttgacagaatttcactcttatcacctgggctggagtgcagtggtgggatatctcggctcactgcaacctccgcctccggggttcaagttatcctcccacttcagccttccaagtagctgcaattacaggcctgtgcctccatgcctggctaatttttacccttttagtagagatgggttttcaccatgttgaccaggctggtctcaaactcctgacaagaggtgatctgcccacctcggcctcccaaactgctgggattacaggcatgagccaccgtgccaggcctgtatagccttttgaacctgtaatttaatgatgtcttgcatcagtcttggaaaattctcagttattaattcttcaaatgttgtttatgctcagttctctctctcttctcatcgagggacttcagttaaacatgctaggctttattcttctatgtatttagtctgtattttttaatctttttatatattggtgcttggttttgagtattttcttctgtcctagcttccggttcattgattttctttcagagtctaacctgctattaatctcacacaaattcttaatttcagcaatcatattttacttttacaattctagactttttattttccaaatctgccctcttccttttttttttttttttttttttttttgagacagggtctcactttgttgcccaggttggagcacagtagcataatcatagctcactgcagcctcaaccttcacaggctcaagcaattctcccacctcagccacctgagtagctgggaatgcaggtgtgcaccaccacacctacacatctggataatatatatatatatatatatgtatatatacttttttttttttgtcgagacagggtttcgccatgttgcccaggctggtctcaaactcctgagctcaaacgatccactctcctcagcctcccatagcgttagaattacaggcgtgagccaccacatcccaccctgttctttttaatagtttctagttcttacaagtttcaattatacccttgaacaggtctgtagttctaatgggtcagtttctgtcatcagtaattgtgtgtgttattttatctctccaaatatctggttatctttgattgtgtatcaggaattctatttgaaaactgtgtctgtagaaataatttcaaggccttagataacccatcttcttccagatggaatttttgtcattgtttctgcaggcatctggggacattagcaatctaggaccactctaattcagtctcaggaactgtgattttccagggccacccacagtaccagtacttgaagtactagttccagtctctgagacagcaaatttattttcagttaaccctgattaccagggcctagttcttgtggcctcagaacacatcagaaggtattaccaggccttccatttggggcaggccctggacttccattgttgtcccttaacttcatgagaaaatcaaaagtctgttcagcctctcagttgccccgtcctgattcagctgcccattcccaaacaataagcagcccagttgccaagcccaaatacccagctctcaactggattctcatcttctcctagatcatggcccaggaatgcttcactagtttgttagctttctgatgctttaacagataaatatttttaattctccagtatttctagcctttcttgagggtggatggttggagcaatattttatttgaactgttgagattactattagtagaagcagagcctgaaaaatttttatttttaattttaattcattcatttctaaatttatccaattaaattcactcagttttaatttcaagtgttttgggatttgggttgaagaaattttgttctagtttatagcaacacagtatactatgtactactgctatactttaaaatgtatttaggggtttttgtggactaatatatgatcacttttacacagatatcatcttatgatatcaaacttagatttgatgaaatgagttggtaagcttcatatcttttatatgttgtgaaaccttgaaattacatttggaagtatatttttgaatgaattttggtaatttgtatttccatttatatcatttagattttcaaaatatttaaccccctgtagtctacagttttataaatattctcatatacataaaaatatgtttaaattctttttcctactgtgtatatttgtgttttctctcatcccttatactttatcttttagcaaatgtttttgtattttatttttctaaaaaagctaaccttggttaataacaaaaatggaaattaagaaagcaaacggaaaagagtaggagaaaactgtataaatactataacactatgatcaaagagctatttaaaatgaaaagaatgtggattgagttaatacatgcatgcaaatactataggaaatcatatcagtaagaaaggcaggacacatcatattatgcccattgaagctacaactttataaaaatgtacctatgtgttagcaaagattaaaagcaaataatgaatgtaaaaatagctatagtttagtgactcatgagatttctgtcattcattatttaaactgactgttatttatcctgctcttcctttttccaggaattccttgtgggctaccccccaccatcaccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccaggggtgagtctgactgaggcctagaagggccctgccagtgacatgcgttgctgttggatcaggagattagtatttgttcagggggagggatgtgtgctgagcagggtcgaggagcaaattttctaggtagtgaacatgaaattcagaaggtgtgtgtacatgcacatgtgctgaaattgcgaagcaaagctcaacctgggcaagggatatgatgtttctttggggttcttataaacagatctatcaattacctttgagtataataatggttgatacaaaatgagtgattcctctggccgggcactataatacaggctacatgtgaattttaatccttaaaacaaagttattaggtagttaccagttgttctatgtttgtctgtattgttttgcttgagatactgtcttgatctgtcactcacgttgaactgctgtggtgccatcatgacttacttcaacctccgcctctctggctcaagcaagtctcctgcctgagcctcccaagtagctgggaatataggtgcatgccaccatgcctggataagttttttatatattttttgtagggatagagtctcaccatgttgcccaggctggtctcgaactcctcagctcaagcaattcacccaccttggcctcccaaagtgctgggattataggcatgagccaccgtgcccggcctctatgttttatagagaatatgtgccttagacacatcagataacattctgagacagtaacttgcagacaaaactggattgcaagtccacctcactccagagccttggctttgctcatcagcattcagtcatgaaatcaaaacttactctagatactttcaaggagggagggatttcatgcaggttgtattagtctgttctcacattcctataaaaaactacttgagcctgggtaatttataaagaaaagatgcttacttgactcagagttctgtaggctgtacaggaggcatggctagggacccctcaggaaagttacaatcatggtggaaggtaaagaggaagcacgcatatcttcatatgcttggcaggagagagagagagagcaaggcagaggtgctacacactttggaacaagcagatctcgagagaactctatcacaagacagcactagggtgatggtgctcaaccataagaaaccacctccatgatccagtcacttcccaccaggctccttctccaacactgggaattaccatttgacatgagatttgggaggggacatagagccaaatcatatcgcagctaataggtcacaaaaatgttagaagggcaggaaaagcaataggacaaaggcaaagttacgagagatcagggagctgctgtggctcccagtctacagcacaggagcctggagtgatggtgaaatggccagcccctcccactgagcaggcagctccctgtaagctgctagtgctgcaggagccaccactgctgccagaatgcagctgatattgctggagccaaagtcattggcatcgttacaattgaagctgtagctactcactgaagccatctatactgccactgcctgagccacttctagaagtagaacagattctgccatcatcctgctttttaatttggtatatatgcctccaattggcagaacctaaccagagcccagctatcaaggaagatgaacaattgtagttttaaggcttcctttgctagctgtcaaaagacagtgcagaagtgtgaggctgggggccaacagaaatttaaccagcacagcacctcaatattacatcaccaggcattgattagtccagggaaacactgggtgatgagccctgaaaatggacattacagcatcagagtatttacaaactccctaaagaagtcatttttctattccaatcccccatttgatgcttgagaaagctgaagtccagaaaagggaactgatctgctcaaagacaaaccgaaattattttttccattttataacagttttatgtaatttagttgagatccaaatgtgttctgatttcctgagttccaatcaactatattaagagagagccagcgctgcccttacaatatgttgcgtaaatatacactctcatcatggtgacagtaggtctttcagattttgttcgacagtttcccaccttctcactgaagtgaaatgaatgactaggcagcaccttgctacatagcatgaggagaggagacccatagttctttaccatcctatgtcaggtggccgctgagagaagacttgaaaggagatgagcatagatgtatggacgctctttgttgcaccagtgtgataggtgatggagggacctattagatgagacatgggcaggggcactcctttattgcttaaaatgcaagactaaattggtgatgcctttctagaaaggaagtatgaagatacgaaaatccatcattcctcccaattttgtactgggtgaacagtaattggaagcattctagaaggaactgtccattgtgaaatcttagttgcatactttagatgaaaaacaatgaattggagatacctctgttttagtcacagttgtgccacgtgtcagttctatgactgatggcaagacatcttccttgccctgtgtatttagtttatcaatgtaataaggctgttattctaactttattattatatatagatttgtaattattattcccttggccagtttaacagtgagaaaaaagttgttttcacacaattagctgtactttgtttctctctccccagtatgtcagccacctccagatgtcctgcatgctgagcgtacccaaagggacaaggacaacttttcacctgggcaggaagtgttctacagctgtgagcccggctacgacctcagaggggctgcgtctatgcgctgcacaccccagggagactggagccctgcagcccccacatgtgaaggtgactagactcttatctggcttgatatttttagcttgcgtctttattctccacatgccagtgatttctgttcgtttttctttatctccagtgaaatcctgtgatgacttcatgggccaacttcttaatggccgtgtgctatttccagtaaatctccagcttggagcaaaagtggattttgtttgtgatgaagggtgagtatgagcttgcctgacctgctggacattgaaattggggttgggaatcagtctaaaaaggggagatttggtgtggcacacacacacacaccttcagagagatgaactttcgaaagtatacctaggaagaaaggaaagaaacatatagaactaataacatgagatatgaagaggaaactggaacatatattaactggcaagttcaaaggcaagtataactactggttatgaatatataagtaacacattaagcaaaaaatatcagccagaaacggtggctcacccctgtaatcctagcacctttgggaggttgaggcgggcagatcacctgaggtcaggagttggagaccagcctggacaacatgatgaaaccctgtctctactaaaaatacaaaagttagctgggtgtggtggcatgtgcctgtaatcccagctattccggaggctgaggcaccagaatcacttgaacctgggaggtggagtttgcagtgagccgagatggcaccattgcactccagcgtggacaataagagtgaaactccatctcaggaaaaaaaatcatattttacaagcaaaaaggaatatgagtaatttagagagtcccaggaaaaaactggaagtaacaaaagcttattataaaaagctaggatcatttgtgaatcatttcagtaaattctttaaatcgtcaacagtgaaatttgtaataggactgaaaatgtaaaaatcagcattttttaaaaaaatccagccatatatcatctggttaatcatgggctctgggctctgagctggggtcctgatggctgctgttaatatttccagcaagctcattaccttgtttatgtccacctagtgctcttcgcagggtgcacatctctacacgggagctgaccggcatgggcaacaaagcacctgatcccaaaatgtaacacagaatcttggcagcctccaaatgccagcacccagtaagagttaggagggcatcggggtccagcagacattgagaattttcgacaattgcatgcaaaaaataagtcctctcttctttcctttttcccctagaatattcatgcttactcttcagcagcccaaattgcccttttgagccttcttcacgccatcacagatgtggagatgaaaggacagtctgttctctcgccagctatttcccacttttccactccaaactgggagctgttttacttgctgttccagggtcagagttaggaaggcattacattagaagactgggtttctaataacaacaatgagtgatttatcaggttatcatggagtaatcagtgaaactccaagcctgggtcctgggtcaaggggatggcgcctatgtcatgaccacctttttcagttcaagcaggactatcatgtgaccaagctactgcattttgccattctatattgttcccttctggaggctgtgatttttccagaataaggtagcctgtgcaactctgccacctgctggcctaaggtcctaataatcctgaaattggggctgggccttagattgtgaactaagggttctcttggctgaaacagctcacactattcactcctattttcttctttagatttcaattaaaaggcagctctgctagttactgtgtcttggctggaatggaaagcctttggaatagcagtgttccagtgtgtgaacgtgagtagcaggagtaacatttcaggccagtctctcccttcatctgttcagtatttgacccatgacctcccctaatgtggttcttcaattttctagtttgaattattgatttgaaaattgcttattttaataatgtttggttgtgaatcaaatgtatacatcacctgtctttggaaccatctgatctgtctctgtccttctgtattctgtgttctagtgcgataaatcctatggtagcatgattctaggtcaggagagattagataatgtgaagccttaacaatttgctttctttctctctttcttttgtttcttttttctcttccttcctttcttcagttctttcttcccttctctttctctcccctttcttccttccttcctccttctttcttttccattttgttcttccatcaggtgcagtctacaatttttgtatatatttgataatacacaaatattaaacatgcctttatttaatcaatatttattgatcacatactttgtgcctgatgttcatctagccacaggagttatatcagtgaacaagatgaatgaattccctgtccccatgttgtttccactcagttggggaaagggacaagaaaaaaaataaatacgatgctatgaagatagtagagcaaagcatttaggcatgagggaaaagtgaggagcaacattagacaaggcgagcagtttgagactccttaaattctcaaaacatgtacctaaataatttatgctgagagattcataaataatgtcatttttaaaaatttattatacttttaagttctagggtacatgtgcacaacgtgcaggtttgttacatatgtatacatgtgccatgttggtgtgctgcacccattaactcgtcatttacattaggtatatctcctaatgctatccctccccgcttcccccaccccacaacaggccccggtgtgtgatgttcccctttttgtgtccaagtgttctcactgttcaattcccacctatgagtgagaacatgtggtgtttggttttttgtccttgtgatagtttgctgagaatgatggtttccagcttcatccatgtccctaaaaaggacatgaactcatcaatttttatggctgcatagtattccatggtgtatatgtgccacattttcttaatccagtctatcattgatggacatttgggttggttccaagtctttgctattgtgaataatgcagcaataaacatatgtgtgcatgtgtctttatagcagcatgatttataatcctttgggtatatacccagtaatgggatcgctgggtcaaatggtatttctagttctagatctttgaggaatcaccacactgtcttccacaatggttgaactaggttacagtcccaccaacagtgtaaaaatgttcctatttctccacatcttctccagcacctgttgtttcctgactttttaatgatagccattctaactggtgtgagatggtatctcattgtggttttgatttgcatttctctgatggccagtgatgatgagcattttttcatgtgtctgttagctgcataaatgtcttcttttgagaagtgtctgttcatatccttcacccactttttgatggggttgtttttttcttttaaatttgtttgagttcattgtagattctggatattagccctttgtcagatgagtagattgcaaaaatgttctcccattctgtaggttgtctgttcactctgatggtagtttcttttgctgtgcagaagctctttagtttaattatatcccctttgtcaattttggcttttgttgccattgcttttggtgttttagacatgaagtccttgcccatgcctgtgtcctgaatggtattgcctatgttttcttctaggatttttatggttttaggtctaacatttatgtctttaatccatcttgaattaatttttgtatacagtgtaaggaagggatccagtttcagctttctacatatggctagccagttttcccagtaccatttattaaatagggaatcctttccccatttcttgtttttgtcaggtttgtcaaagatcagatggttgtagatgtgtagtattatttctgagggctctgttctgttgcattggtctatatctctgttttggtaccagtaccatgctgttttggttactgtagccttgtagtatagtttgaagtcaggtagtttgatgcctccagtttgttcttttggcttaggatagacttggcaatgcaggctttttaaataatgtcatttttaaaaaatgagccccatatgttcaataatgagtagactactgatttctcctagtctccccatttataatttccccaatagaagatagaactttgcttcatttcttgattctaatgattgggaaatgtgtttctttagaaaaccatgaaattttactaaaatgtttatgttgttagaaatggacatcttacagtgctttttagagtaaaattttggaagaacataacttatatagagattcttgctgtctaagaaattcagtgctccttgaagcagcatgacaaatttctgttctaccatcatgaatgaaagctcattgattggactactcaagctttctcttatttttcataactgttgctagttaaagtagcttcttccaaattccagttctaatgaaaaatgccaattagaaatgaggaagaaactgttctaaacaaatcagcagatgctagaaaggagaaacaacttgaaacctgacccagaaagttaaaagagaaaataaatcatcaacagacctagacattttcaaaagcaaagccatctgaatccatttggagttgttttttatcatggccttactatgttttaattcactgtgacagggctattgttatcactgagattgatgatcaatatcaagaagtaatcagcgaaaggtttcacctatttaagatgattagcacacatatgtacatttgagaaatatttcctaagaatgcaggctccttcctcagcactctgtccccaggatcctgatgagtggctgacacaggacaagtgcttaattaatatatattgactaaatgaatgagcaacccttcaaaatggctatttttctttttcaaatgttttgctacttcattaaagttgtaaagtttccattgtccaggaaccgttactatccggaagattcaggatagacaagtctcttttgtactttgcaatacactttcattgatatctcatttaatccaactcttcaaagtcctaatgtctactgtcatctccttagcatattttcagcaacaccaatcatagcaccctgtaattgcagaatacctctggtgaaactcctgaatgaaacttagagctttcatgttttttctagaaatcttttgtccaagtcctccagttattcctaatgggagacacacaggaaaacctctggaagtctttccctttgggaaaacagtaaattacacatgcgacccccacccagacagagggacgagcttcgacctcattggagagagcaccatccgctgcacaagtgaccctcaagggaatggggtttggagcagccctgcccctcgctgtggaattctgggttagtgctcatttccccacatcccaaatgggttcagaatatctaacccaggccctccatatttccgtaattacaatgtggtatttatttgtgcatttgccacaatggaatgccaaaccaatgatagatggttctaaggtaggtcaacacataagatcctgatgacctttgcagatggagggactgatgaaaaaagagggaggcggtgagtggtgggaaagtccttcattagaatcatatgaattaaaaacagatgcctgtgaatctccttattgaaatgtttggtttagaaatctgacctagaaaatcggtggctccttctgccaggaaacgtcttgagttcccgcccatgcttgacagcctctcattggagttttgatgacttgaagtacaaggaaaccagacaggaaaggtggaacctgggcagaaaaactctttctggcttcctaaaaatgtgaaaaattaaatgggagctatctttacattaaattatatgagcattagctgagcgtggtggcaattgcctgtggtcccagctactcgagaggctgagatgggagtatcccttaagcctgggaggcagaggttgcagtgagccaagattgtgccactgcactccagcctgggtgacagagcgagaccctatctcaaaaacaataaaaataggcattaggaggccaaggctggtggatcactagaggtcaggagttccagaccagcccgcaaacacagtgaaactccaactctactaaaaatagaaaaaaaatttaaaaacaaaaataaattatatgagtagaaagaccagatagcaggctagtcttccaaataatatacttccttataagcctatgctaatggaactttcctttctattttacagggaagttttttttttttcataactaaaattttcttttcttctggcatcaaatctaccaaggaagagaaaagaggaaacacactgggtatctttttattaactcaaatattcttgatttcttggtctctaggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtgcgtaaacttgcgttggatctttcccatgtctgcaaaagcttcttatggaattatttcaaatgtgggatatgagaaaccttttctgaaaagtgttcggatagatggatgtaagagtttttcttgtaggcatccttgattgttgcttgaaatgttaacttcatgagaatgtttcaagaaatagttgtagagaaaatcttcattccctatgggaaagaaaataataaatgactagatcaggaaaaaaatggtgtaggaagacaaattctgtttgaataactaggtgggaagaaatcctttgcaaactttgaaatatattgatagtaaataatgccataaatgacctttacattttgataagggatgcaaggtctctacacagatctaaatctagatctagatagatctggagggaaggtctttttgaaagtggggcttagtaggtggctgatcctcagcgctctgatgagttttctcaaggtgccaaaatctgtggaaccatcagagccgcgtgttttcttcaggaagctacatgcaggttgagaccttacgtactgaagagagttcagattactctacctggctccaaaacattttctttcccacaggtaaatcatgtaaaactcctccagatccagtgaatggcatggtgcatgtgatcacagacatccaggttggatccagaatcaactattcttgtactacagggtgagttggcagcaacatctcttggtttaagagttccagcacagcgatagtactttctagccacatctcagcaaggaaactaggctattgccacctgctcttaagaggcttgaacacaggtgttaactcctgattgaaatgaacaaagataggagaagattagggggaaaatctgtatccttgctggaaaccagggcagtgcacatataaagagtatgctgttcactggatgggaaggaaaaaaacttagaagtgtagtagtcaaagcacacaaacaaccctaacccagagtagacattgctggaagaaagggaagaccatgtagcagctgtgtgagagaatgaatcttaatgataacagcatgatcccttgctagggctgccatcaaaaagtacaggccttcctcgttttattgtacttcgcagatgttatgctttttacaaattgaacgcttgtgggaacgctgtgtaagcatgttcgtcggcatcatttatccaacagcgtgtgttgacttcgtgtctctgtgtagcattttgattattctcacagtatcccagatgttttcattattatcatgtctgtgatagtgatctgtcatcagtgatctttgatgttactattgtcattgtttggggtccctacgaactgcacccatataagacagaaaacttaatcaataaatgtgcgtgctttgactgctccatggactagacattccccttctgtctccctctcttcaggactccctaatccctgagacacaataatactaaaatgactccaattaataaccctacaatagcctttaagtgttgacatgaagggaagagtcatgcatctcttactttaaatcaaaagctagagatgattaagcttactgaggaagatacgttgaaaaccaagataggccaaaagccattcctcatgtgccaaacagctagaaagttgtaaaggcaaagtaaaaatacttgaaggaaatttaaaatgctcttccagtgaacacatgtatgataagaaggtaaaacagccttattgctgatatggaagaagttttagtggtctagacataagatcaaactagaaacatttcctgaagccaaagcgtaatcctgagcaaggccgtaactctcttcaattctgtgaaggctgacagaagctggaagctagcagaatttggttcctgaggtttaaggaaagaagccctctccataacataaaggtccaaggtgaagcagccagtgctcatatagaagttgcagcaagttatctagaaaatctagctaagatcactgacgaaggtgttacactaaataacagattttccatgtagacaaaacagccatctattggactttcatagctagagaggagaagccaatacctgggttcaaagcttcaaagaacaggctgactttttaggagctaatgccgctggtgactttgagttgaagccaatgttcaccgaccattctaaaaatcctagggcccttaagcattaagttaaatataccttgcctgtgtctataaatggaagaacaaagcctgatgacagaggtatgtttgcggcatagtttactgaatattttaagcccactgttgagatctagtgctcagaaaaacagattcctttcaaaatattactgctcattgacattgcacctaagcagccaagagctctaatggagaaggacatggagatgaatggagttttcctgcctgctaacaacagcagccattctgcagcccatggctgaaggagtaattttgactttcaagtttcactatttaagaaatacattttgtaaggtgagtccccacagacagtaattcctctgatggatctgaacaaaataagttgaaaactgctggaaagaattcatcattctacataccattaagaacattcgtgattcatgggaagagcttaaaatatcaacattaataggagtttggtagaagttaattccaaccctcatggctgactttgagaggttcaagacttcagcggaggaaataactgaagatgtggtgaaaatcgcaagagaactacaattagaagtggagcctgaagacgtgactgaattgcgacaaattcatgatcaaacttgaacagatgaggagttgcttctcatgaatcagcagagaaagtggtttttttgaggtggagtgtcttcctggtgatgatgacatgagcattgtgaaaatgaccacaaaggatacagaatattacaaaaacttaggtgataaagcagcagcagtatcgggaggattaactccaattttgaaagcagttcagagggtaaaatgttatcaaacagcattgcatgctagaaaaatcttttgtgaaaggaagagtccatcaatacagcaattttattgctgtctcagcttaagaaattgccacagccaccccagccttcagcaaccaccaccctgatcagtcagcagccatcaaccttgaggcaagaccctccaccaacaaaaagattacaaattattgaaggtcagataatctttagtattttcttatcaataaacctttttttaaagtatgactttgtttagacataatgctatttcacacttaatagactaccgtatagtataaacacaacttttagactcactgagaaatcaaaaaattcatctgactcatttgttgtgatatgtgttttattgtggtggtctggaactgaacctgcaatatatttgaggaatgtctgtaacacgaagtgggcggcttaatacaacagaagtttttggagttccattctagagactggaaatccaaaatcaaggttttgggagggccacgctccctctgaatcctgtagggaaggatccttcattgcatcttccagcttctggagccacaggccttccttggcatgtggcagcagaactccaatttctgtctctgtcctcatatggccatcttccctctgggtctgtgtcctcatatgctgttctctctgtgcatgtctgtttccaaagttttcccttttaataaggacaccagtcacactggattagggcctaccttcatgacctcaccttaacttgattgcgtctgcaaagatcgtatttccaaataaggtcacatccacagggactggaggttaagacttcagcatactcaggggagacacaattcaacctataacagagcccctttgaaaatgtcaggcatcaggtgctcacagcacacggtccagctgttggtgctcacccttgctcagcacacggtggaggctctgcctcaatctcattcttcatgggaacagctaagccaggtagcgaatacgagttacgtttgtgtcaccacagcagacactgaaaggaagtttgtggtgtccagcacatttgccagcataggcctcacagaccacaacacctagaatctgacaaaaattagaataaatccgatgtctccttttctctctttttttaagcatttttaaatacaattggtaaatttcctgactgtaccctactcatcttgcattgctgaataagtgaggaacctctctatggcatgaagcagaaaaccattgagcttatgagaagaaacaggaaatacatgtaaaagagaccagtctgaaaaatcaggagaaattttacaaaagagatttactgccaagaaaccagggaaactttcagaacactctccttttcatatttgtaacaagattcaattgtacaaatacttctgtgaaactagccatgaagtgtgtacatgaatgaatatatgtattcagtgtgtttatatatttcatttcatacatgtgatctatatcatatatatatatatatatatatatatatatcacaatgaatattgcagaaaattaaagcaaagagtaagaagagttaaccaaatgttccctgaatgcagtgggaaaagatgaaaaggagaagacaggcaagcacagtggctcacacatgtaatcccaacatattgagaggccggggcaagaggatcacttgagcccaggagctcaagaccagcctggacaacatggcaaaaacccatctctacaaaaaagtataaaaattagctgggcatggcagcatgtgactgtagtcacagctaggcaggagaatgaagtgggaggatcacctgagcccaggaggctgaggcttcagtgagccttgatggcaaccctgcactccagcctggatgacagaatgagaccctgtctcaaaaaaggaaaaagagaagacatatgtaacacagtgtcaggattcaaaatacatgtagcaaaaattccagaagggtaagcaaataagcccatacctagccatcactagggaaacttctgtgtttcagggatagagaaaaaaactctgattccagaaataaaatgtgaaaatataatacccgcaaaagaaataaatttattgacaccacattgattctatattgtataagatatattgtataacactaaattgtagaagatagcacttctcttgagccaagctaatatgcacacctagaggctccaggtacacattaaaggataagcaaagacacaaaaattgtaccatttaagtatgtttcccaggcaattcataagcaaatttttaaaaaggagaatgatgaattccaaaggaaatctcaatgagataggatgtaggtaaaaagaaaaaacaacaataaaaaaaacatacacacaaaatcttggcaatgtaataataatttattaataatctctctaaactcatagaatatatcaataaaactagaaaatgtgagacagcaagaaaagataggctagacttacattacagaaaagatgagtagactgactatatagagtttgactctaaaattgagaaaagaggtttaaatatgtgtcacgtgtatatgtataatatacatgcacacatataaaatgaaattcctcactggaaaaaatattaagtttaatttccaaattattagaatgactaaaacagttgaatctatctgttccatatagtaattgagggggaaggaaaaggaatagcaaggaatccatttttctcttccaccagaaataagctccctcatgtttgggtcaggtcactttattcattgctttctccacatcctcatcattaggcatcatgaaatcaatgaaaaggcagtgaaagaatgatgatgaaagctaatcaaatgtatcatttacctcaatacgtttggtttaatcttcttgttgaaagacaaattctcctagacaggatcaaaagcaacatatcttgtatttataaaaaacatgtctcaagtaaaatgacatagtattatacacacacacacacatacacacacacacacacattaagggaaaatgcagacaaaaaatggcagaaataatatttagagaaagatagaatttaagaaaaaaaattgtcaaacaggtctgcaaaataattgttttattttggtgccagttacagtccgcaatgaagcgaagatattaagaagcaaagtgggccaggagaaattagagcagaaatatctctttcaatagtgagagaataggaaaaagaagtagaaaagctgggaacaataggtaaagtttaggctaggccttagacttctcctgcattgtaatccctctggtttgccacatatgcatgctgtcaggaagttgatgaggtatgtacagcacaatttattttccattttttgcctttaggcaccgactcattggtcactcatctgctgaatgtatcctctcgggcaatgctgcccattggagcacgaagccgccaatttgtcaacgtgagttgaaatctctttccccattcaccccaccgtttaatcctagagttgtcctcctagaattacaaagaatggatctcatccctcttggaaatggtatccttctcatatttgaagaatccagtcatatccttaaaatggctcacagcattccaaacttccaccttcagctagaaatgcttttttattttttcttatctcaaggtctaattttttttaaactagtctttagctcacttaaacagtcccccaatttcatcctctgttgggtgaacacctcccagtttaaagagcattttatttagtgaagtcaacaaatacaaagtcagtgaaagaaaccccatatcctctctgcaagctcttagtatcacatcagatattcaagccatgcagctctttcttccttcttattctttgtctaaacaggatcatgccatcttccctgtgagttgtttggaagatgagctttctacattttggggagcaaagacgaatgagcaattgcaagctaacaaggaatataaaatgtgtataatcctgggtttagtgatggtgtgaggaaatcagcaatttcaaacccagttggtgggaggataagtgggaacaaactttgtagaaggccaataaactggctgggcactgccctacggtagagtaggacacagtattcagttcttccaagatcagacgagattgggcgcatttagggtggtatggttgtagatcagtatccagttctttttattatttctgaatctgtaagtatcatgtttattatatgtaatattgtatatttgtactttgtctttgttagttcttccagagcttttgttcttattatttaataaagatgttatactgagccacatgtggtgactcaaacgtgtaatcccagcactttgggaggcctaggtgagcagatggcttgagtccaggagtttgagaccagcctgtacaacatactgaaacgctgtctctacaaaaatacaaaaactatacgggcatggtggcacatgcctgtagtcccaactactcaggagactgagaggtgggaggattgcttgagccagagaggtcgaggctgcaatgagccatgatcgtgccactgcactccagtctgggcagcagagcaagaccttgtctcaaaaaaaatgctatgctgtatgctttattatattaatatccaatagaataaagacacatgccttctatatagagagaactaaattaataatggtgagataacagttaaattctcatttagcaggagaaataaaaacatagactataggctaggcacagtggctcatacctgtaatcccagcacattaggaggctgaggtgggcagatcacttgaggtcagtagtttgagaccaccctggccaacataatgaaaccccgcctctactaaaaatacaaaagttagccgagtttggtggcgcatgcctgaaatcccagctactcaggaggctgaggcaggaaaatcgcttgaacctgggaggcaagggctgcagtgagccaagatcacgccactgcactccagcctggggaacagagtgaggatctgttaaaaaaaaaaaaaaaaagtggactctaataatacatggacacatttagtgaaataaacttaactgagtagagcagaacttataatattttaaaactgtaagaacatgtctgtacattagcaaatagtagatgagaatagtattttcaatatttacttctggtaatttggaattaaaaaaaaaacttttgggaaaatttacaataaagtatgattttaacaaaccaggctaggcgtggtggctcacgcttataatcccagcactttgaaaagcagaggcatgcagattgcttgaggccaggagttcaagactagcctgcccaacatggccaaaccccatctctactaaaaatacaaaaataaaccagacatggtagtgcatgcctgtgatcccagctactcgggaagttgaggtaggaggattgcttgacctgggaagtggaggttgcagtgagccatgatcgtgccactacactccagcctgggtgacagagcaagactctgtcccaaggttttgttttggttaacttgctgtccctttttccaggaattccttgtgggctaccccccaccatcgccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggcccggcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccaggggtgagtctgactgaggcctagtagggccctgcaagtgacatgcgttgctgttggatcaggagattagtatttgttcacggggagggatgtgtgctgagcagggtcgaggagcaaattttctaagtagtgaacatgaaattcaggtgtgtagacatgcacatgtgctgaaattgagaagcaaagctcaacctgggcaagggatatgatgtttctttggggttcttataaacagatctatcaattacctttgagtataataatgtttgatacaaaatgagtgattcctctgcccaggcactataatacaggctacatgtgaattttaatcctgaaaacaaagttattaggtagttcccagttgttctatgtttgtctgttttgttttgcttgagatactgtcttgatctgtcactcaggttggactgcagtggtgccatcatggcatacttcaccctccacctccctgactcaagcaagtctcctgcctgagcctcccaagtagctgggaatgtaggtgcatgccaccatgcctggctaagttttttatattttttttgtagggacagagtctcaccatgctgcccaggctggtctcaaactcctcagctcaagcacccacccaccttgggctcccaaagtgctgggattataggcatgagccactgtgcccggcctctatgttttacagagaatatgtgccttagacacatcagataacattctgagacagtaacttgcagacaaaactggattgcaagtccacctcactccagagccttggctttgctcatcagcattcagtcatgaaatcaaaacttactctagatactttcaaggagggagggatttcatgcaggttgtattagtctgttctcacattcctataaaaaactacttgagcctgggtaatttataaagaaaagatgtttaattgactcagagttctgtaggctgtacaggaggcatggctgggaaagttacaatcatggtggaaggcaaagaggaagcacgcatatcttcatatgcttggcaggagagagagagagagcaaggcagaggtgttacagactttgaaacaagcagatcttgacagaactctatcacaagacagcactagggtgatggtgctcaaccattagaaaccacctccatgatccagtcacctcccaccaggctccttctccaacactgggaattaccatttgacatgagatttgggaggggacatagagccaaaccatatcgcagctaataggtcacaaaaatgttagaagggcaggaaaagcaataggacaaaggcaaagttacgagagatcagggagctgctgtggctcccagtctacagcacaggagcctggagtgatggtgaaatggccagcccctcccactgagcaggcagctccctgtaagctgctaatactgcaggagccaccattgctgccagaatgcagctgatattgctggagccaaagtcattggcatcgttacaattgaagctgtagctactcactgaagccatctatactgccactgcctgagccacttctagaagtagaacagattctgccatcatcctgctttttaatttggtatatatgcctccaattggcagaacctaaccagagcctagctatcaaggaagatgaacgatttatttttaaggcctccattgttagctgtcaaaagacagtgcagaaatgtgaggctgggggccaacagaaatttaaccagcacagcacctcaatattacatcaccaggcattgattagtccagggaaacactgggtgatgagccctgaaaatggacattacagcatcagagtatttacaaactccttaaagaagtcatttttctattccaatcccccatttgatgcttgagaaagctgaagtccagaaaagggaactgatctgctcaaagacaaactgaaattactttttccattttataacagttttatgtaatttatttgagatccaaatgtgttttgatttcccaagatcagatcaactacattaagagagagcctgagatgccgttacaatatgttgtgtgaaattacactctcattatggtgacagtaggtctttcagattttgttcgacagtttcccaccttctcactgaagtgaaatgaatgactaggcagcaccttgctacatagcatgaagagaggagacccatagttctttaccaccctatgtcaggtggccgctgagagaagacttgaaaggagatgagcatagatgtatggacgctctttgttgcaccagtgtgataggtgatggagggacctattagatgggacatgggcaggggcactcctttattgcttaaaatgcaagactaaattggtgatgcctttctagaaaggaagtatgaagatacaaaaatccatcattcctcccaattttgtactgggtgaacagtaattggaagcattctagaaggaactgtccattgtgaaatcttagttgcatactttagatgaaaaacaatgaattggagatacctctgttttagtcacagttgtgccatgtgtcagttctatgactgatggcaagacatcttccttgccccgtgtatttagtttatcaatgtaataaggctgttattctaactttattattatatatagattcgtaattattattcccttggccagtttaacagtgagaaaaaagttgttttcacacaattagctgtactttgtttctctctccccagtatgtcagccacctccagatgtcctgcatgctgagcgtacccaaagggacaaggacaacttttcacccgggcaggaagtgttctacagctgtgagcccggctacgacctcagaggggctgcgtctatgcgctgcacaccccagggagactggagccctgcagcccccacatgtgaaggtgactagactcttatctggcttgatatttttagcttgcgtctttattctccacatgccagtgatttctgttcgtttttctttatctccagtgaaatcctgtgatgacttcatgggccaacttcttaatggccgtgtgctatttccagtaaatctccagcttggagcaaaagtggattttgtttgtgatgaagggtgagtatgagcttgcctgacctgctggacattgaaattggggttgggaatcagtctaaaaaggggagatttggtgtggcacacacacacacaccttcagagagatgaactttcgaaagtatacctaggaagaaaggaaagaaacatatagaactaataacatgagatatgaagaggaaactggaacatatattaactggcaagttcaaaggcaagtataactactggttatgaatatataagtaacacattaagcaaaaaatatcagccagaaacggtggctcacccctgtaatcctagcacctttgggaggttgaggcgggcagatcacctgaggtcaggagttggagaccagcctggacaacatgatgaaaccctgtctctactaaaaatacaaaagttagctgggtgtggtggcatgtgcctgtaatcccagctattccggaggctgaggcaccagaatcacttgaacctgggaggtggagtttgcagtgagccgagatggcaccattgcactccagcgtggacaataagagtgaaactccatctcaggaaaaaaaatcatattttacaagcaaaaaggaatatgagtaatttagagagtcccaggaaaaaactggaagtaacaaaagcttattataaaaagctaggatcatttgtgaatcatttcagtaaattctttaaatcgtcaacagtgaaatttgtaataggactgaaaatgtaaaaatcagcattttttaaaaaaatccagccatatatcatctggttaatcatgggctctgggctctgagctggggtcctgatggctgctgttaatatttccagcaagctcattaccttgtttatgtccacctagtgctcttcgcagggtgcacatctctacacgggagctgaccggcatgggcaacaaagcacctgatcccaaaatgtaacacagaatcttggcagcctccaaatgccagcacccagtaagagttaggagggcatcggggtccagcagacattgagaattttcgacaattgcatgcaaaaaataagtcctctcttctttcctttttcccctagaatattcatgcttactcttcagcagcccaaattgcccttttgagccttcttcacgccatcacagatgtggagatgaaaggacagtctgttctctcgccagctatttcccacttttccactccaaactgggagctgttttacttgctgttccagggtcagagttaggaaggcattacattagaagactgggtttctaataacaacaatgagtgatttatcaggttatcatggagtaatcagtgaaactccaagcctgggtcctgggtcaaggggatggcgcctatgtcatgaccacctttttcagttcaagcaggactatcatgtgaccaagctactgcattttgccattctatattgttcccttctggaggctgtgatttttccagaataaggtagcctgtgcaactctgccacctgctggcctaaggtcctaataatcctgaaattggggctgggccttagattgtgaactaagggttctcttggctgaaacagctcacactattcactcctattttcttctttagatttcaattaaaaggcagctctgctagttactgtgtcttggctggaatggaaagcctttggaatagcagtgttccagtgtgtgaacgtgagtagcaggagtaacatttcaggccagtctctcccttcatctgttcagtatttgacccatgacctcccctaatgtggttcttcaattttctagtttgaattattgatttgaaaattgcttattttaataatgtttggttgtgaatcaaatgtatacatcacctgtctttggaaccatctgatctgtctctgtccttctgtattctgtgttctagtgcgataaatcctatggtagcatgattctaggtcaggagagattagataatgtgaagccttaacaatttgctttctttctctctttcttttgtttcttttttctcttccttcctttcttcagttctttcttcccttctctttctctcccctttcttccttccttcctccttctttcttttccattttgttcttccatcaggtgcagtctacaatttttgtatatatttgataatacacaaatattaaacatgcctttatttaatcaatatttattgatcacatactttgtgcctgatgttcatctagccacaggagttatatcagtgaacaagatgaatgaattccctgtccccatgttgtttccactcagttggggaaagggacaagaaaaaaaataaatacgatgctatgaagatagtagagcaaagcatttaggcatgagggaaaagtgaggagcaacattagacaaggcgagcagtttgagactccttaaattctcaaaacatgtacctaaataatttatgctgagagattcataaataatgtcatttttaaaaatttattatacttttaagttctagggtacatgtgcacaacgtgcaggtttgttacatatgtatacatgtgccatgttggtgtgctgcacccattaactcgtcatttacattaggtatatctcctaatgctatccctccccgcttcccccaccccacaacaggccccggtgtgtgatgttcccctttttgtgtccaagtgttctcactgttcaattcccacctatgagtgagaacatgtggtgtttggttttttgtccttgtgatagtttgctgagaatgatggtttccagcttcatccatgtccctaaaaaggacatgaactcatcaatttttatggctgcatagtattccatggtgtatatgtgccacattttcttaatccagtctatcattgatggacatttgggttggttccaagtctttgctattgtgaataatgcagcaataaacatatgtgtgcatgtgtctttatagcagcatgatttataatcctttgggtatatacccagtaatgggatcgctgggtcaaatggtatttctagttctagatctttgaggaatcaccacactgtcttccacaatggttgaactaggttacagtcccaccaacagtgtaaaaatgttcctatttctccacatcttctccagcacctgttgtttcctgactttttaatgatagccattctaactggtgtgagatggtatctcattgtggttttgatttgcatttctctgatggccagtgatgatgagcattttttcatgtgtctgttagctgcataaatgtcttcttttgagaagtgtctgttcatatccttcacccactttttgatggggttgtttttttcttttaaatttgtttgagttcattgtagattctggatattagccctttgtcagatgagtagattgcaaaaatgttctcccattctgtaggttgtctgttcactctgatggtagtttcttttgctgtgcagaagctctttagtttaattatatcccctttgtcaattttggcttttgttgccattgcttttggtgttttagacatgaagtccttgcccatgcctgtgtcctgaatggtattgcctatgttttcttctaggatttttatggttttaggtctaacatttatgtctttaatccatcttgaattaatttttgtatacagtgtaaggaagggatccagtttcagctttctacatatggctagccagttttcccagtaccatttattaaatagggaatcctttccccatttcttgtttttgtcaggtttgtcaaagatcagatggttgtagatgtgtagtattatttctgagggctctgttctgttgcattggtctatatctctgttttggtaccagtaccatgctgttttggttactgtagccttgtagtatagtttgaagtcaggtagtttgatgcctccagtttgttcttttggcttaggatagacttggcaatgcaggctttttaaataatgtcatttttaaaaaatgagccccatatgttcaataatgagtagactactgatttctcctagtctccccatttataatttccccaatagaagatagaactttgcttcatttcttgattctaatgattgggaaatgtgtttctttagaaaaccatgaaattttactaaaatgtttatgttgttagaaatggacatcttacagtgctttttagagtaaaattttggaagaacataacttatatagagattcttgctgtctaagaaattcagtgctccttgaagcagcatgacaaatttctgttctaccatcatgaatgaaagctcattgattggactactcaagctttctcttatttttcataactgttgctagttaaagtagcttcttccaaattccagttctaatgaaaaatgccaattagaaatgaggaagaaactgttctaaacaaatcagcagatgctagaaaggagaaacaacttgaaacctgacccagaaagttaaaagagaaaataaatcatcaacagacctagacattttcaaaagcaaagccatctgaatccatttggagttgttttttatcatggccttactatgttttaattcactgtgacagggctattgttatcactgagattgatgatcaatatcaagaagtaatcagcgaaaggtttcacctatttaagatgattagcacacatatgtacatttgagaaatatttcctaagaatgcaggctccttcctcagcactctgtccccaggatcctgatgagtggctgacacaggacaagtgcttaattaatatatattgactaaatgaatgagcaacccttcaaaatggctatttttctttttcaaatgttttgctacttcattaaagttgtaaagtttccattgtccaggaaccgttactatccggaagattcaggatagacaagtctcttttgtactttgcaatacactttcattgatatctcatttaatccaactcttcaaagtcctaatgtctactgtcatctccttagcatattttcagcaacaccaatcatagcaccctgtaattgcagaatacctctggtgaaactcctgaatgaaacttagagctttcatgttttttctagaaatcttttgtccaagtcctccagttattcctaatgggagacacacaggaaaacctctggaagtctttccctttgggaaaacagtaaattacacatgcgacccccacccagacagagggacgagcttcgacctcattggagagagcaccatccgctgcacaagtgaccctcaagggaatggggtttggagcagccctgcccctcgctgtggaattctgggttagtgctcatttccccacatcccaaatgggttcagaatatctaacccaggccctccatatttccgtaattacaatgtggtatttatttgtgcatttgccacaatggaatgccaaaccaatgatagatggttctaaggtaggtcaacacataagatcctgatgacctttgcagatggagggactgatgaaaaaagagggaggcggtgagtggtgggaaagtccttcattagaatcatatgaattaaaaacagatgcctgtgaatctccttattgaaatgtttggtttagaaatctgacctagaaaatcggtggctccttctgccaggaaacgtcttgagttcccgcccatgcttgacagcctctcattggagttttgatgacttgaagtacaaggaaaccagacaggaaaggtggaacctgggcagaaaaactctttctggcttcctaaaaatgtgaaaaattaaatgggagctatctttacattaaattatatgagcattagctgagcgtggtggcaattgcctgtggtcccagctactcgagaggctgagatgggagtatcccttaagcctgggaggcagaggttgcagtgagccaagattgtgccactgcactccagcctgggtgacagagcgagaccctatctcaaaaacaataaaaataggcattaggaggccaaggctggtggatcactagaggtcaggagttccagaccagcccgcaaacacagtgaaactccaactctactaaaaatagaaaaaaaatttaaaaacaaaaataaattatatgagtagaaagaccagatagcaggctagtcttccaaataatatacttccttataagcctatgctaatggaactttcctttctattttacagggaagttttttttttttcataactaaaattttcttttcttctggcatcaaatctaccaaggaagagaaaagaggaaacacactgggtatctttttattaactcaaatattcttgatttcttggtctctaggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtgcgtaaacttgcgttggatctttcccatgtctgcaaaagcttcttatggaattatttcaaatgtgggatatgagaaaccttttctgaaaagtgttcggatagatggatgtaagagtttttcttgtaggcatccttgattgttgcttgaaatgttaacttcatgagaatgtttcaagaaatagttgtagagaaaatcttcattccctatgggaaagaaaataataaatgactagatcaggaaaaaaatggtgtaggaagacaaattctgtttgaataactaggtgggaagaaatcctttgcaaactttgaaatatattgatagtaaataatgccataaatgacctttacattttgataagggatgcaaggtctctacacagatctaaatctagatctagatagatctggagggaaggtctttttgaaagtggggcttagtaggtggctgatcctcagcgctctgatgagttttctcaaggtgccaaaatctgtggaaccatcagaaccgcgtgttttcttcaggaagctacatgcaggttgagaccttacgtactgaagagagttcagattactctacctggctccaaaacattttctttcccacaggtaaatcatgtaaaactcctccagatccagtgaatggcatggtgcatgtgatcacagacatccaggttggatccagaatcaactattcttgtactacagggtgagttggcagcaacatctcttggtttaagagttccagcacagcgatagtactttctagccacatctcagcaaggaaactaggctattgccacctgctcttaagaggcttgaacacaggtgttaactcctgattgaaatgaacaaagataggagaagattagggggaaaatctgtatccttgctggaaaccagggcagtgcacatataaagagtatgctgttcactggatgggaaagaaaaaaaattagaagtgtagtagtcaaagcacacaaacaaccctaacccagagtagacattgctggaagaaagggaagaccatgtagcagctgtgtgagagaatgaatcttaatgataacagcatgatcccttgctagggctgccatcaaaaagtacaggccttcctcgttttattgtacttcgcagatgttatgctttttacaaattgaacgcttgtgggaacgctgtgtaagcatgttcgtcggcatcatttatccaacagcgtgtgttgacttcgtgtctctgtgtagcattttgattattctcacagtatcccagatgttttcattattatcatgtctgtgatagtgatctgtcatcagtgatctttgatgttactattgtcattgtttggggtccctacgaactgcacccatataagacagaaaacttaatcaataaatgtgcgtgctttgactgctccatggactagacattccccttctgtctccctctcttcaggactccctaatccctgagacacaataatactaaaatgactccaattaataaccctacaatagcctttaagtgttgacatgaagggaagagtcatgcatctcttactttaaatcaaaagctagagatgattaagcttactgaggaagatacgttgaaaaccaagataggccaaaagccattcctcatgtgccaaacagctagaaagttgtaaaggcaaagtaaaaatacttgaaggaaatttaaaatgctcttccagtgaacacatgtatgataagaaggtaaaacagccttattgctgatatggaagaagttttagtggtctagatataagatcaaactagaaacatttcctgaagccaaagcgtaatcctgagcaaggccgtaactctcttcaattctgtgaaggctgacagaagctggaagctagcagaatttggttcctgaggtttaaggaaagaagccctctccataacataaaggtccaaggtgaagcagccagtgctcatatagaagttgcagcaagttatctagaaaatctagctaagatcactgacgaaggtgttacactaaataacagattttccatgtagacaaaacagccatctattggactttcatagctagagaggagaagccaatacctgggttcaaagcttcaaagaacaggctgactttttaggagctaatgccgctggtgactttgagttgaagccaatgttcaccgaccattctaaaaatcctagggcccttaagcattaagttaaatataccttgcctgtgtctataaatggaagaacaaagcctgatgacagaggtatgtttgcggcatagtttactgaatattttaagcccactgttgagatctagtgctcagaaaaacagattcctttcaaaatattactgctcattgacattgcacctaagcagccaagagctctaatggagatggacatggagatgaatggagttttcctgcctgctaacaacggcagccattctgcagcccatggctgaaggagtaattttgactttcaagtttcactatttaagaaatacattttgtaaggtgagtccccacagacagtaattcctctgatggatctgaacaaaataagttgaaaactgctggaaagaattcatcattctacataccattaagaacattcgtgattcatgggaagagcttaaaatatcaacattaataggagtttggtagaagttaattccaaccctcatggctgactttgagaggttcaagacttcagcggaggaaataactgaagatgtggtgaaaatcgcaagagaactacaattagaagtggagcctgaagacgtgactgaattgcgacaaattcatgatcaaacttgaacagatgaggagttgcttctcatgaatcagcagagaaagtggtttttttgaggtggagtgtcttcctggtgatgatgacatgagcattgtgaaaatgaccacaaaggatacagaatattacaaaaacttaggtgataaagcagcagcagtatcgggaggattaactccaattttgaaagcagttcagagggtaaaatgttatcaaacagcattgcatgctagaaaaatcttttgtgaaaggaagagtccatcaatacagcaattttattgctgtctcagcttaagaaattgccacagccaccccagccttcagcaaccaccaccctgatcagtcagcagccatcaaccttgaggcaagaccctccaccaacaaaaagattacaaattattgaaggtcagataatctttagtattttcttatcaataaacctttttttaaagtatgactttgtttagacataatgctatttcacacttaatagactaccgtatagtataaacacaacttttagactcactgagaaatcaaaaaattcatctgactcatttgttgtgatatgtgttttattgtggtggtctggaactgaacctgcaatatatttgaggaatgtctgtaacacgaagtgggcggcttaatacaacagaagtttttggagttccattctagagactggaaatccaaaatcaaggttttgggagggccacgctccctctgaatcctgtagggaaggatccttcattgcatcttccagcttctggagccacaggccttccttggcatgtggcagcagaactccaatttctgtctctgtcctcatatggccatcttccctctgggtctgtgtcctcatatgctgttctctctgtgcatgtctgtttccaaagttttcccttttaataaggacaccagtcacactggattagggcctaccttcatgacctcaccttaacttgattgcgtctgcaaagatcgtatttccaaataaggtcacatccacagggactggaggttaagacttcagcatactcaggggagacacaattcaacctataacagagcccctttgaaaatgtcaggcatcaggtgctcacagcacacggtccagctgttggtgctcacccttgctcagcacacggtggaggctctgcctcaatctcattcttcatgggaacagctaagccaggtagcgaatacgagttacgtttgtgtcaccacagcagacactgaaaggaagtttgtggtgtccagcacatttgccagcataggcctcacagaccacaacacctagaatctgacaaaaattagaataaatccgatgtctccttttctctctttttttaagcatttttaaatacaattggtaaatttcctgactgtaccctactcatcttgcattgctgaataagtgaggaacctctctatggcatgaagcagaaaaccattgagcttatgagaagaaacaggaaatacatgtaaaagagaccagtctgaaaaatcaggagaaattttacaaaagagatttactgccaagaaaccagggaaactttcagaacactctccttttcatatttgtaacaagattcaattgtacaaatacttctgtgaaactagccatgaagtgtgtacatgaatgaatatatgtattcagtgtgtttatatatttcatttcatacatgtgatctatatcatatatatatatatatatatatatatatatatcacaatgaatattgcagaaaattaaagcaaagagtaagaagagttaaccaaatgttccctgaatgcagtgggaaaagatgaaaaggagaagacaggcaagcacagtggctcacacatgtaatcccaacatattgagaggccggggcaagaggatcacttgagcccaggagctcaagaccagcctggacaacatggcaaaaacccatctctacaaaaaagtataaaaattagctgggcatggcagcatgtgactgtagtcacagctaggcaggagaatgaagtgggaggatcacctgagcccaggaggctgaggcttcagtgagccttgatggcaaccctgcactccagcctggatgacagaatgagaccctgtctcaaaaaaggaaaaagagaagacatatgtaacacagtgtcaggattcaaaatacatgtagcaaaaattccagaagggtaagcaaataagcccatacctagccatcactagggaaacttctgtgtttcagggatagagaaaaaaactctgattccagaaataaaatgtgaaaatataatacccgcaaaagaaataaatttattgacaccacattgattctatattgtataagatatattgtataacactaaattgtagaagatagcacttctcttgagccaagctaatatgcacacctagaggctccaggtacacattaaaggataagcaaagacacaaaaattgtaccatttaagtatgtttcccaggcaattcataagcaaatttttaaaaaggagaatgatgaattccaaaggaaatctcaatgagataggatgtaggtaaaaagaaaaaacaacaataaaaaaaacatacacacaaaatcttggcaatgtaataataatttattaataatctctctaaactcatagaatatatcaataaaactagaaaatgtgagacagcaagaaaagataggctagacttacattacagaaaagatgagtagactgactatatagagtttgactctaaaattgagaaaagaggtttaaatatgtgtcacgtgtatatgtataatatacatgcacacatataaaatgaaattcctcactggaaaaaatattaagtttaatttccaaattattagaatgactaaaacagttgaatctatctgttccatatagtaattgagggggaaggaaaaggaatagcaaggaatccatttttctcttccaccagaaataagctccctcatgtttgggtcaggtcactttattcattgctttctccacatcctcatcattaggcatcatgaaatcaatgaaaaggcagtgaaagaatgatgatgaaagctaatcaaatgtatcatttacctcaatacgtttggtttaatcttcttgttgaaagacaaattctcctagacaggatcaaaagcaacatatcttgtatttataaaaaacatgtctcaagtaaaatgacatagtattatacacacacacacacatacacacacacacacacattaagggaaaatgcagacaaaaaatggcagaaataatatttagagaaagatagaatttaagaaaaaaaattgtcaaacaggtctgcaaaataattgttttattttggtgccagttacagtccgcaatgaagcgaagatattaagaagcaaagtgggccaggagaaattagagcagaaatatctctttcaatagtgagagaataggaaaaagaagtagaaaagctgggaacaataggtaaagtttaggctaggccttagacttctcctgcattgtaatccctctggtttgccacatatgcatgctgtcaggaagttgatgaggtatgtacagcacaatttattttccattttttgcctttaggcaccgactcattggtcactcatctgctgaatgtatcctctcgggcaatgctgcccattggagcacgaagccgccaatttgtcaacgtgagttgaaatctctttccccattcaccccaccgtttaatcctagagttgtcctcctagaattacaaagaatggatctcatccctcttggaaatggtatccttctcatatttgaagaatccagtcatatccttaaaatggctcacagcattccaaacttccaccttcagctagaaatgcttttttattttttcttatctcaaggtctaattttttttaaactagtctttagctcacttaaacagtcccccaatttcatcctctgttgggtgaacacctcccagtttaaagagcattttatttagtgaagtcaacaaatacaaagtcagtgaaagaaaccccatatcctctctgcaagctcttagtatcacatcagatattcaagccatgcagctctttcttccttcttattctttgtctaaacaggatcatgccatcttccctgtgagttgtttggaagatgagctttctacattttggggagcaaagacgaatgagcaattgcaagctaacaaggaatataaaatgtgtataatcctgggtttagtgatggtgtgaggaaatcagcaatttcaaacccagttggtgggaggataagtgggaacaaactttgtagaaggccaataaactggctgggcactgccctacggtagagtaggacacagtattcagttcttccaagatcagacgagattgggcgcatttagggtggtatggttgtagatcagtatccagttctttttattatttctgaatctgtaagtatcatgtttattatatgtaatattgtatatttgtactttgtctttgttagttcttccagagcttttgttcttattatttaataaagatgttatactgagccacatgtggtgactcaaacgtgtaatcccagcactttgggaggcctaggtgagcagatggcttgagtccaggagtttgagaccagcctgtacaacatactgaaacgctgtctctacaaaaatacaaaaactatacgggcatggtggcacatgcctgtagtcccaactactcaggagactgagaggtgggaggattgcttgagccagagaggtcgaggctgcaatgagccatgatcgtgccactgcactccagtctgggcagcagagcaagaccttgtctcaaaaaaaatgctatgctgtatgctttattatattaatatccaatagaataaagacacatgccttctatatagagagaactaaattaataatggtgagataacagttaaattctcatttagcaggagaaataaaaacatagactataggctaggcacagtggctcatacctgtaatcccagcacattaggaggctgaggtgggcagatcacttgaggtcagtagtttgagaccaccctggccaacataatgaaaccccgcctctactaaaaatacaaaagttagccgagtttggtggcgcatgcctgaaatcccagctactcaggaggctgaggcaggaaaatcgcttgaacctgggaggcaagggctgcagtgagccaagatcacgccactgcactccagcctggggaacagagtgaggatctgttaaaaaaaaaaaaaaaaagtggactctaataatacatggacacatttagtgaaataaacttaactgagtagagcagaacttataatattttaaaactgtaagaacatgtctgtacattagcaaatagtagatgagaatagtattttcaatatttacttctggtaatttggaattaaaaaaaaaacttttgggaaaatttacaataaagtatgattttaacaaaccaggctaggcgtggtggctcacgcttataatcccagcactttgaaaagcagaggcatgcagattgcttgaggccaggagttcaagactagcctgcccaacatggccaaaccccatctctactaaaaatacaaaaataaaccagacatggtagtgcatgcctgtgatcccagctactcgggaagttgaggtaggaggattgcttgacctgggaagtggaggttgcagtgagccatgatcgtgccactacactccagcctgggtgacagagcaagactctgtcccaaggttttgttttggttaacttgctgtccctttttccaggaattccttgtgggctaccccccaccatcgccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggcccggcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccaggggtgagtctgactgaggcctagtagggccctgcaagtgacatgcgttgctgttggatcaggagattagtatttgttcacggggagggatgtgtgctgagcagggtcgaggagcaaattttctaagtagtgaacatgaaattcaggtgtgtagacatgtacatgtgctgaaattgagaagcaaagctcaacctgggcaagggatatgatgtttctttggggttcttataaacagatctatcaattacctttgagtataataatgtttgatacaaaatgagtgattcctctgcccaggcactataatacaggctacatgtgaattttaatcctgaaaacaaagttattaggtagttcccagttgttctatgtttgtctgttttgttttgcttgagatactgtcttgatctgtcactcaggttggactgcagtggtgccatcatggcatacttcaccctccacctccctgactcaagcaagtctcctgcctgagcctcccaagtagctgggaatgtaggtgcatgccaccatgcctggctaagttttttatattttttttgtagggacagagtctcaccatgctgcccaggctggtctcaaactcctcagctcaagcacccacccaccttgggctcccaaagtgctgggattataggcatgagccactgtgcccggcctctatgttttacagagaatatgtgccttagacacatcagataacattctgagacagtaacttgcagacaaaactggattgcaagtccacctcactccagagccttggctttgctcatcagcattcagtcatgaaatcaaaacttactctagatactttcaaggagggagggatttcatgcaggttgtattagtctgttctcacattcctataaaaaactacttgagcctgggtaatttataaagaaaagatgtttaattgactcagagttctgtaggctgtacaggaggcatggctgggaaagttacaatcatggtggaaggcaaagaggaagcacgcatatcttcatatgcttggcaggagagagagagagagcaaggcagaggtgttacagactttgaaacaagcagatcttgacagaactctatcacaagacagcactagggtgatggtgctcaaccattagaaaccacctccatgatccagtcacctcccaccaggctccttctccaacactgggaattaccatttgacatgagatttgggaggggacatagagccaaaccatatcgcagctaataggtcacaaaaatgttagaagggcaggaaaagcaataggacaaaggcaaagttacgagagatcagggagctgctgtggctcccagtctacagcacaggagcctggagtgatggtgaaatggccagcccctcccactgagcaggcagctccctgtaagctgctaatactgcaggagccaccattgctgccagaatgcagctgatattgctggagccaaagtcattggcatcgttacaattgaagctgtagctactcactgaagccatctatactgccactgcctgagccacttctagaagtagaacagattctgccatcatcctgctttttaatttggtatatatgcctccaattggcagaacctaaccagagcctagctatcaaggaagatgaacgatttatttttaaggcctccattgttagctgtcaaaagacagtgcagaagtgtgaggctgggggccaacagaaatttaaccagcacagcacctcaatattacatcaccaggcattgattagtccagggaaacactgggtgatgagccctgaaaatggacattacagcatcagagtatttacaaactccttaaagaagtcatttttctattccaatcccccatttgatgcttgagaaagctgaagtccagaaaagggaactgatctgctcaaagacaaactgaaattactttttccattttataacagttttatgtaatttatttgagatccaaatgtgttttgatttcccaagatcagatcaactacattaagagagagcctgagatgccgttacaatatgttgtgtgaaattacactctcattatggtgacagtaggtctttcagattttgttcgacagtttcccaccttctcactgaagtgaaatgaatgactaggcagcacctgctacatagcatgaagagaggagacccatagttctttaccaccctatgtcaggtggccgctgagagaagacttgaaaggagatgagcatagatgtatggacgctctttgttgcaccagtgtgataggtgatggagggacctattagatgggacatgggcaggggcactcctttattgcttaaaatgcaagactaaattggtgatgcctttctagaaaggaagtatgaagatacaaaaatccatcattcctcccaattttgtactgggtgaacagtaattggaagcattctagaaggaactgtccattgtgaaatcttagttgcatactttagatgaaaaacaatgaattggagatacctctgttttagtcacagttgtgccatgtgtcagttctatgactgatggcaagacatcttccttgccccgtgtatttagtttatcaatgtaataaggctgttattctaactttattattatatatagattcgtaattattattcccttggccagtttaacagtgagaaaaaagttgttttcacacaattagctgtactttgtttctctctccccagtatgtcagccacctccagatgtcctgcatgctgagcgtacccaaagggacaaggacaacttttcacccgggcaggaagtgttctacagctgtgagcccggctatgacctcagaggggctgcgtctatgcgctgcacaccccagggagactggagccctgcagcccccacatgtgaaggtgactagactcttatctggcttgatatttttagcttgcgtctttattctccacatgccagtgatttctgttcgtttttctttatctccagtgaaatcctgtgatgacttcatgggccaacttcttaatggccgtgtgctatttccagtaaatctccagcttggagcaaaagtggattttgtttgtgatgaagggtgagtatgagcttgcctgacctgctggacattgaaattggggttgggaatcagtctaaaaaggggagatttggtgtggcttaaaagaaagacacacacacacacacacaccttcagagagatgaactttcgaaagtatacctaggaagaaaggaaagaaacatatagaactaataacatgagatatgaagaggaaactggaacatatattaactggcaagttcaaaggcaagtataactagtggttatgaatatataggtaacacattaagcaaaaaatatcagccaggcacggtggctcacgtgtgtaatcccagcacctttgggaggttgaggcaggcagatcacctgaggtcaggagttggagaccagcctggacaacatggtgaaaccctgtctctactaaaaatacaaaagttagctgggtttggtggcatgtgcctgtaatcccagctactccggaggctgaggcaccagaatcacttgaacctgggaggtggagtttgcagtgagccgagatggcaccattgcactccagcgtgaacaatgagtgaaactccatctcaggaaaaaaatcatattttacaagcaaaagggaatatgagtaatttagagagtcccaggaaaaattgcaagtaatgaaaagcttattattaaaagctaggatcctttaagaatcatttcagtaaattctttaaaccatcaacagtgaaatttgtaataggactgaaaatgtaaaaatcagcatttttttaaaaattcagtcatatatcttctggctagtcatgggctctgggctctgagctggggtcgtgatggctgctgttaatattcccagcaaggtcattaccttgtttatgtccatctagtgctcttcacagcgtgcacatctctacacaggagctgaccggcatgggcaacaaagcacctgatcccataatgtaacacagaatcttggcagcctccaaatgccagcacccagtaagagttaggagggcatcagggtccaaaagactgagaattttcgacaattgcatacaaaaatcatgtcctctcttctttcctttttcccctagaatattcatgcttactcttcagcagcccaaactgcccttttgagccttcttcacgccatcacagatgtggagatgaaaggacaatctctgttctctcgccagctatttcccacttttccactccaaactgggagctgttttacttgctgttccagggtcagagttaggaaggcattacattagaagactgggtttctaataacaacaatgagtgatttatcaggttatcatggagtaatcagtgaaactccaagcctgggtcctgggtcaaggggatggcgcctatgtcatgaccacctttttcaattcaagcaggactatcatgtgaccaagctactacattttgccattctatattgttcccttctggaggctgtgatttttccagaataaggtagcctgtgcaactctgccatctgctggcctcagatcctcaaaatcctgaaattggggctgggccttagattgtgaactaagtgtcctcttggctgaaacagctcactattcactcctattttcttctttagatttcaattaaaaggcagctctgctagttattgtgtcttggctggaatggaaagcctttggaatagcagtgttccagtgtgtgaacgtgagtaataggagcaacatttcaggccaatctctccccttcatctgttcactatttgtcctatggcctccctcaatgtgattcttcaatattctagtcttaattatcgatttaaaaatagtttattttaataatgtttggttgtgaatcaatatgtacatcacctgtctttgcaaccatctgatctgtctctgtccttctgcattctctgttctagtgcgataaatcctttggtcttgtgctcctaggtcaggagagattagataatgtgaagctttaacaattttctttctttctctagttttttctttcttttttctcttccttccatccttcagttctttcttcccttcttctctccttctcccctttcttctttccttcctcccttctttctttttcattttgttctcccatcaaagtgcagtcagtctacaatttatatatatatgataatacacaaatattgaacatggctttatttaatcaatatttattgatcacatactttgtgcctgatgttcatctagccactggagttatatcaatgaacaagatggatgaattccctgtccccatgttgtttctacttaggtggggagagggacaagaaaaaaaataaattcaatgctatgagacaatagagcaaagcactgaggaatgaggcaaaaatggggagcaacattagacagggtgagcagtttgagactccttaaattctcaaaacatgtacctaaataatttatgctgagagattcataaataataagtcatttttttaaaatgagcctcatatgttcaataatcagtagactactgatttctcctagtctacccatgtataatttccccaatggaagatagaactttgcttcaattcttgattctaatgattggaaaacgtgtttctttagaaaatcatgaaattttactaaaatgtttatgttgttagaaatatacttggacatcttacagtgatttttagagtaaaattttggaagaacataacttatatagagattcttgctgtctaagaaatccagtgctccttgaagcagtatgacaagtgtctgttctactatcatgaatgaaagctcattaactggactactcaagctttctcttatttttcataactcttgctagttaaaatagtttcttccaaatgccagttctaatgaaaaatgccaattagaaatgaggaagagactgttctaaacaaatcattagatgctagaaaggagtaacaacttgaaacctgacccagagagtaaaaagagaaaataaatcatcaacagacctagacattttcaaaagcaaagccatctgaatccatttggagttttttttttttttttatcatggcctgactatgtttcaattcactgtgacagggctattgttatcactgagattgatgatcaatatcaataagtaatcagtgaaaggtttcacctatttaagatgattagcacacatatatacatttgagaaatatttcctaagaatgtaggctccttcctcagcgctgtgtccccaggatcctgatgaagggctgacacaggataagtgctcaattaatatatattgactaaatgaataaataacccttcaaaatggttatttttcttcttcaaatgttttgctacttcattaaagttgtaaagtttctactgtccaggaactgttactatccggaagattcaggatagacaaatctcttttgtactttgcaatacattttcattgacatctcatttaatccaactcttcaaagtcctaatgtctactgtcatctccttagcatattttcagcaacaccaatcatagcaccctgtaattgcagaatacctctggtgaaactcctgaatgaaacttagagcttttgtatgttttctagaaatcttttgtccaagtcctccagttattcctaatgggagacacacaggaaaacctctggaagtctttccctttggaaaagcagtaaattacacatgcgacccccacccagacagagggacgagcttcgacctcattggagagagcaccatccgctgcacaagtgaccctcaagggaatggggtttggagcagccctgcccctcgctgtggaattctgggttagtgctcatttccccacatccctaatgggttcagaatatctaacccagcccctccatatttccataattacagtgtagtatttatttgtatgtatgcatttgccacaatggaatgccaaaccaatgatagatggttctaaggtaggtcaacacataagatcctgatgacctttgcagatggagggactgatgaaaaaagagggaggcggtgagtggtgggaaagtccttcattagaatcatatgaattaaaaacagatgcctgtgaatctccttattgaaatgtttggtttagaaatctgacctagaaaatcggtggctccttctgccaggaaacgtcttgagttcccgcccatgcttgacagcctctcattggagttttgatgacttgaagtacaaggaaaccagacaggaaaggtggaacctgggcagaaaaactctttctggcttcctaaaaatgtgaaaaattaaatgggagctatctttacattaaattatatgagcattagctgagcgtggtggcaattgcctgtggtcccagctactcgagaggctgagatgggagtatcccttaagcctgggaggcagaggttgcagtgagccaagattgtgccactgcactccagcctgggtgacagagcgagaccctatctcaaaaacaataaaaataggcattaggaggccaaggctggtggatcactagaggtcaggagttccagaccagcccgcaaacacagtgaaactccaactctactaaaaatagaaaaaaaatttaaaaacaaaaataaattatatgagtagaaagaccagatagcaggctagtcttccaaataatatacttccttataagcctatgctaatggaactttcctttctattttacagggaagttttttttttttcataactaaaattttcttttcttctggcatcaaatctaccaaggaagagaaaagaggaaacacactgggtatctttttattaactcaaatattcttgatttcttggtctctaggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtgcgtaaacttgcgttggatctttcccatgtctgcaaaagcttcttatggaattatttcaaatgtgggatatgagaaaccttttctgaaaagtgttcggatagatggatgtaagagtttttcttgtaggcatccttgattgttgcttgaaatgttaacttcatgagaatgtttcaagaaatagttgtagagaaaatcttcattccctatgggaaagaaaataataaatgactagatcaggaaaaaaatggtgtaggaagacaaattctgtttgaataactaggtgggaagaaatcctttgcaaactttgaaatatattgatagtaaataatgccataaatgacctttacattttgataagggatgcaaggtctctacacagatctaaatctagatctagatagatctggagggaaggtctttttgaaagtggggcttagtaggtggctgatcctcagcgctctgatgagttttctcaaggtgccaaaatctgtggaaccatcagagccgcgtgttttcttcaggaagctacatgcaggttgagaccttacgtactgaagagagttcagattactctacctggctccaaaacattttctttcccacaggtaaatcatgtaaaactcctccagatccagtgaatggcatggtgcatgtgatcacagacatccaggttggatccagaatcaactattcttgtactacagggtgagttggcagcaacatctcttggtttaagagttccagcacagcgatagtactttctagccacatctcagcaaggaaactaggctattgccacctgctcttaagaggcttgaacacaggtgttaactcctgattgaaatgaacaaagataggagaagattagggggaaaatctgtatccttgctggaaaccagggcagtgcacatataaagagtatgctgttcactggatgggaaagaaaaaaacttagaagtgtagtagtcaaagcacacaaacaaccctaacccagagtagacattgctggaagaaagggaagaccatgtagcagctgtgtgagagaatgaatcttaatgataacagcatgatcccttgctagggctgccatcaaaaagtacaggccttcctcgttttattgtacttcgcagatgttatgctttttacaaattgaacgcttgtgggaacgctgtgtaagcatgttcgtcggcatcatttatccaacagcgtgtgttgacttcgtgtctctgtgtagcattttgattattctcacagtatcccagatgttttcattattatcatgtctgtgatagtgatctgtcatcagtgatctttgatgttactattgtcattgtttggggtccctacgaactgcacccatataagacagaaaacttaatcaataaatgtgcgtgctttgactgctccatggactagacattccccttctgtctccctctcttcaggactccctaatccctgagacacaataatactaaaatgactccaattaataaccctacaatagcctttaagtgttgacatgaagggaagagtcatgcatctcttactttaaatcaaaagctagagatgattaagcttactgaggaagatacgttgaaaaccaagataggccaaaagccattcctcatgtgccaaacagctagaaagttgtaaaggcaaagtaaaaatacttgaaggaaatttaaaatgctcttccagtgaacacatgtatgataagaaggtaaaacagccttattgctgatatggaagaagttttagtggtctagacataagatcaaactagaaacatttcctgaagccaaagcgtaatcctgagcaaggccgtaactctcttcaattctgtgaaggctgacagaagctggaagctagcagaatttggttcctgaggtttaaggaaagaagccctctccataacataaaggtccaaggtgaagcagccagtgctcatatagaagttgcagcaagttatctagaaaatctagctaagatcactgacgaaggtgttacactaaataacagattttccatgtagacaaaacagccatctattggactttcatagctagagaggagaagccaatacctgggttcaaagcttcaaagaacaggctgactttttaggagctaatgccgctggtgactttgagttgaagccaatgttcaccgaccattctaaaaatcctagggcccttaagcattaagttaaatataccttgcctgtgtctataaatggaagaacaaagcctgatgacagaggtatgtttgcggcatagtttactgaatattttaagcccactgttgagatctagtgctcagaaaaacagattcctttcaaaatattactgctcattgacattgcacctaagcagccaagagctctaatggagaaggacatggagatgaatggagttttcctgcctgctaacaacagcagccattctgcagcccatggctgaaggagtaattttgactttcaagtttcactatttaagaaatacattttgtaaggtgagtccccacagacagtaattcctctgatggatctgaacaaaataagttgaaaactgctggaaagaattcatcattctacataccattaagaacattcgtgattcatgggaagagcttaaaatatcaacattaataggagtttggtagaagttaattccaaccctcatggctgactttgagaggttcaagacttcagcggaggaaataactgaagatgtggtgaaaatcgcaagagaactacaattagaagtggagcctgaagacgtgactgaattgcgacaaattcatgatcaaacttgaacagatgaggagttgcttctcatgaatcagcagagaaagtggtttttttgaggtggagtgtcttcctggtgatgatgacatgagcattgtgaaaatgaccacaaaggatacagaatattacaaaaacttaggtgataaagcagcagcagtatcgggaggattaactccaattttgaaagcagttcagagggtaaaatgttatcaaacagcattgcatgctagaaaaatcttttgtgaaaggaagagtccatcaatacagcaattttattgctgtctcagcttaagaaattgccacagccaccccggccttcagcaaccaccaccctgatcagtcagcagccatcaaccttgaggcaagaccctccaccaacaaaaagattacaaattattgaaggtcagataatctttagtattttttatcaataaacctttttttaaagtatgactttgtttagacataatgctatttcacacttaatagactaccatatagtataaacacaacttttagactcactgagaaatcaaaaaattcatctgactcatttgttgtgatatgtgttttattgtggtggtctggaactgaacctgcaatatatttgaggaatgtctgtaacacgaagtgggcggcttaatacaacagaagtttttggagttccattctagagactggaaatccaaaatcaaggttttgggagggccacgctccctctgaatcctgtagggaaggatccttcattgcatcttccagcttctggagccacaggccttccttggcatgtggcagcagaactccaatttctgtctctgtcctcatatggccatcttccctctgggtctgtgtcctcatatgctgttctctctgtgcatgtctgtttccaaagttttcccttttaataaggacaccagtcacactggattagggcctactttcatgacctcaccttaacttgattgcgtctgcaaagattgtatttccaaataagatcacatccacagggactggaggttaagacttcagcatacttggggggagacacaattcaacctataacagagcccctttgaaaatgtcaggcatcaggtgctcacagcacacggtccagctgttggtgctcacccttgctcagcacacggtggaggctctgcctcaatctcattcttcatgggaacagctaagccaggtagcgaatacgggttatgtttgtgtcaccacaacagacactgaaaggaagtttgtggtgtccagcacacttgccagcataggcctcacagaccacagcacctagaatctgacaaaaattagaataaatccgatgtctccttttctctcttttttttaagcatttttaaatgcaattggtaaatttcctgactgtaccctactcatcttgcattgctgaataagtgaggaacctctctatggcatgaagcagaaaaccattgagcttatgagaagaaacaggaaatacatgtaaaagagaccagtctgaaaaatcaggagaaattttacaaaagagatttactgccaagaaaccagggaaactttcagaacactctccttttcatatttgtaacaagattcaattgtacaaatacttctgtgaaactagccatgaagtgtgtacatgaatgaatatatgtattcagtgtgtttatatatttcatttcatacatgtgatctatatcatatatatatatcacaatgaatattgcagaaaattaaagcaaagagtaagaagagttaaccaaatgttccctgaatgcagtgagaaaagatgaaaaggagaagacaggcaagcacagtggctcacatatgtaatcccaacacactgagaggctgaggcaagagtatcacttgagcccaggagctcaagaccagcctagacaacatgacaaaaacccatctctacaaaaaagtataaaaattagctgggcatggcagcatatgcctgtagtcacagctaggcaggagactaaagtgggaggatcacctgagcccaggaggctgaggcttcagtgagccttgatggcaacctgcactccagcctggatgacagaatgagaccctgtctcaaaaaaggaaaaagagaagacatatgtaacacagtgtcaggattcaaaatacatgtagcaaaaattccagaagggtaagcaaataagcccatacctagccatcactagggaaacttctgtgtttcagggatagagaaaaaaactctgattccagaaataaaatgtgaaaatataatacccgcaaaagaaataagtttattgacaccacattgattctatacaacactaaattgtagaagatagcatttctcttgagccaagctaatattcacacctagaggctccagatacacattaaaggataagaaagacacaaaaattgtaccatttaagtatgtttcccaggtaattcataagcaaatttttaaaaaggagaatgatgaattccaaaggaaatctcaatgagataggatattggtaaaaagaaaaaacaacaataaaaaaatacacacaaaaactcggcaatgtaatcataatttactaataatctctctaaactcatagaacatatcaataaaactagaaaatgtgagacagcaagaaaaggtaggctaaacttacattacagaaaagatgagtagactgactatatagagtttgactctaaaattgagaaaataggtttaaatatctgttgtgtgcatatccatgtgtgtaatatacatgcacatatataaaatgaaattcctcattagaaaaaataataagtttaatttccaaattattagaataactaaaacagctgaatctatctcttccatatagcaagtgagagggaaagaaaaggaaagacaaggaatgcatttgtctcttccaccagaaataagccccctcatttttgggtcaggtcattttattcattgctttctccacatcctcatcattgggcatcatgaaatcaatgaaaaaggcagtgaaagaatgatgatgaaagcaaatcaaatgtatcatttatctcaatacatttggtttaatcctcttgttgaaaaacaaagtctcttagacaagatcaaaagcaacaaatcttgtatttataaaaaacatgtctcaagtaaaatgacatagtattatacacacacacacacacacacacacacacacaaattaagtgaaaatgcaaacaaaaaaaggcaaaaataatatttagagaaagatagaatttaagaaaaaaattgtcaaactggtctacaaaataattgttttattttcgtgccagttgcagtccacagtgaagccaagatattaagaagcaatgtgggccaggagaagttagagcagaaatatctctttcaataatgaaagaataagaaaaagaaatagaagagctggaaacaataggtaaagtttaggctaggccttagacttctcctgcattgtaatccttctggtttgccacatatgcatgctgtcaggaagttgatgaggtatgtacaggacaatgattttccattttttgcctttaggcaccgactcattggtcactcatctgctgaatgtatcctctcaggcaatactgcccattggagcacgaagccgccaatttgtcaacgtgagttgaaatctctttccccattcaccccaccattgaatcctagagttgtcctcctagaattacaaagaatggatctcatccctcttggaaatggtatccttctgatatttgaagaatctagtcatatccttaaaatggctcacagcattccaaacttccgccttcacctagaaatgcttttttttttcttatctcagtctaatgtattttaaactagtctttagctcatttaaccagcccccaatgtcctcttctgttggttgagcacctcgcagtttgaagagcattttgtttagtgaagtcaacaaatacaaagtcagtgaaagaaaccccatatcctctctgcaagctcttagtatcacatcagatattcaagccatgcagctctttcttccttcttattctttgtctaaacaggatcatgccatcttccctgtgagttgtttggaagatgagctttctacattttggggagcaaagacgaatgagcaattgcaagctaacagggaatataaaatgtgtataatcctgggtttagtgatggtgtgaggaaatcagcaatttcaaacccagttggtggcaggataagtgggaacaaactttgtagaaggccaataaactggctgggcactgccctacagtagagtaggacacagtattcagttcttccaagatcagacgagattgggcgcattcagggtggtatggctgtaaatcagtatccagttctttttattacttctgaatctgtaagtatcatgtttattatatgtaatattgtatatttgtgctttgtctttattagttcttccagagcttttgttcttattatttaataaagatgttatactgagccacgtgtggtgactcaaacttgtaatcccagcactttgggaggcctaggtgagcagatggctttagcccaggagtttgagaccagcctgtacaacatggtgaaatcatgtctctacaaaaaatacaaaaactaaacaggcacggtggcacatgcctgtagtcccaactactcgggagactgagaggtgggaggattgcttgagccagagaggtcgaggctgcaatgagccatgatcgtgccactgcactccagcccgggcagcagagccagaccttgtctcaaaaaaaaatgctatgctgtatgctttattatattaatatccaataccataaaggcaaatgccttctatatagagagaactagattaataatggtgagataacatagttaaattctcgtttagcaggagaaataaaaacatagactataggctaggcacagtggctcatgcctgtactcccagcacattaggaggctgaggtgggcagatcacttgaggtcaggagttcgagaccagcctggccaacatggtgaaaccccatctctactaaaaatacaaaagttagccgagtttggtggcgcatgcctgtaatcccagctactcaggaggctgaggcaggaaaatcgcttgaacctgggaggcgggggttgcagtgagctgagatcacgccactgcactccagtgtggggaacagagtgaggatctgttaaaacaaacaaacaaacaaaaaaaaaacacatggactctaataatacatggatacatttagtgaaataaggttaactgagtagagcagcactcataacattttaaaactataagaacatgtctgtacattagcaaatattagatgagaataatattgtcaatatttacttctggtaatttgaaattaaaaaacaaaactgttagcaaaatttacaataaagtataattattagaaaccaggctgggcacggtggctcacgcttataatcccagcactttgaaaggccgaggcaggcggattgtttgaggccaggagttcaagactagcctgcccaacatggccaaaccccatctctactaaaaatacaaaaataaaccagacatggtggtgcatgcctgtgatcccagctactcgggaggttgaggtgggaggattgcttgacctgggaagtagaggttgcagttagccatgattgtgccactgcactccagcctgggtgacagcaagactctgtcccaaggttttgttttggttaacttgctgtctcttttccaggaattccttgtgggctacccccaaccatcgccaatggagatttcattagcaccaacagagagaattttcactatggatcagtggtgacctaccgctgcaatcttggaagcagagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccagagttaccaagctgctccaggggtgagtctgactgatgcctagaagggccctgccagtgacatgtgttgctgttggatcaggagatgagtatttgttaagggggaggtatgtatggtgaggagggtgggaaagtaagttttgggggaagaagcatgaaattaagaattgggggtgtgcatgcacccatgcatatgtgtcttcatttggaaagcaagaccttaattagccaagaaaaaagctattttggactcacctattatttgattctcagggcaaagtaccagctgcaatctctctcaagtatattgaaaaattatatggactttctctatgatcagctatgtgctaagcactttatatgcattttctcattcattatttacaacaacactttgaaattgtgctattgtattatccatttaatagtgacatcagcttgatctttcagaggttaaataaattagctaagtcacatgttctaagcgagacacccaggattttaaaatgcaagtgtatcagaccccagagtctgaatgttttggctcttgccatactttcatcagtatccattgctgaaagaaagagactggcttacaaagacagaaatcatagcctcagaatagacaaagaccttagagtttgtctataatggtctgcctcctacattttattttgattttattttatttaaaaactatttattagagttgatgtcccactctgttgcccaggctgaagtacagtgatacaatcatggctcactgcagcctcagattcctaggctcaagccatccacgtcctacattttatccctaggagtctaagtcaagagtgaaagtaacttgttcaaagtcagttaaatatttctaaattcatgtttaatgaggtatagattaggttgatgttaaaatgggttctgatgccctaagcatgaacgaacaggactataaataaaggcagatgttgagtcaaatactctccaaataatatgccctctcgtgacaaaggactgtcttatttaatggcttgtgtttttgatggctcatcttgtctactgatgccacaatagctggcttagcagctgtgtaggaggtgttatggttgatacatagggacagagaaggagcttacgattcttctaccaacccatgttagccttgtgcaaccactgagctgggaagatgaacagataaagggatataaagacggatgtactgaggcaggagatgggcagggcttgtgttctggtcacaatcctgctgaccaaaacaggctctggcccagacaggatgaagtgaaaaaacagcaggaaccagcagatggcgatgaaagcaattgctagctgccctcatagtcccatcagcaccatgacagtttacaaatgccatggcaacgacctagaagttaccgcccctttcctggaaagttctaaataactcgcccctcaatctgcattgatccactccttaatttacatgtaactgaaatgggtttacagcagtataaacacagttgcctgccaggaacccttatgttgctgactctgggtgtgctgcctgtgagttagccctgctctgcaagaagcagtgcctttcactaacagattgctgtctagcaccactggctcatccttgaattctgtcctggatgaggcaagaacccttccagagtaagccccaatttaggggcatgcctgtcccgaaacagtatgactgtactttagtcattggtgtgcaatcagagaaattgggggaaatctgtaaaacagatttggtctcaggtgacagtctcattacctgaataacaatggtacaaatcgggattaccttcctaggaaatatgtagatggagaatccaccaatactgataacttcacattggatagccagagctaggagaaaatacctcatgccctgtagatttacaagtgaatttggggccttgtgctagggagaattgggttctatttctctacctctgactagctatgaggtcttcaggaagcataggaaattcccccataactaacaagtactctggaactgtcctttccacagtgtgtcagccgcctccagaaatcctgcatggtgagcataccccaagccatcaggacaacttttcacctgggcaggaagtgttctacagctgtgagcctggctatgacctcagaggggctgcgtctctgcactgcacaccccagggagactggagccctgaagccccgagatgtgcaggtgcctcaactctctggcttccagatttctctctttaccccacacatggaggtcttactcctattttttcttttttttttttttcttcttctagtgaaatcctgtgatgacttcttgggtcaactccctcatggccgtgtgctatttccacttaatctccagcttggggcaaaggtgtcctttgtctgtgatgaagggtaagtgtgacccagaattcagatcagggactcagcactgcagagtgactcttgagcttaaggatcaatccaaaaagagggctgacctaggagaagaagaatccagggagattaacctctggaagtgtagctttaaaataaaggtagggactaagtggcactactatcaggagataaagagataaagaaaaaatggcgcatataactgagtgtcaagtacaaacagaaatacagtcaccagtccagaaaaggggaccaacctggtggaaaagaagtactagaggagactaatatctgaaacaatgattggaaagtgtggtatgaaccagctggatccatgaacagaagtttaaaaagcaaaaagctcaactcatttgatttctcacttatagaggctcagaagtaaaatcattttggaaaacgtgcagcttccagtaaggcacaaaggaaaaacaatggccgaaatacaaaagatcttgaaaaaaaaagtgtgtatatatatgtatacatacgtatacatatggacacgtatatgtatacgtatacatgtacatgtgtatacatatgtgtatacatggacacgtatatgtagacgtatacatatggacacgtatatgtagacgtatacatatggacacgtatatgtagacgtatacatatggacacgtatatgtatacgtatacatatggacacgtatatgtatacgtatacatgtacatgtgtatatgtatacgtatacatgtccatatgtatacgtatatgtatacatatgtatatatacatatgtatatacatatatatggaacatatgtatatatacatatgtatatacatatatacatggaacattagatgtatgaataaataataatttgcagacatgaagagataaataaatattctaggggttgttaagaaaagtttgatatataagagaaagttgtatataagataaaataacatgcaaagattatttcacaaaacttttaatcaaataaatagtggaatttggaataggaacgaaagagtaagtagaaatattctaaattccaattacatgtgattgacagctctgccagctattattgctttgtcctcactgaaagctacactttttccaaaatgatttggcttctgagcccgtcaatgagaaactaagtgagttgagtgttttcacctgtgctttagcttgagcagtaaaatgttaattaacttaggaattctcagggaggaggttgagatctgtcacgaagggaagagagaaatggtgcattcatccagccactactgctttgttctttaggtttcgcttaaagggcagttccgttagtcattgtgtcttggttggaatgagaagcctttggaataacagtgttcctgtgtgtgaacgtgagtagatggaatacttgttcagtctggatctttctgtttttttcttaatatagtttgccccatgggattatctattgtttgtcccgctgtttgtgcccgcttttgatagaaattgttctttgttggaatagatacaagcaatgttttggggaaaaataaacatgagaatcatgtgttttgggtaccatcctataaatatttatgaggagagtctgtgctataaatagagagaaatgcttcatagaaataaatgtatggcaagatgctaggctaaatttttctcttctttcctgtcaaaagtaatagtcatacttcaacttttcagttcttccctcaatcatccatttagtcatatactcattctttcaacagaaaattatttgagcacctactatgtgccaagcaatcttctgggaactggggatatacctataaacaagacagataagtccatgtttaagtttttgtgcaaggataaagacaaaaatcaaagacatgaatagaaatgttcaaatgatactaagtgttattaagaaaatgctcttaattgagtcagtgctgtcaattgagaatgtagctgaggacccaaaaggcaagtgtagcccagcaaacctctgggtgtagctgagggttcaaaatgggaggctgttgcagcaatctaatcagagatgttggcccaggatagcaattgggaaaggtgatgatgagaagtgatcaaattctggatatattttgaaggtgcagatgacaggatttggtgatggttagcttagatagagggtgtgaaagaaagagaagaaacatagccagtttccaggtttttggccagagcaaccgccagggtagaatttcccttagctgaaatgcaggggactgcatgaagtttgggaatgggggaaatcaaaagttaagcttgggacataactttagtgttcctcttagatatccagatggatatgttggagagtcccaggctgcccatagatatgtagaagccatcattgtatctgctatgcttgaaatcaggactgaaagagatcttcacctagggagtgagtgctgctagagaacagatgcatggactgagcctggatgtccaggattaagagttgcaaaggtgagaaggaatcagcaaaggggattatgatgaagcagccactgcagtaagagaaaacacaggagggtgaggtgccctggaagccaagtatggaaattattttaagggattagactaatcaactgtgtcaaattctatagagaggtcaaattaggtgagaacagaaaattgatctttgggtttagcaacttggaggtaacaagtggaagtttcagtggagtgctggcaaacactgattggaatgaattctagggagaatgaatgggaggaactgtaacagatcatagacaatattttagaggagttttcatgtaaagagagtagaaataggactatagctgaagagggaaatgacagcaagaggtttgcttttgatttttaagagggcagaaaatagtgtgttaaaaacagaaacactactatgtcccatctatccatttacttcttcactaaatcaatcagggtattgcttccccttctgatcatagctattaaaaatacatgtttacaatagaattttgctcatatgaatactttgccttaaatcatttcaatgtcttgtattgatttatatgatgaaaatgataatttcatcttacattgttggaagtcagctatttgacaatcttaacttccctggaatagttaagaagtatgaaagaaaagaaaaagaaaataccctcatgaacccaacatatacctgaaatcgcttactagagtgtaaacattggttaagctattttaacctttgattagtttatctataattcttttaagctgtaatatcctcttcccaaattcaaagcaaattagaaaagggaaggagtgtccccaaatagaggcattccaaggaataaatgtgtttctttaatgaaaaaaataaataaataaacccttaaaaaccaatgagtatctcaaaaaaccgtaacattcttgagccttttgaaacacatacaggagtacatagcatttttttttcattgtgacagcattactgcaatctttcatctgtattttgaaaatcatagcctggcatcatcaagaaaaattaaatcactgatatacaaataataaatgtataatatattttagaaagatgtctctaggatgaagactcttgatgtcaaagatcatatttatcctgtgctttaaacagtacttgacatacagcagatattcaaaaacatgcttgttgaattaatggatgattcccctttaatgtgactgtgaagatttttatttactttaaaggaatatactctttattattcagaaatattaactatctgaaaaatttaggatgcttaatttgggaaaggcttttgtaataaacattgatttagttgtcatttcatttagctccatcttagcagaggcctaatacatttattttgcagtttctactttccttaagaagaaaagtacgcttaattggcaacacagtcacagtatgacaactgtagaatcaccttggattatactttaaaattttttatggaattgagagctcttgttttctttctagatatcttttgtccaaatcctccagctatccttaatgggagacacacaggaactccctctggagatattccctatggaaaagaaatatcttacacatgtgacccccacccagacagagggatgaccttcaacctcattggggagagcaccatccgctgcacaagtgaccctcatgggaatggggtttggagcagccctgcccctcgctgtgaactttctgttcgtgctggtcagtatccacttccacatatcctaaatgggttcagaatatgtggacccaatccctcatgtttctgtaataagactatggtatttgtttgtgagcttaactttgtcataagtgtaaatgtcaaaattacataccatagctaaaacagatgggtttcagcagcgccaaggtatgtttgaatctataagatgaaaactcttcttgctggtggagtggaagagggtgggaaaaagggactgagggaggggtggagggaaggcagtaaggcacagttatgtaaatcaggaagaaaaatgtattcactggagacgacatgaaaacatctgcctctgaacactaaccagtatctgtataattgacagtctccataagttcatgaggggtacatgggcatgcaaagttcaaaattggaaatgtggatattatttagctaaggttttaaactagtgttctgctgcatgggctaagtaaccaaaaagactctctttgtcttgacttaaagtttgtccacttgtcatcttgcctccaggctgtcttaatctttgtacttgaactgttccactcagggggtaagaagcaaggaaagagtagcccaaagaaaagagtaggaaaaggaagaggctatttcttcctaaggaggggaagaagttgcctggtccttcagggcaaacattaggccttttccagagcagaaactggagtagattagggatgtggcaccagccttggaatattccattatccacagggaagccctgagagacaagagccagccaaggtgaaaagactaaacctgatgaaaggcatttaacctttctttgacctttactctccaactgagtggtacccatcagaatgcagtaaatttttttaatgtaaatgcctagaccccagtgcaggcttaatgaacagatggaggaagccttctccaaaaaggaggtaatggagttcagactctatttgaaaatatgcagcacatggctgggcacagtagctcacacctataatcccagcactttggaggccgaggtgagaggattgtttgaggccaggagttcaagaccaacctggccaacacagcaagctcctaactctacaaaaaataagactgaaaaattgtaaaaactgtaaaacaaaaaaagtaaaaatatgcagcacacaatatactctctcagaaagaagacatagcttcttacagaaggctgatggcttagtctgttttgttctggttctttttttgttttgttttgtgtgtgtgtgtgtgtgtgtgctttttttgagagagagggtcttactcttttgcccaggtggagtagagtggtgcaatcatagtttactgcagccttgacctccctggctcaagcaagcctcccatctcagcctgccaagtaggtgggaccacaggtgcatgccaccacacccagctaattcttgtattttatgtagaccggttttcatcatgttgcccaggctggtcttgaactcctgggctaaagcaatccacctgccttggcctcccaaagtgctgggactacaaggcgtgagccaccatgcccagcctattttgttctatctttaaatgcctggtttagcatcagaagaaaaacactgtattagtttcctagggctgctgtaacaaattaccacaaactaggtggcttaaaacaaaagaaacttattatttcacagttttgtaggctgaaattgagatgttggcagaggtattttcccatcttctaaggctctggaaaataaccaattctttacttcttccatctgctgctggttcctgggattccttggcattccttggtttgtggatgcatcattcaaatccctgcctccatcatagccttttcccctgtgtctctatatgtcaaatccctccactttttccctgatagggacaccagtcattggatttagggcccactctaaataaaagatgatctaatctcaagaacctaatcttaattctatctgaaaaaccattattccaaataagtttctattctgaggttttaggtagagatatcttttgggagaacatcattcaactcactacaaggggtacctgctatgaaaggccagagaggcagcttatgatgggcaccctgagaatggagtatggagagagatgataaaatatgtcttgctactcatgagtgaattagcacaaacacatgaagatttgagtggttaactgaggatataggcactccgataggaggtcagaatgtgaaactacaagctgaagttcttgctttggtgaaataagggaagaaagatcagaaagctgagtggtcttccaaatagtaaaaaaaatcctgctgagtagatgcattgaagagcttcatcccaaggtaacatcaaggagaagaaaatcttttgctattcttgtaagtctctttgtttctgtgatccacctatcagcttaattgaagagaaagaggaggtagggtggaagtctctctgctaactttgatattcctgtggtttttctctccaggtcactgtaaaaccccagagcagtttccatttgccagtcctacgatcccaattaatgactttgagtttccagtcgggacatctttgaattatgaatgccgtcctgggtattttgggaaaatgttctctatctcctgcctagaaaacttggtctggtcaagtgttgaagacaactgtagacgtgagtaacccctccctgggaactacttcatgtctgttaaagcataggtgggaccgggcttggtggctcacgcctgtaatcccatcactttgggaggccaaggctggcagatagcttgaactcaggagttcgcaaccagcctgggcaacatggccaaaccccacgtctacaaacaacaacaacaaaaacaacgtaggtgggatttgattcaatttgctcaaattttggaagcaagatgtctatatttgcccaagatattttgataaaggaaaggatggtcttgtacatcaccccttcttcttgcttgtagttcctgaaccttgactagatgctcatttcatgagaatggctctcacaaaagaattagagagaaaatttacattcactgtagatcatccttgatggctgacaccattaaatgaatgaaacaggggtacaaaagaaatttatgtgagttgcagtgaactgtgcttggctaactaaaaataggggagacatcccaaattttgaggcctttgattttggctggcggaatgagagtacaacactttagccataaatgacttgttttgtttttgttttgtttctgctgttgctgttgtgttttttgtttgtttgtttgtttgtttctgagatggagccttactctgtcacccaggccggagtgtagtggcgcgatcttggctgcaacctcctgggttcgagcaagtctccctgcctcagcctctcgagtaactgggattacaggcacccactcccatgcccagctaatttttgtattttttagtagagatggggttttgccacgttggccaggctggtcttgaactcctgacctcaggtgatctgccggcctcggcctcccaaagtgctaggattacaggcgagagcccatacataacctttattaggaggtgcaagatagtctttttcaaagttgtgttcgtagctacatgattctgaagttgtctgccaagtttcctcaaagcagtcaattccatgaaacaattggaactgtatatgctgtttagtatgccacactccagtctgaaccttacaaaggtaagttgaactctatatttaatcccaaattctgcttcttcccctaggaaaatcatgtggacctccaccagaacccttcaatggaatggtgcatataaacacagatacacagtttggatcaacagttaattattcttgtaatgaagggtgagttgagaataccatctcttgaatatgagttccagaacagcagagccaacttctgacccagtctcagatagacaaactaaactattgctccctttactttaaaagcaagcaataggacttatagatggagatgatacgttggacatagccatatgatcaaaggaatacaaaaaagaaggtacaatatgtattgtattgtaaaccagaggagggcaacatgttcctgtcaaaggtggtacatgtgaaacctggtcaggcattcattggatgaaaaggagcagcttacaaataaggaaaaggaaaaaaggtagttgaaccatgtaaacctccttaactgagatcagtaggtaatacagttgagttggaggaccctgaagcagagtttgggagggtaaacattaattgtaacagcagctctggaagagtatgcatcaaagtgcacacagagaggagacattatggggttcttgctcttgacttctccttgggacaagtagccacaccaaaagccattgcctcaactgagaaggggcttttaaaaactctggagtggacctccatcaaactccagcagacctgcagcagaggggcctgactgttagaagataaactaacaaacataaaggaatagcatcaacattaacaaaaaggacgtccacatgaaaaccccatccaaaggtcaccaacatcaaagaccaatgatagataaatccacgaagatgaggaaaaaccagcacaaaaaggctgaaaattcccgaaaccagaatgcctcttctcctccaaaggatcacaactccttgccagcaagagaacaaaactgggtggagaatgagtgagttggacagattgacagaagtaggcttcagaaggtgggtaataacaaactcctctgagctaaaggagcatgttctaacccaatgcaaggaagcgaagaaccttgaaaaacaggttagaggaattactaactagaataaccagtttagaaaagaacataaatgacctgatggagctgaaaaacacagcacaagaacttcatgaagcatacacaagtatcaatagccgaatcgatcaagtgaaacaaaggatatcagagattgaagatcaacttaatgaaataaagcatgaagacaaaaaaagaatgaaaaggaatgaacaaagcctccaagaaatatgggactatgtgaaaagaccaaacctacgtttgattggtgtacctgaaagtgacggggagaatggaaccaagttggaaaacactcttcaagatattatccaggagaactgccccaacctagcaagacagtccagcattcaaattcaggaaatacagagaacaccacaaagatactccttgagaagagcaaccccaagacacgtaattgtcagattcaccaaggttgaaatgaaggaaaaaaatgttaagggcagccagagagaaaggtcgggttacctacaaagggaagcccatcagactaacagtgaatctctctgcagaaaccctacaagccagaagagagtgggggccaatattcaacattcttaaagaaaagaattttcaacccagaatttcatatctagccaaactaagcttcataagtgaaggagaaataaaatcctttacagacaagcaaatgctgagggattttgtcaccaccagacttgccttacaagggctcctgaaggaagcactaaacatggaaaggaataactggtaccagccactgcaaaaacataccaaattgtaaagaccatcaacaatatgaagaaaccacatcaactaatgggcaaaataacaaatcagcatcataatgacaggatcaaatttacacataacaattctaacattaaatgtaaattggctaaatgcccccagttaaaagacactgactggcaaattggataaagagtcaagacccattggtgtgctgtattcaggagacccatctcatgtgcaaagacacacataggcgcaaaataaagggatggaggaatatttaccaagcaaatggaaagcaaataaaagcaggggttacagtcctagtctctgataaaacatactttaaaccaacgaagatcaaaagagacaagagcattacataatggcaaaggatgcaacaagaagagctaactatcctaaatatatatgcacccaatacaggagcacccagattcataaagcaagttctgaaagatctataaagagacttagattcccacacaataatagtgggagactttaacaccccactgtcagtattagacaggtcaacgagacagaaaattaacaaggatattcaggacctgaactcagctctggaccaagcagacctaatagacatctatagaactctccaccccaaatcagcagaatatacattcttctcagcaccacatagcaattattctaaaattgaccacataattggaagtaaagcactcctcaaaatgcaaaagaatggaaatcataacaaacagtctctcagaccacagtacaatcaaattagaactcaggattaagaaactctctcaaaactgcacaactacatggaaactgaacagcctgctctgaatgactactgggtaaataacgaaatgaaagcagaaataagtaagttctttgaaaccgatgaaaacaaagacacaatgtaccagaatctctgggacacagccaaagagtgtttagagcactaaatttatagcactaaatgcccacaggagaaagcagaaaagatctaaaatcgacgccctgacatcgcaattaaagaactagagaagcaagagcaaacaaattcaaaagctagcagaagagaagaaataactaagatcagagcagaactgaaggagatagagaaacaaaaaacccttcaaaaaatcaatgaatccaggagctggttttttgaaaagattaacaaaatagaccactagccagactaataaagaaaaagagagaagaatcaaatagacacaataaaaaatgataaaggggatatcaccactgatcccacagaaatacaaactaccatcagagaatactataaacacctctacgcaaataaactagaaaatctagaagaaatggataaattcctggatacatacaacctcccaagactaaaacaggaagaagtcgaatccctgaataggccaaaaacaagttctgaaattgaggaagtaattaatagcctaccaaccaaaaaaagcccaggaacagatggattcatagctgaatcctaccagaggtacaaagaggagctggtaccattccttctaaactattccaaacaatagaaaaagagggactcctccctaactcattttatgaggccagcatcatcctgataccaaaacctggcagagacacaataaaaaaggaaaatttcaggccaatatccctgatgaacattgatgcaaaaatcctcaataaaatactggcaaacaaaattcagcagcacatcaaaaagcttatccacaacgatcaagctggcttcatccctgagatacaaggctggttcaacatacgcaaatcaataaacgtaatccatcacattaacagaaccaatgataaaaaccacatgattatctcaatagatgcagacaagggcttcgataaaattcaacagcccttcatgctaaaaactctcaataaactaggtattgatggaatatgtcccaaaataataggagctatttataacaaacccaccactaatatcatactgaatgggcaaatgctggaagcatgcgctttgaaaaccagcacaagacaaggatgccctctctcaccactcctattcaacatagtattggaagctctggccagggcaatcaggcaagagaaaggaataaagggtattcaaataggaagagaggaagtcaaattgtctctgtttgcatatgacatgactgtatatttagaaaaccccattatctcagcttaaaatatccgtaatctgataagcaacttcagcaaagtctcaggatacaaaatcaatgcaaaaatcacaagcattcctatacaccaataatagacaaacagcgagccaaatcatgagtgaactcccattctaaattcctgcaaagtgaataaactaccttggaatacaacttacaagggaagtgaaggacatcttcaaggagaactacaaaccactgctcaaggaagtaagcgaggacacaaacaaatgaaaaaaacatttcacgattgtggataggaagaatcaatatcatgaaaatggccatactgcccaaggtaatttatacagtcaatgctatccccatcaaattaccaatggctttcttcacagaattacaaaaaaaaaaaaaaaaaaactactttaaacttcatatggaaccaaaaaatagcccatatagccaagacaatcctaagcaaaaagaacaaagctggaggcaccacgctacatgacttcaaactatactataaggctacagtaagcaaaacagcatcgtactggtaccaaaacagatatatagaccaatggaacagaacagaggcctcagaaataatgccacacatctacaaccatctgatctttgatgaacctgacaaaaacaagcaatggggaaaggattccctatttaataaatggtgttgggaaaactggctagccagatgcagaaaactgaagctggaccccttcctttacatcttatacaaaaactaactcaagatgtattaaagacttaaatgtaagacctaaaactataaaaaccctagaagaaaacctaggcaataccattcaggacataggcatgggcaaagacttcattactaaaacaccaaaagcaatggtaacaaaaaccaaaattgacaaatgggatctaatgaaactaaagagcttctgcacagcaagagaaactatcatcagagtgaacagacaacctacagaatgggagaaaatttttgcaatccatccatatgacaaaggactaatatccagaatctacaaggaacttaaacaaatttacaagaaaaaacaaccctatcgaaaagagggcaaaggatatgaacagacatttctcaaaagaagacatttatgcagccaacaaacatgaaaaaaagctcatcatcactggtcattagagaaatgcaaatcaaaaccacattgagataccatcttgggccagttagaatggcaatcactaaaaagtcaggaaacaacagatgctggagaggatgtggagaaatagaaatgcttttacactgttggtgggagtgtaaattcgttcaaccattgtggatgacagtgtggtgattcctcaaggatctagaaccagaaataccatttgacccagcaatcccattactgagtatatacccaaaggattataaatcatccttctataaagacacatgcacacgtatgtttattgcagcactgttcacaatagcaaagacttggaaccaacccaaatgcccatcaatgatagactggataaagaaaatgtggcacatatacaccatggaatactatgcagccataaaaaaggatgagttcatgtcctttgcagggacatttatgaagctagaaaccatcattctcagcaaactaacacaagaacagaaaaccaaccaccgcatgttctcattcctaagtgggagttgaacaatgagaacacatggacacaccgaggggaacatcacacagtggggcccgtcagagggtaggagtccaggggagggatagcattaggagaaatagccaatgtagatgatgggttgatggtgcagcaaaccaccatgacatgtgtatacctatgtaacaaacctgcacgtcctgcacatgtatcccagaatttaaagtatgataataaaaaaaagactgtgtactcatttttggttgccatgataaattcagagaggaaaaacatgatatatattaaattttactgcaacaactaactgccccttgtcatcagcctattctgtcactagagtgagtcagtattcctcttttctgactgtctgagcctggacgatttaaactgcttttcacacaacctcttgcccaaccttttctcacctcccattgtgaatgaacatagatttccctatggtaaacaaaacaaaatatcaccaaatctaaggcaagataaagaaattgaagataaaagaaaccaacccaagagatcagagaaatattcatctgcacaacagcttcctccaataaacaggggacaatctttaaaaatctctcatatgtgtttgtaacatagaatcgatggaactatatgaggcatttataagatttaatgatctgatatcagaaaagttgagatttgaatgaaacacatgggagtcggaaaaggagtgatgactggtagattggagcctgcccccaacccccggaaaaaaaaaaaaaaaacaccaaagggataatgaagacaagattgaattctccagaattcatcaaggaccagacttgaaatgacacatatatacacacaaacacactacacacaaacacacagggatataatatagaaattccagaaaaaataaaagaaagcagaatgaatagaagcattaattagcacataatggaagacaatttctcaggctataaagaaaaatactaagttgatccttgaaggcttactagacaaatcaagattaacaacaatgggccccggccctacatggaagaaaattatgccatccaaatataaaaaaatactgccactctccagaaataacaaaaaagaagaaattcatcttagcaccaagcttccgttctgtaacactaagtagtagaagttagtgtttgagaggaaatattgtacaataaaatttctgtactcggccaagctgccattcatctgcaaggcacagatgcatcgtcttaaataagaaggaaccccaaacatacaccagttagatatactgcctacaaaaagaaaaactcccacaaagctgtgggagtttttctttttgaagaagaaatcaaaattccaaatggtgttgtatcaaagaaatattaatgaggcacaaaactagttaaatggggtcactaaaactgttttatttaatatggaaataaaatatcaaagcaggactaattcttgaaagataattcatgtaatatgaaaagaagaagaaacttgatataaaaaatagattttatcacttcagctaggaagttagagatgaagtaagaaaaaccatcataaacttatcatatgtaggggacacatattcttgacataaaaaataaggagaaaatggtacttcacaccagtataaaatctatatatctatatctatatatatctatatctatatctatatatatatatataatcaaattttaaaagataatcagaagggcgaaaccacttggtccataaaacaaaagaggggtgagagaaacaagagctagcaagctttctgtctctcttttgggaaactagcattattacgttaaagtgaattaatacatgtattttaatgcctcagtttttctttctaatataataaatattaacagatataaactccattggtaaaatcactttgaggtccttaatacttcttaaagtggccgggcgctgtggctcatgcctgtaatcccagcactttgggaggctgaggcgggcagaacacctgaggtcgggagttcaagaccagcctggccaacatggagaaaccctgtctctactaaaaaatacaaaattagccaggtgtggtggcgcatgcctgtaatcccagctactcgggaggctgaggcaggagaatcacttgaacccgggaggcggaggttgcagtgagccgagatggtgccactgcaccccagcctgggcaacaagagcgaaactctgtctcaaaaaataataataataataataacaataacaataacaaaaatgtttaagagtgaaaagaattcttgagaccaaaaaagtttaagaactagggcttgatgatgttcaagcaaagataggaaaaggctattgcaagtacggtacaaagcacagggggaaggtttcataagtatatatataatatatatataatataacataaaattcatatatattataaaaataataaatatgatataaatttgatataaaatattatataaatctgatttttaacatattttgattttatactggtgtaaagtactattttctctttattttttacatcaagaatatgtatcccctacatagtataagtttatcatagtttttcttacttcattcctaacttcctagttgtagtgataaaatctattattttatatcaataaaaatattgatataaattttatttacatgatatacaatatttaaatataacatattttatattacaaaatatactactatgtattacaaaaaaaaaaacaaactccatttagcagagcaagaatggagtttgttttgtacagtgctgagttccaacccatagaattgttaaataaataaaaaggaaagaacactataagatcaaactcatcagttataatagtaaatgtgaatgattccaatccccccttttgaaagacaaaggcttctaaatatggtcagaatcctatttacagtagcaccaaaaagaataaaatacttaggaatcaatttaatcaaggaggcacaagacctgtgcactgaaaactcagtaactgaaaatgagcaaatgatgtgatagacatgtctccaagggaaatatacaaatgcccaataaacacatcaaaagatgttcaacatcattagtcattagggaagtgcaagtcaacctgactttgtactaggatgttttgtattaggatggttataatatttttaaaaaataggaaataaaaggtgttggcgaggatgtggagaaattagaacgcttatacattgctggtggaaatgtaaaatggtgtagcactgtggaaaacagtttgatgattcctgaaaaagttaaacatagaattaccatataaccagcaattctgctcctaggcatatacctaaagaaattgaaaacaaggactgaagcagatgctcaaataccaatgtccgtagcagctttgttcaaaatagccaaaaggtagaaacaacccaagtatctacgagcagatgaatggataaatgaaatggagcttatccattccatggaatattcttcagctatacaaaggaatagagttctgatacatgctacaagatgcataaactttaaaaacattatgctaagtgaaatgagccagacacaaaaggataaatactgtattccacttttatgaggtgccaaaaataagaaaatttattggactaaaaatagattagagataaccagtggaaggagagaatagggagttacaactcaatacatccagtttctcattgggatggtgaaaatttttggaactaagcagtgataatggttgtataatgttgtgaatgtcattgatgccactgaattatacccttaaaatggttttaatggcaaattttatgttgtatctcttttaaaacaataagaaagaaaaaaatttttaaatatatcatgtgatattaggaaagaaaaaaacagataacagtataagaaaaataagaatttaaaacatatcaaataagatttaaaaattttgtttaagatattgatacttggtccagtgcacaataaagacaagaacttttttttttttcttttgagatggagtctcgctctgtcaccaggctggagtgcagtggcactatctcggttcactgcaacctccgcctccagggttcaagccattatcctgcctcagcctgccgagtagctgggactacaggcatgcgccaccacgctgagctcatttctgtatttatagtagagacagggtttcaccatgttggccaggatggtcttgatctcttgacctcgtgatctgcctgcctcggcctcccaaagtgctgggattacaggtgggagccaccgcgcctggcctgaagacaagaacttttgaacaagagagcgctaactaacgtattgaaatacataaaacaaatactgatatatagaagagctcattcagctgtttcaaagacagagctctgtaacacatgtactcttacctaaagaactgtctcccaccactggaaaggaggtcttctctgaccaaatacacagcatcttggagttggccagcattaacttggatcatctggctggccaggaaaggagtgctcagggagaaagaggatggtcaccatcccaaccagattggccattagatctatgtatcaacagagtgacatacgggagaattaaaattctagtatgcaaaaatacaccgtatgttaacagaaaatagactgcagggaaatttgtattaggtaaaaccgagagaaagttaagagcatacaacagtagataagcaatagacaacccgatataaaaatgaggaaagaatatgcacaggcaattcacaaaaggaaacataaaaatggccttaaaaattgctaaaataaatatttaagcaaaaaagctcaacttcactatggtttggggaaatgcaaattaaagcaacaatatgtcatgttttcacagtcacattaataaaagtttaaaagacggaagtagaggtaaataggaatttgaggaaaaggagccctctcatagtggttcattggaatgtgaattgctgcagctttcaaaaaaaaatcttacactatccacaaacaatgaaagcatagatatcttcttagctactaatcccactcctaggaaaaggagtattaattacaataggttctttattgcagtattgtttatataagcaaaaagagcaaacaaccttgacatccttctattagcagtaggttgaataaatcataagacgtctactatgaactattttgcagcaatcaagaagacttaattagatctctgtttagtgatttgaatgggtgaccatgttgtgatgtcaacagaaaaaaataatttgcagaaaagcatatagagtttgttctcaatttggaaaaataatgacaaatttggaggagatatcctatacacatatgtgtgtttgattgggtttggaaaaatcaggaccacctgagatggaggtgggagtgacaaaatatacatggtatactaagtgaatatataggttatacaattacgttgttaaatttctgaaaacaagtgcaacttaagcatataactaaggagtagatgttaacctggacaaatgaaacatagattgttttgagcaagagacggcaaaattttttgtcaagagccagatagcaaaattttcaattttgcagaccatgcaatctctattgcaattactcagttctgccattgcagtggaaaaatagccctagacaaatgaatgtgtgattgtattttgataaaacttcatttacaaatacgtgctatagaacaaatttggcctgtgagccatagggtgacaatctccggttagatgaagggattgagagcattatttttcttcaattcttgtcattatgcaaagtcagagaattttctaaaataaataaaaatacaaattggcaaaataataatagttgaaaacttcagattgggcaaataagtgaacaaataatcacatgttgaggaataaggctgctttgattcttgtgtgttcaactttgaaacctttatcacagttataaaaaccatttataaaagtgatataactccacagagtatacctcaataaatttgcacatagaagaaatcaaaatgggtatattttctcatcgcaatacaccaaaaactaggaattaataagcaaatgatacattaaaaattcaaagttttagaaaacggagtaccttagatcttgatcaaagagaaatttaaaaacagccattgcagattacctggagaataacaatcgctaatgatcctcaagtgcatgtgcctcaagcattcttctaagtcctttacttgaattgatttacttagtctttaaaagaccctttgaaatggatatcatgcatatccctcattgtatagaagagaaaactgagacagacaggttaactaatttgtccaaattcatgtgacaggttgaggttagaattagaatatcgccagtcagcttcaacaacctgtaatggtaagccttacattatttatcttcttaattaggaatgctgaaacatatattactcataaaaatttctggggtgctgatgccaaaactgtcctcagagaaatttttcaatcctttttgttacttgacaggaaaaaattcaaataaatgaacaaaacatttcttaacaatttttaaattattaaaaacatatataaaaggctgctggagtaaggaattaataaagtaatgaacaaagaaaaaatcatagaaattataaagaaatctaaaagcagattctttaaagtgaccaattataaaacaaacagactgggtcaattgtcatttcacaaaataacaattctataaatatacaagaatgagaaagaagacataagcctgttgatattgaagagatttaatacttgataaaaatattatatcttctctattctaataaaattaaaactatccatgaaatgtaccatgtcagaagaaaaatacaatttaccaggtgtagtttaaaataggcagaattgctgataaacccatatctgtttgagtccatattttcaattcttttaggtatatacccagaagtggaattcctgggggatatggtaattctgtttaacttttcaaagaattgccagactattttccacagctgctgtaccattttacatccccatcagcaatgcacaaatgttccaatttctctacatcctcaccaacacttgtcatttttctggtttaaaaaaaattattattataccaccctaaaaggggctgaagtcagtttgatttacattttcctaatgactaatgatgtggagcatcttttcttgtgtttattggccatttgtatgtcttttttggaaaaatgtctattctcatcctttgtccatttcgtaattgggttgtttgtttcattgttattgagttacaggagtcctttatatgttctaagtattaaatccttatcagatagggttttcacatattttctatcattctgtgggttgtctttttaatctcttggtggtatcttttgttcttgacttggactgcaggacacttcagttcctcactacatgggcttctccaaaggacagctggcctctcccagaatgagcatctcaaaaagagaagaaaacattgcagtgctttttgtggttagcctctgaagttgcacactatatcatttccactttattctaatcattagaatcaagtcacaaagcacagcccacattcaaaaagagaggaattgggctccatcacttgaagggacatgtataaaataatttgtggacatatttaaaaccaccacaaagaagcacctttaaaaaaagacaatggcccagttttgtaactcttttttaacttcaagaaatagataatccaagtattaatattatttaaactgttatggaacatagaaataaaattatagccataattaaagtttgccaaagattacaaatgaaaataaaataaaatatatctctggctcatttgctaatataaatactaaaaatcttaaattgactattaaataaaaccaatattaaaagaattatgcaaggggaacaagtaaggttattccagaaatggttccaaattaggaaacccacaaacttacaatattaaagagtacaacttttcttaaatgtcatataaatatactctctaatgccaaaaaacacaatgaatggttaaaatctaaaagcatgcttgaatataattaaagttcaaaggaaaagaacactcggcatccttcctattattcaaagtagttgtggaaattcaaaccagtaaaatgacagccccctgtatttagagagatatacatatagatatagatagagagagagagaaggcaaatttattattaactgatggttgtttacctgaaaacccgaaggaattatttgaaaggttattagaataggaaatggtagtgagatatcgagtaaaaaataaatacttataaattaattactttctttatgtaggtaacaaccaaatagaatataaggaggaaaaataccattcacaacagaaacaaaatcatctagaaagaaatttaacaggaaatatataggacttataagcagaagatttaaaagagggggacatagaaaaatacttcaagaaatggaagatataatattttatttaaaagatttaatgttgtggtgatgttaattatccctgaattagtatgcaaatttaatgtaatcagtttcaatgacattcttttttttaatttgacaagatgtctgtaaatgtcatgagacccaccaacagaatattctgagataataacaagaagggtgtttgataccagatcagaggtgggtttgatacccacctctcagtgtctggtaaccacctttctactctctacttctacgagttcaactattttagatttcacatgtaagaaagatcatgcggtattagttcttctgtccctagcttattttggaaggtattttaaggcacaaatatgttgtagtgtaattatgttgtaatttttcctgacctgatgtcccacgtctgtaaaattcttttattgaagcctaggctctttccctaggactccctgtctggaatcataaatatcttacttctgtacttaacagaattgttctgtctgcatatagtccccactttttctccaagtagtttctcaaacaaatgcacttcctttcctgaaaagatgagtaagattttaacagctttaaatctttatatatagatatattttaagccaaacgactacactgtacatggttttatagccctctttaatacttacgaactatattgtataattattctaattattatatattactctacaacaccatttttagtggttgcattttggttattacttggatagtccataacctacctaacaaagtccttaatgtctggaattaaagtggtttcgcatttcaactgttagcaaaaacactacaatgcacgatcctgcacacgtgaaaagaaatgagatgaggacttcactaacttcaaagacagcttaaggattcagatcttcacatgtacacaagagacaagatttgcagatttgagtgaaaggctatgcacgattttaagcctttcagtacatattgccaaagtgccctccactaaactttgaccatgacctacggagtgagtcacaacagtgactctttctttgagtttatattactgctaggttttgtcaatttgccaatctaatgggcaaaaacggcattttatttgcattttaaagtgtatttatcatgtttataaggaagctaaacttttcatatgttcatttgactatttccatttttcgtttgtaaattatttgttcataattctttaccatttttctacttgggtgtttgcctttttataattgatgtataagagttgtttttattatttttcctctgtggtttgtcttcaaatttgtatgtagaaaggtttatttgtaattattcagttttatcagttttgttcatagtagaatttttcctcaatgtatgtctatagaagcctcaaatcagaaacacgtttgcctaaatcacctagttcttttatggttttatttttgacatttaatctttgatacacacggattttgctttgatgaatgtcatgaggcagagatctagcttagcttttcagatatttgccctatcaatgaataattcagttttccgtgtcttgaaatgccatctttatcactgccaatttcttacaaaaacttgtatctatttcttgggctttcccccattttgctctagggatctgtgtctctattcctgcatcatttcaattattttacattttaaatgcattttaacatcccttctgtttttgtgccttaaaataccttccaaaataagctaggcacagaaaaactaatgccacatgatcttacttccatgtgaaatctaaaacagttgaactcatagaagtagagagtagaaaggtggttaccaggcactgagaggtggggagctgagatttggtcaaagggcgcagggtttcagttagacaggaggagtaagtttcagagatctattccacagcatggtgactatagttaataataatgtgtatttccaaattgctggccgggcacagtgtctcatgcctatagctctttgggaggctgaggcatacgaattgcttaagcctagaagttagaaactaggctgggcaaaatggcaaaaccctgtctctaccaataaatacaaaaattagccaggcatggcagcgcatacctgtagtcccagctactcgggaggctaaggtgggagaatggtttgaacctgggaggcagaggttgcagtaagccaagatcacatcactgcactccagcctgggtgatagatccagaccctgtcaaaaaaaaaaaaaagaaagaaagaaaagaaaaagaaagggaaaaaaaattgctagaagagtagattttaaatattctcaccacacacacacacacacacacacacacacacacaaaacaaatatgagaggtgacggacatgttaattagcttaatttaatcatttgcaacagaaacatatatcaaaacaccacattttaccctataaatatatacaattattgtttgttcataaaaataaaatcagattttaaaaaatattcactgtgtttttttcagccatacataggctggaaccttcttcacattttggctccaacaatctagcttagtcacagcgagcacatctaaaacaacctctaggaggccaaaagtcagaggactcccatgatcctgtgctcttagacaacttttaaatgtatgataggagacaggcagaggaaaacacaggtaataatgggattatccttttctttcctttctccagtggttctcaacttgtttaattgcagcaatttttaagattttttttcttggcacacttgaaaagattgtataccatagcctaaacaggctagcaataagtaaaattcaatcagtacctaaaacgtaaaagagactcactgtgtctacaaaaacattgacggtcattgccatagtcacacagttccctttagctttctgtcactgtttcgggaagagctggtatatcagttaggatttccagctgtaaaagacagaagaaataaaataacaggatctcaaacatagatagtagtttacttctgtctcaggttaaaaatcacgaaagtaggcagtccagggtttatacgatgactccataatccacagaaacctgggttccttccactttgctactctgacctcttcaaaatgagagcccatcttatctcatggtctaaactccagccagtatagaggacacagggaagaagggaaggccaattcctttaaagacactttccagaagttgcacaagacactccacttacatcctctggccagaagttagtaacatggctatgcccggctgtaaggaaaggtgagaagtgaaacctttattgcaggtggccaatggcccagttaaaaatagagggttccattactaatgaaggagaggaaagtggatactagggatggcaccagtagtctttgctacaaatggttactgccctgatcacatttcttacataatcaagaggaaaagttcttaactgttgcagttactgcctcatcattatatggcattccattttaccctttaatttttacttggtcaagtttaggcctgctgtacaccagaacacatgaatagctttgctcagcattctttgtgacgttgctcacagtaacattatggatacctaataaattttttaaaagacaaaatgttctacgttttgtggcctactctggatggctttaaggtaaagtgggtgagtatccctaccctttacatttcaagtgtaggggtgtttagctgtctcttctggctctcatttactgactcttctgggtaaatccattgttctttcttttatacaagagactatctgagcacccaaaacttgaaagtctctaagctaggtgctatagtgttaaatatttcagtaagatattttccctgcttaatccaggagcttgtcatttccttgctggaagtacacatggataaaataactgcaaggtttctgaaagacttaagtacaaaaatgtcctgcaaagaaaaagggaaatatctcattcagttgtgagggattaggaataaaaatgaattggagaggtcaaaatgtaagcttgtcctcaaaaagaaaggactaatttgcagatggagatggggtttcttccttccgaggtctgccatggtgtaatctgtcctgtaatgtctaatgtctacctgctattattttctaaatggtgagttaaatgggaaatatgtgtagcgtataaccattttctatcctttgctttaggtttcgactcattggttccccatctactacttgtctcgtctcaggcaataatgtcacatgggataagaaggcacctatttgtgagagtaagttgaaatacttttctccacaaattcctctgtgtgatcctgacttgcccctggagtacaaagaataaattgaatccttcttgcacaaagtagtctctcagatatttgaaaataggagtcagatgcttcatggtcttcctggcttttctttatcttaaaaggtgatttatctgaaactgtgggcttgaacctaggcaaaataccctactttcccattataatagtaaatatttccagtatagagagtgttgtccttaatgagtacattttaaaggcgttagacaaaattagatctgtctttgccaactcttactatctatcaggttacaattccacaaagtaggctactcactttcttgttattctaatccaaataataaaaagaactcttcttccagttcttagcaattttcctaagcctctgatcattttgagttctaatcctccttcaattcttttaggcccatgtcttcagttgtatttgttctcgattagctgaccctccatttttcccataagatatttttcaatgaatctccaaaactttaaaaccatggaagaatgattgcaaattggcaaagtgttatagctgtgaagaagtcgtcatcgcacacagagttgatggcagcaaaagtaggcacagacttccagaaagctaatgaccaatataaacaaaagtaaagtaaataccctctgactgacaattccatttcccagaatttagcccaagaaaataatcatgaaatagtcccatgattttggtccagagatactcaatgcaataatatttgtgatagtggaaaatgttaaacaacctaaatgttcagcatggtttgaaaatagctagtagaagaaataaggcatattttaatggctatcagtttttcggaaaggtaaaaaagtgcaccaggaggaattaaaggttgagatgcctcatccaagtggaaaaagtacatctatgtagctacatgactgattattattcagccaccaaatatggtagtatagaaaatatatccatccatacatatgcatgtatccacatatgtatctaagaggatataattaaattgttacaaatagttatctttgaaccattttcactttcttctttctctttgtccatattttataaatttcctacaatgaatgtgttcattgtagtcactaatattcttcccccccaaattaacattgacttttaaacattaaatgaatgagaatgtatacaaggtgcctcccatatctgccaagaacttgaaattctatgaaataattcaaattatcaaagaattatcagtttactatacaaagttttcaaggcatggcaccttttgtagggggttatcttttataaaaaaatttccacttctacatttataggtcagtgatcatttaattgagtcaatactggttatgtgtgtatatgtgtgtagtcacttagccaatatgtgaatattattatcttatgatagaacacagtattcatttatcattttattgcccttaaatctgccattatttcatttctcatgccttatcttttgtgtttccttttctctctttttcttcataaataatgccagaagtggtatatttaaactgcaaagaggttattttaataacctataggaaaaaatagtccagcaatagataagtaccttaacaatctgtgataaaatcacatgtattatccacttaaaattataaatatataaacccaaaaaaacatggattttttttgtgaaatatgagcagaacccatatcatacacacctaaatttcaactaggtaaaaatgtctgattattagcaaatattttaagaaaataacagtattgtaattccatttagaaaatcattggattatttgcatttggtatttaaattcatagtaaaataattcattattaaaaaataagctgttttaccatactcttccttctctcagtcatatcttgtgagccacctccaaccatatccaatggagacttctacagcaacaatagaacatcttttcacaatggaacggtggtaacttaccagtgccacactggaccagatggagaacagctgtttgagcttgtgggagaacggtcaatatattgcaccagcaaagatgatcaagttggtgtttggagcagccctccccctcggtgtatttctactaataaatgcacagctccagaagttgaaaatgcaattagagtaccaggaaacaggagtttctttaccctcactgagatcatcagatttagatgtcagcccgggtttgtcatggtagggtcccacactgtgcagtgccagaccaatggcagatgggggcccaagctgccacactgctccaggggtgagtgtgacccatcaagactttgctgggtgtgagggtacgtatagatgataggagttgttgaaattaaggaagaagtgtataaggactatgaaattggcataaacataatagtagcttcactgtctgttatctctgttaataattgtctcaaagtaatggcttattctctcatctatagtagacatattttagatgcatttttgaatttaacatttacagcaaatatatgaagtagctactattggtatccccattttactttgagagaactgagtcttagtgatattaaagaacttttccaaggctctgactccagagcctaatcataatgtacagtggaatgtatcatgaacaataatgtgtaatagtgatgatcgtatctctatccctggagtggggcagtaggcaagtgagccatgaggaccaaaatgagagcatcaaatcaaaaaggccttggacttcaacttcaactttttctcattataattgaaaagactgaagctcagaaaaagtgttttgctcaaatccaaacaaatatatatatatgtatatacacacacacacatatatacttgatatataattatatattgttcagattgaggctcaaattcattctttgaggttttttgattgtttgtttgtttgtatgtttgtttgagagaaggtctcgctctgttgcccaggctggagtacagttgtacaatcatagttcactgaagcctctaactcctgggctcaagtaagacctctgcctcagtctcacaggtagctggaactccaggtgctcactaccacacctggctaatttttatttatttttagagacagagtcttgctatgttgcccaggctgatcttgagctcccgtcctcaagcaatcctcctgcctcagcctcccaaagtactgggatttcaggcctgagccaccatgcctagtttcaaatgcattctgatgccctgagaacacaccaattgtcctgtggatggaggcagccaacatttcggttaaaatacggtctaagcaatatgttctatcactaaaaagtctgtagcttttttttctttgagggggggttgttctttttgtttatttttaatttattaatctttaatttttgtgggtacatagtaggtgtatatatttatgggtatatgaaatgttttgatacaggcatgcaatgtaaaataatcatggagaatgaggtatccatgcccttaagcatttatcctttgtgttacaaataatccaattacactctttcatttttaaatgtacaattaagttattactaactatagtcaccctgtcatgctatcaaatactacatcttattcattctttctttttttttttgtacccattaactgtccccacctcccctccctaccctcaccccctatccccacgattttgttcttgatgcctcctcttttcttagctgaaatgactggcttaaaacatggagtgggaagaattaggactggtcacagggacagaaaggaagctaacagttcagccctgtgctgactgaaagagggtcagggagtgtggaaaatgaagaatacgtgaaggtgtctgttagatgagaccttggcaacagtactccttgctgttgccttacgcatgagcttgagggactgcctctgtaggaagtggaagagtggccaaaccacccgcactcacgactctgtgctccataaccagtagttgaaagcaagaggaatatgctgccttatagtctttggaacatgtttcagtagaaaaaacacagacaaggtgttggagagactttgattctagtcacagttctgcttggtttccttagcttccttgttagtgagatgtggctactgaactaccaatcttctcttttaatagctgcactctgcaatgacgatttttaagccctctggtaagcataagatataacaaaggaaattgccccatatctaacaagtgctctggaactgtcctttccacagtgtgtcagccgcctccagaaatcctgcatggtgagcataccctaagccatcaggacaacttttcacctgggcaggaagtgttctacagctgtgagcccagctatgacctcagaggggctgcgtctctgcactgcacgccccagggagactggagccctgaagcccctagatgtacaggtgccttgactctctggcttccagattgctctgttttccccttcacatggaggacttactcctgttgttttattttttcttctagtgaaatcctgtgatgacttcctgggccaactccctcatggccgtgtgctacttccacttaatctccagcttggggcaaaggtgtcctttgtttgcgatgaagggtgagtgtgacccagcgttgagaccaaggactcagtgtggagaatcactctcttgagatcaggggttaatccaattaaggagctgacctagtagataagaagtacccagagagattaatttatggaagggtagttttgaaataagggtagggactaagtggcaccactttcagaaggcaatgagaaaatggcacatacagctcaatgtcaggtacaaacctaaatacagtcactgatcttgagtacacagttggaacttgaaatgaatgggtacgtatttatttggaggcaaaagaacataattttataagaggtatgctagaaaataaatgatgaataagacaaaaattgtttgccccataagaagtaaggtagaggttgtcttaagaaacttaaaaccaatcaatagtggaatctgtaatagtgcatggataagtgtgttttaacccaataatatatcttcaggtcaggaatggccagtgtaattcttttaatgcaggatttttctcagccactttgccagccagtgacttctggacagcaatgcccctgcccaggccttgcttgggcccaggctcaccgcaggaaacaccccagatacttagcccactgggcggcgtctggctggtgctctgactgggaccctggggccaccatgactgcacactcagcccctggtgggaggggatgtgtgagtgagtgagtgtggggtccagctggccactccaagcacctgcacaggaatgggctctgagcagtgctggcggctggaccaggcatgtcgcactgaagggaacgtggtggtgcccaaacaggggtgcccatgaccccaaagcccagaggaggtgttacagcacactaatggctcttagcatttgataatgcctgcagcccaacagatgacagtgtgcttaacagctctgtcaatcctgtcgccccacatctcctgtcgcccagctctggcttgatccgctgctgcttcctttcgcgtggtacagctgccctcccacagcagagggcggagggccacagtgttacaggcttctttgtacctgcgtttggtgggtcctgagttgttgtcccgcatccaagaagaacaaggttatactgacaatagaagggtgaggagggtggagaagagttttattgagtgacaaaacagcttctcagcggagacgagacacgagggtggaccccagatgaagtcagggggtcattctctctctcagcgtggctggttctggggcttttatggacacagaatggggagcctgtgctgattggtttgtgactatgcaaaaaagactaaaacaaagacaccactcaaaggtgggcacaacagtgtaaaaaaccaattagggaagctcaggtatatgtaaactaaatgaacagtgaggatcaatcagaggaaagcacaccaaatgggaagagaggttctcaaaccagtccatggatttacctggaacttgtagctaggctttaaactgtcttcagcttgaaggtcgggtttcaccgggatctgccccatctgcctaggatttgtctgcctcctgcttctatcagtttcaagtggtattattagttgtttatgtgtatccattactcttggtggtgtgcactatgagtctggagggataactagattgggcaattaagcagttatttttaatgatttccaaagaatcttcggcatttacaaagtccaccacctaataatgatttccaatttcagaatgatttcagatttcagaaggcaagcaggattcaataagttgggcattttggggtgcaaagactcttcccccctcccttctttttttcttagagcacgtggttcagcatgcttctgtgagcctcctctggcctgttacagttgtagtagcaagaagaacagtgcccgttctctttctagatgttcctggctttgcttaccaaatcgagagctgttctgcctcatgacccactaatgagaataagtgggatgtcagagagccatcagtgaaagatgacacctgaaggttatggctcttgtgcccatggagaagtatggttctgtgttcatgccttctgtaggtgatgctgggctatgaagtttatatggcaattatgcacatcagctctaattgctttgccagtcacagggtaccatggttctttagaataaattggcctttgagtttctgtcagctactgaagaattcagatccctaatgaactaagacttttagctgggcctgaacctaagacctaaatgatagtcgaggaggaaatggtagtgaggaagctgagcatctattagcgaagaaatcaagggagagatgggaattgctcacacatttgctaccactttttttttctttaggttccgattaaaaggcaggtctgctagtcattgtgtcttggctggaatgaaagccctttggaatagcagtgttccagtgtgtgaacgtgagtagaaagaactatgtagtttggatagctctccttattttcgttttccagcatgtttttccgcatggcatcacctgttgtctagatctttacttaactaaattatggataaaaatacttctttgttggaagaatttcaagaagggtcttgtaggtcttctctgacatgtgtttttgttactaatctgcaaatcacttagtttaatgactgtttaattttgtggggaatgtgtggcaagaaactagatgacataaaggtgcagcacgttttagtcagtcatttatttttagttttcttatcaaggaggaatctttcttaaatttttatttttatttttattttctgagacactgtcacccaggacagagtggagtggtgcaatcacagctcactgcagcctcaacctcctgggctcaaatgaccctcgcacctcagcctcccagtagttgggactacaggtgcatgccaccacacctggctaatttttgtactttttgtagagatagaatctcgccatattgccccagctggtctcaaactcctgggctcaagctatcctcccaccttggcctccaaaagtgttaggattacaagtgcgagccaccatgcccagccaaatttttatgttcttttatcccctcgcatatcataaacaatttagtcagcttgttttttagcctgcagtatttaatgacatagggcttcccatgtgccaggactttccatgtgtagaaaaagcaatgaatagtgaatgaatagtgaagacacctccctactttcctgggatgtattttcttgttgggaagcagactatgaacaaggaaataaataagtaaacaaaattctaaaaattataacatataaaatggtagttaaatagggatgttatggagaaaataaaacagagttatatgataaattagtacgatggaaggagctgggatgatgaatcagtgtctgaaatgatgaggtgtcctaagtttccaaaccatccgcttaaataaaatatgccaaaattcagaaaaaattcagaaactcttagataaaagtacatgtttgacataccaagacattactgattgattctattctgtctactaaagcaaggcaagaattttttaaaccttgttttcctgattattagaaaatgtttattttaatttgtattgtgttaaaataacttatagaaatcaatttggataccttatggtgagtattatggtgaagaacattcaatacctgaggaaactcaagtattcaacaaactcaaccttacagagacacatagagctgaaaataaatatataaataaacttaggaaaacacaaacaggtaaaattcaagcatgagaagtcaatcattgtttgatgtactaggtcttttatatacacataattctgataaatttgggtatctcttcctaaattcatatcaaactagaagcatcaattgcttttagggaaggaactgttctaagcagactaaaaggaggaagaaatggtggctaataattggaagaaatcaaaaaaggctctttggcaccatttaatctgagtaaaaacagccttactggtgtctgatgacaccactggaaatttggtattggtcctgatggtaatggtcttgaatcaccaagaaacatttacattgctaaagatgatagctcatgtttattaaagttcatagatttccttgaaacttatggtctctgatgaccaaaactttgtctgtcttgaacctcattgtcaactcaggaatcttactatgcctgagttaaagtagacaaccaaatgggtgtttttaaaaaaaataaaaacaattactttccaaattcattgtgaacataggtacctgagtggtccaggaacactgtctttgggcttttgcaataaactgtaatttaggtctcacttcagttagttgcctctcaacaaaagccttacagatttaaattccgtctaccttagttatattctttctaaaagttatattctttttaagcgcacagtcacaggtcactattgtttcagtcatcttaagtgaaattctaatagaacttaaagctcttgttttctttctagaaatcttttgtccaaatcctccagctatccttaatgggagacacacaggaactccctttggagatattccctatggaaaagaaatatcttacgcatgcgacacccacccagacagagggatgaccttcaacctcattggggagagctccatccgctgcacaagtgaccctcaagggaatggggtttggagcagccctgcccctcgctgtgaactttctgttcctgctggttagtacctgcttccacatatcctaaatgggttcagaatatctaggtaagaacctccatatttctatagtgacagtcatttttgcttgtgaaaatggctttgctgtaactgtcagagacagaactacctcccaagtgaatgacaaacgggttatagataggcacgctgtctcaattgttggtattctgatggtccttcctatggggtgaagagtgtgggatggtaaggagagaagggggtggacagtgaagagaattgatgaggtccagatttagtagggaatgttttcaaagtactgaaaacaaatgctaaagaaaatactcttttattccacctctactactacgagttatctttatcctggagagatggatgtgctgtgcaaaaagtacacattgatgatgtaatttacttcagaactgataacgctataaaagtaatttgagaaactcagatgtagggatttatactttttatgttgtttccaagggtttgttcaagccactgactatgtttgtttgatccttcacctcaacattaacaaagggaactcaggaggccctggagaagcagagtttaaaattgtactcttagcctaatgggtgcagcaaaccaatatggcacatgtatacctatgtatcaaacctgcacattgtgcatatgtaccctagaacttaaagtatatatatatatatatatatatatgtgtgtgtgtgtgtgtgtgtgtgtgtgtgtatgtgtgtatatatatatgtgtatatatatgtgtgtgtgtatatatatatatatatatatatatatatatatatagagagagagagagagagagagagagagagagagagagagagagagagagattgtactcttagcctccatagctcattcctttgatatattagtctggctttaaacgacagtacctgacaactgtaggcacatgtgtggctgtgactgcccacaccagttccatcttccagtaaggacagaacagcactgaatcggtagcttgtcgatccctgtggtactcccccatctgatctagtttgaagttagagactgtagaggatagtgtttaaatgtcaagaggtctaggtttagagaacccgtctttcactgatcaaataggagggagtggcttatgacctggctggttgaggtcttcatgtacctctaatagccagagatattggatgtgttcatgtattcatatgtctatgtttaactgagtgtcttttcttgtgtttgtgtgggaacttgttcttagcctgcccacatccacccaagatccaaaacgggcattacattggaggacacgtatctctatatcttcctgggatgacaatcagctacatttgtgaccccggctacctgttagtgggaaagggcttcattttctgtacagaccagggaatctggagccaattggatcattattgcaaaggtgacttatttcttggtattccttattcttgctgggttgtatggaatgcatgaggcttgtaaggctgagagacattgaaatgagcttaatgaaagggataatatttttttcttctcggcaactgctttcttttcatttacataaaattatttcatcttattaactgtcctctttgcatggtcgatagcagtgcttctccatccagagcattaacaaaatcaccttgttaaaaagattctcaaactccattccatggcctctgattctgttttaaagtggggtcaaaagtctatttttaacaaactcatcagaatgctctgatgcaggaagaccacagaccacacttcaagaaataccactttgccttcttggtttgtatctaggaaaaaaatattgtaggcttaattttgagactattacaactgaaaagaagtctgtgcttgaagatgaaggatgtactgatggctgggcagaaaaagaaagtaaaacaaaggataagttaaacaaaataaagtagtctgggtgcggtggctcacacctgtaatcccagcactttgggaggctgaggcgggaagatcatgtcaagagatcgagaccatcctggccaacatggtgaaaccccgtttctactaaaaatacaaaaattagctgggtggtggtgcgcgcctatagtcccagctactcgtgaggctgaggcatgagaatcacttgaacccagaggcagaggttgcagtgagctgagatcacgccactgcactccagcctggcaacagagcaagactccgtctcaaaaaaaaaaaaaaaaaaagaaaagaaaagaaagtaaattaattagaaagatgtattaaattcaggctgggcacggtggctcaggcctgtaatcccagcactttgggaggccaaggtgggcagatcacctcaggtcaggagttcgagaccagcctggccaacatggtgaaaccccgtctctaccaaaaatacaaaaattaatcaggcatggtggtacatgcctgtcgtcccacctacccgggaggctgaagcaggagaattgcttgaacccaggaggtagaggttgctgtgagcccagatcgcgccactgcactcctgcctgggtgacacagtgagactcaaaaaaaaaaaaaaaaaagaaaaagaaaaagaaagaaagataaattttaaattcacaatcatgatttactaacttctttgttctatgtgcagaaattggccagaattatgcatttaataaagagcagagtgccagtatttgttgtgaagccagacagaattaacatggtactcctgttccctcacagcgtgaccccagtggctccagggctagatcaccgttagcctaattcctaatctttccacagctttccagttgcagagctgttaatcaacagtgaatgcacagtacattccatattctattactttacattaagaaatgggagtcaggaaatgttaaatcataaggtttttggaggaggaagattagtaacatgtttaaaaacatgcttcctcttagccaagggcaaaataggttttggctattttctcctattctcgcagttaaaacggacaatcaacaataaaatatcaatttctttctgatttgtctaatttcagaagtaaattgtagcttcccactgtttatgaatggaatctcgaaggagttagaaatgaaaaaagtatatcactatggagattatgtgactttgaagtgtgaagatgggtatactctggaaggcagtccctggagccagtgccaggcggatgacagatgggaccctcctctggccaaatgtacctctcgtaagtgcaagtgcaaggaatgtgggatcttcccggtcatggttattgctcattcattcatccatattggcatcaagtgtagtgtgatgtttatggcatatgctatgagctatagagtacaatatgagcatccacctattccaaaactcccatagtgagagtaaggccagacttcctcttctcatacttctcactgcagctctgcaccttttttgtctatatcactttgtggttgcatgagccacacagtaatgatttatttacagcctacgagccttacaagaaatgttttcagcatgagttagggagcaccttccaagctgcagagagcagccggcctgtctccctcactactggaggggacaggattttaagctagcacagctggatagagcagatttagaaattacgtatcattgagctctgtagaagagtagccctctgctggcaactggaaggtactgtaagatagaaaactacccacatcatggagcagatgagcaaagttaataatgaacagcctttcttaatccaagttagtgctacactttcccttctccccatctcttatgactcttctaatacatggttctacaccaagattgttcaagatccagttttacaattaatcctgtaaatatgctaatatgactcgcagataatatttctaaattatcagcttgacactcccttaatatcaaattatatttgcttttttggcaaaaatctcactggataacttactaaatgcttttagagtattctgaagatctggctgggactgacagaaaattcaggtcattggagaaccaaccgtatcaaatattagaacaaaatataaagcaataatacaaaagtcactttgcaccaggataagaagagacatacaaataagtggaacaaaattgatattaataaaataaaggggccaggtatggtggctcatgcctgtaatcccagcactttgggaggccgaggcggatggatcacctgaggtcaggagtttaagaccagcctggccaacatggtgaaaccccatctgtactaaaaaataaaaaaattagctggtcgtggtggcagatgcctgtaatcccagctactcaggaggctgaggcaggagagtcgcttgaacacgggaggtggaggttacagtgagccgagatcgctccattgcactctggtctcggtgacaagagcaaaacattttttaaaaattgtccattaaattaacaataaaaaggttgttaggtgaacacccaatacaaagcaaggatgtgatgaaactgatattgttgtgtgttgaaggtactattgtaaatttgcaaaaactcttatgaaaaacaattatgaaatgtatgtggaaaataatacaactattcctgccagttagccctcctagaaatttaatctaaggaaataatgtaaaatattaaaatattctatgcattttattaagggtttcatgagacagaaacctagaaacaagctaaatgcacaatagaagtcattgaatacactatgatgcatctactagattatgttagtttgcctttgttgtaacttatatttctagtatataattatgtgaaaacacacatataaggaaatgtaccagaacagaatgtatcaaaacattttttgggtatgaggattggggtgacttttttctttagttctgtattataaattttcttctgtaattgtattaataataatttttaaaagtcttctctgagtgcagaaggtaaaatgagagtatgtgaatgaaaccaatggctttttgcattagaaaaaatattagactgagtcctgaagaaaaatcaggatgacttgtcactggctgagaggtcctgttcaatcatgttgcatgccagagtgatgttttgtgacttttgtcttccttttaggtacacatgatgctctcatagttggtaagttttatgaaagttttgctgaggaattctggcatctataacagtaagtacctacctataatgaatgaaatgtaaaaagagagatcaaaatgtcttgaggtgtaaagagatcaaaatatcttcagttgtaagttcaactagaaagaaaataatgataagttaggccacaatatggtgaaactggcatcgtcatatgcatactaaataaccttcatcaaaggctctttactatctttgaaccattacaaatgaataatcattcatcagtgtcaaaaattctttatttgaatgtggtgggagaatgcaacttcttctttcagttgtaacctggagtatgcttccagatggtgatcctgctcatttgcacaaatagaaagccataagaccagtcttctgagcccatatctgtgatttgcctaaataagaatagttttgtaataaagtttgcttccaagggaatactgtggcatattactcttacatccctttttacgcatctggacactgagacacagagagttaacgtaacttgtccaagaccacagaatggggtagcctgggtctacttatctgtggagactgtgcactttaacaatcaataaatggacaaaatgacctaaatatgtaattcaacaagagagagaattccagtattttcacaatgaaatgcctgtgtgttaagtcttaggcaagagacatgggcagggccatggagagctggtggccagctgccccatcacggttctcacttacttttggaaaagctgacattggactaaacgttacaaaacggctcagctcacaccttaactttaataaccctgtgggagtgagactaatgctatagaaacccagagtaaagcagaatgtatagttacatctttaaaaaaaaaaaagcattggcaatctgtagtgggactggatactaagatagaatttaaaacctgtaagttatattttccatgcatttaattaccttgttttactgcctaggcactttatctggtacgatcttctttattttactcatcattttcctctcttggataattctaaagcacagaaaagggtaagtatagccatattatcccaagaaatgtaaactgtacttaccccctcttggaagtcaaaagaaagtaaaagacaaacaaacccattgctacataaacagatgtggtaattcttataaagaaagtccttgacacacagtatagacaaagaggtattcacactaaaggaagtatataggatactaagaacaattaaaaaataataataataacaaaaaaaaagaccatttggccaggtatggtgactcatgcctgtaatttcagcactttgggaggccaaggtgggcagatcactagaggccaggggttcgagaccaacttgggcaacatggtaaaaccctgtctctactaaacatacacaaaattagctgggcgaggtgggacacacaactgtaataccagctactcgggaggttgaagcatgagaattgcttgaacccaggaggcagaggttgtagtgagccaagactgtgccattgcacaccagcctgggtgacagagtgagactacatctcaaaacacacacacacacacacacacacacacacacacacacacacacacacacagcattttaagaaggaattgagttttacagaaagagaaagtaggcagaaggggtttttaaatagttgttcatgaggctgtttgatatcctagttttgctaagacattgcagacactgacctctaagcccagatcctatcatagcactagaagttagattgggtcacttatggcacacatatcatatggcacacataggctgccagtggggaagaattgaaactttccattgggtattttaatatataaacaaatattttgtaaacaccattaacttttttttttttttttttttttttttttttttaagaccgagtcttgctctgtcacccaggctggagtgcagtggcacgatcttggctcactgcaacctctgcctcccagattcaagcgattctcatgcctcagcctcctgagtagctgggactacagccatacgccactacaccaggctattttttgtatttttagtacagaaagggttttgccatcttggccaggctggtcttgaattcctgacctcaagtgatccacccgcctcagcctcccaaagtgctgggattacaggtgtgagccactgggcccagccatcattaattttttaaatttgaaagaaaaaaaacttgcaaagactaagatctgaataaagaaacgtctttgacagggaagagaacctacacagcttttgtactggttgattgaattataacaacctcaatgaggccagaatcaataatatcaatgttatatggttgatgagcaagttctatacccatagaaaaactgaatttgtaacttttaagtgaacggttttctatagcaaatattctaaacaagtacagtttcctacaacaagctttacagaaactgaagttttgatatttcacaaagatgccaatatactttttaaaaagtagtttgtcatagtagatcttgctgtaaagaacctagacaggaactcaatttcatggaaaaatactgaattggtagatatttaaatttaaatatccatccttcctaactaatgttctctatattttacggcttgacatatattctttgctcttttccattacaaaaagaaaaggtaagtagctgggcactttaccttaacaaagtacttgtgtcaatacatttttcctcttaaagtttctcattaagtaccatataattagtgagttaattttttaaaaaattactactacgtctgaattaaaggagttggggcttctaattttctgtatctatatcagtctctagttaaaaccacacaggggaaatgattatcccttcttcttggaagtattcaagatactttaatatcttgaagatatttgattatctccacccttctaactatgtcattcttcattacttatggtccattccttgttaatcaactagagggtcacactcccaagcctaactattgatttgtttcacctacataatttaagatcatttcctcatattaatcaccttcaggcataaacatgactcaataaccatttcataaaattatttctttggaaatgattgtcttgtaaagtctaagcaacctgagaccatataccatttcttcatgttttccatctcgtaaaacctgcctcctatttttttcatattctttaaagtgtaatgtccatggcacaaccattctctctctgaccagtggctaccagaaatgtggcagaaagaaagatcatgatcctcgttagacttaaaggtcagggatgtaaacctcccaaacatctatgtaacccacactaaaacctattctatatgtgtaatccaggaaagtttttaaacattttctaaacttttacttttgacctgtttcacttcttgggattgtaactgcctgatgtgttcttcctgcctgtcatacagacaaaaccagttccctgagataatggcatattgcagtaaagaaagagatgaattaatacaaggccagtcacgtggaagaactggagttatcactcaactcagtctccccaagaacacaggggctagggtttttatagatcatttggtaggaagggagctagggaatgggtactactgattggttggggatgggggtgtgggaaatgttcctcatgtgctgtgtccacctctggttgggggccacaggaccagttgagtcatgagtcacaagtccaggtagagtcagtcagttgccaaatgcaaaaacctgaaaaacatctcagaagaccaatcttatattctacatagtgatgttatctataggagcaattagggaagtcacaaatctctgagcagtaatggattataaaacctatgcctatattttagcagagttcaggtccctctcctaatcctaatctcttggcctttcattaggtttcaggtcctgagcaaggagagagctagttttaggaagagactgttattatccttgctccaaagttacattataaactaaattcctttcatggttagcttggcctacacccaggaatgagcaaagccggcccacctgtgaggctagaagcaagatgaagtcagccatgttagatttctttcactctcagaatctttgcaaaggtggtttcagcatagtgagtgcatttatctaacaaaacaccactgattttcatgttagaaataacacatagctaaaactgggaaaaagaagtaataaacttaaataatcagaaggcagaggtcccttctttcggaaggagttgggctgattaatcatgcagtcatacctccttgagtgggtgtggccaataagctaagtcattgtggctatgtgaggagggctgattattccttatctggagctcaagctttcctcacagaaagacaagggcataaagggcctcatggcaaagaagaaggaagccatgtgggaaacacagaatatgagtggagagtatcgtagtggtcaccaagtcagaagagccatttatcctggagctaaaaaagactgacagatatagaatagtgtagaacaagatggcctgctctatgggagagccacagtcacaccaggcctagagaggtgcaggctgacttctacctcaaacactggagacaattcagaagctgcataagcagtctgaagacttactaagaaactaaaatgaggctgggtgcgatggctcaggcctgtaatccctgcactttgggaggctgaggcgggtgggtcacctgaggtcaggagttggagatcagcctggccaagatggcaaaaccctgtctctactaaaaatacaaaaattagcctggtgtagtggcacatgcctgtagtcccagctactcaggaggctgaggcaggagaattgcttgaacccaggaggtggaggttgcagtgagttgagattgtgccactgcactccagcctgggcaacaaaggcaaaactccatctgaaaaacataaataaataaattaaataaaataaaacaagaaaagaaactaaagtgatagagaaatagaaggaatacacacacagaaatgatctcaccttctttaaaatgctcctcaaggaggtctactttaactatcctagtaaagatgacatgaccccacccccacattcctagtctctcttatcctgctttatttttttcatagccttattctcttttattataattaattaaataattacattccatgtttattctctctctccctccatgaagtcggggatttttgtcctatcttcaccaatggatacacaacaaatctaaactgtccctgggacaaagagagtctcaataaatatttatcaaatgaatgagtgagctacacaccactaacagtgttaccacaaggggaaatttctgccgtaattctctaccaagttgaacagtgcgtctttaacttgtcctaaacttactccaggtttcaaggctgctccttgttctaatataccaactgtctcagtctgttggtatatatacttgggcagttataacagaaactccatagactgggtggattcaataagcatttaagctgggtgcagtggtacctgcctatagtcccagctatctgggaggctgaggcaggagtactgcttgagccaatgagtttaaggccagcctgggcaatatggtaagaccatgtccctaaaaaacattatgtcatttctaaaaaccaagcatttttttctcatagttctagtgggtagagagtccaaggtcaaggcaactgcaaattcagtgtctggtggggatcgctttctagttaatagacttcaatcttttctccgtgttctcaaatcagagaaaaggagtaaaggagctctcctggtctcttttctaagggcactagtcccattcacaagggctctgctctcatgatctaattacttctcaaaggtctcacctttgagatcctatagtaattagatcctataaattttcaacatataaatttggaaagatacaaacattcagtccattgtaccaacactgcatttggtaagcacatatgcttaaacgatatcacacttgatttcatgtgccttctcaatcctcagctttccctgattaagaatacctaattactctgcccatttcctctgcaccctccaccttggcctttccactcactattactactatctcctgccttcttggtctctactattctcctcaccatccctgctccctggactatgatcccctgtgagcagggaccacctatatccacccaaagcaatttttatttaatgattttttaatctctacttgtacagcagtcaaaattaataataagagtagaaatggttaatgtatctacaaaaagagttaacatgtttatttataggtttatttaccatttattatcttctttggtcctcaaagcaactctgtgaggtaggtaggcccaatcatattgttatcccaaagcataaaacactctaggttcaaagaaattcagtggcttgtttaaagccagtaggaagttgttaggaattaggcctttagtccagattatttaactggaaatcttgaactctttgtgctagtattttgacaatgttagttgccatttctgaatctgactctatattactgaaattcagtatccagaactgtacatagtacaaacctaaagtattttccttttttctttcaatattctttttctccctatattttactgagtttgttttagctactttggtatattgaaccagtatctttctagagaaccgtatgcaatctctactttttttactctttattctgagtcattaggctataaaaaattaaggtatttctttaagggcatctttccatattgagatttcctggcgtttcacacagacttggcaagttcttcctgtgatttaatctcactgccttgttatttcactagttaaaaatatgcgcctgcacgttttgatatttcactgtgtatttacaacaataatttgtgataatgttaaataagataggtcataagataggtcatgcactcatcagtgaggaataatactggttagacttcttcattcagagcccattattgcctcttgttactgcctcgtacccactcccatttctacacaaaacagccttgtacacagtcaaaatttcaaagtttccattgttgtgatgtttagaatgataaaatacttaaggccatcctctgtgaagtctccctgaattttcctatgttcacattaaccaccagtaactaaccaaatagctcttcattcaacatatactcaccgagatcatattctccaaaaccccatgtaccactcatcacccaagaccaccttcagaacactactcatcttaccacttaaccaccactccttggaaggtcataccacctggctatataccactccactcttcctcatccatggatctcaagtgtgccttccctgtcctgtgaaaactctgccccctgaagcagtctgcctctttttctcaaatgatgctgtcattctaatttccataagatggtaaagaataactgagtgatgaggaaacagtggtacatgttgaagtgagttaactcttcaagcttccattctaaaatccctaataccaactcatacataaaatctccaggtactggtactgttttatcatttcattgataaaagatgaagtgtttattaacccccaaagaggcagtgtaccataccaagtgagggtgagggctttgcaaccgctaaggcctgtgttcacagtcactcactctctatgagaccctgagcaagatacttatcctcagtaaatttcattttccttgcctgtgaaatggagataataatagttcctaccttacttaacatagtgcctcatttatgatgcatgtcagaaaatgttagctattatttacacatgattgttattactgatattaaaaagtgagtaaatatttctttttactgttagttcttaaataccttcatgacagctactgctgctcccctaaccgtggatattgcttgtacagaaaacagaacacatatcttcactataggagaaaaaggaagcctcgtgtaacactgcagtgcaaagtcattcatgttgtgcagcttaagtgtcaaaatctcgatgtaaatcctatttactaatcaaaattatgtcagaaatagtgaaatgtgttaaggcatggacatctgcctataaacaatttagagtactctgacagaaaatataggatgattttagtattattttctaatctaagtttttgcttagtattaaaagatgagatttggttatgattttcctttcagacgtcttgcaaagatatcaggaacttaaggcaaataataccttaaatttcaaaatgcaaattactaatttctttcaaaacagatacttaaatgattaagacagtttttctatttttttctctgccaattagcaataatgcacatgaaaaccctaaagaagtggctatccatttacattctcaaggaggcagcagcgttcatccccgaactctgcaaacaaatgaagaaaatagcaggtacctatatacatactgaattcaaaatgttttcaacaactcaaatatcaaaaatggaaacaggacttgaatatgatattgcactaggtaggtcattgataccaaagaatttagaaagtacttcaggagttggaaacttcttttttttttattggattattattgtcatttccaatgttttggggtgatgactctataagttagtacagtcacagtcactactttttcaaagcattcctataatttcctgtatttatgctatgaaactttgagaagtagtatgcttttttcttgtggaacccaagaatttgctgcctgcttgtacctccaagtcttccagcttcccttaaatgcacagagtcactttaatgtcctctagagactttcactttacctccccagccaccaacccccttgatttctgacttccactgaattctctacttcatttggcctctttgactgctccttcttttggtcctcattcccttgggcttattaaatacctaacctttcattctacctattcaaagcaggcttactgcaagctgttgtgcagtacacattgctaaagatttggggtgaaaagggaaattataccattatcaaaagtggtatgtatcaatattagaaatcactgaactgaaaagtaactagtacaccagggacctgaaaactaccacctgtgagccaaatccagctggccacttgtttttgtgaataaagttttactggggcacagccacacccaatcgtttgtctactgtctctggctcccttttatactacaacagcagagctgagtagttgcaacagagaccccaaaagccaaaagtatttactatctggccctttagtggaagactttgctaacccctgaactatatcatactatgagaaatttctcactggctagttccccttttaacctgggctttccatcctcttcccaggcctctctctctcattggatactcctctcttttgttcaaatctttactgcattctcagggtatgcagtaaatacaggcattcagactctcgggcttcttgcaaattcaaaactccatttttctttaaaattcagagcaatttatttggctctggcttactttggctatgcccaagaatcctaaaatgtcctacccataggtgtttggaacattttcaggaataagatcaccatatgccctagaacagaattaggccagtcctgtagaaagcagaagcaaaagcaccacaatcattactgaatttcctttctttatgtcctacctctttctcatatacctgtgcattaatctaaatttggcatgttacacctacatacatcagaaatcctaaattcaacagaggacagtggaaggggccccaggaaaagtaaaggaagtggaaaaggtattttatagttaaccaaaacataagtagaagcaattcaaacttttctaaacaaaaaattacagattatgtcctattttctcctataatagaaatgaatttgcaatgccctgtttattatctgtcttcctagttgctttgcttctagcttatttgtcattactgtttatgaaaacaaatgaaatatgcattgcttttttaaaattcagaattgatattttactttttgaagctttaatgtttatctggcctgatccttctcaaatgggcatatgtatacactgggggatacatggctaatgctaatataccaaggggatataaaaatcataagatgaaaatggcatggtttcctagagaatatatttttctaatattactccaatagttcaaataaaaattgtattatttcaacatgaacacaaacacatttataagggaggaaaagacaaataaataatgcaggaagtttaagataaaataagacggctgggcgctgtggctcacgcctgtaatcccagcactttgggcggccgaggcgagtggatcatgagtcaggagatcgaggccattctggctaacacggtgaaaccccttctctactaaatacacacacacacacacaaaatttagccaggcgtggtggtgggcgcctgtagtcccagctactcgggaggctgaggcaggagaatggcgtgagcccgggaggcggagcttgcagtgagccgagatcgcgccactgtactccagcctgggtgacagagcaagactccgtctcaaaaaaaaaaaaaaaaaaaaaaaaaaaagataaaataagacagaaaatattgtgctttcagggatgctttagactatgtctccaaagttcttgcgtgaggcattcattttcctttactatcagagtgctatgggggaaaagtcaggcagaactgattcagggccagctgtgtggccactcatttacaaacagacgaaataacagcagactggaagaacaacaaccatttttacaagagttcattttaaaaatattccacaatgataaattatttgatttagcctcattcctgtcagattacctgcctaaaacacttttccgcctttctttctatctaaattccctgaacccagctccagctctgaattcaatcaaccaagatgctctcccaaacaactctagtccaaaatgatatctctctttgaaactcacatttcctgactacaccatttaaaaaataaactaatttattttaacagtaatatctcatcattgttaaaaacaagaaataggggaaaatataaaaaatataaaaattacctgcaataatctctatctagtagtattcttaagcttctttgcatattgttagacatttgcatatacaccttgagattatattgattgcacaatattgaatcctgctttttttaccaaatgacaaacatttctcccatcattataacagtacataacctatagtaattgacatttcctgtgttgttttttgcctgttaactctattgcattcatgtagttgcttatttattcttcaaacattcttagccacttacaatgtgccatacattgtgcttatgtgtgttttcttttccatgctaaattaacttctgatgaatagagacaattttttaaagatctccccaatctctgagtataatcaaatgagaaatgttcagtaatcaactgagcacgttaatcaattgagaaatttttcatgcacgtccctgtgaagagatcaccaaacaggctttgtgtgagcaacatggctgtttatttcacctgggtgcaggcgggctgagtctgaaaagagtcagcgaagggagataggggtggggccgttttataagatttgggcaggtaaaggaaaattacagtcaacggggctttgttctctggcgggcagaagtgggggtcgcaaggtgctcagtgggggagctttttgagccaggatgagccaggaaaaggactttcacaaggtaatgtcatcacttaaggcaaggaccggccatttacatttcttttgtggtggaatgtcatcagtaaaggcggggcagggcattttcacttcttttgtgattcttcagttacttcaggccatctgggtgtatacgtgcaagtcacaggggatgcgatggcttggcttgggttcagaggcctgacaaaattaatttatgaaaatttcatttatcctcaactttttggaaatactcttacatcaaagtacacctcaaattgtgtacactgactactgatcacttttcggtaggtataaagtccttaaaaattttgtttcaactttcccttttaagattagaattttgaccacagtgttccatgggaacaaagtgaatcatctgtggcaaaatatgctagtcaagaagtgagttagaatctgtgccaagcgttaagaccttgtgcacccaggttctggggcggagtaaagaggcaggctccaaagacatagctgtgtgttggacatgagagtatttggaggaatacaggtaacaggtgatgctgggaagtcctgtgaaatggaaggagaacgaagatgaggaatctggtggcagtaataaccggggaacagatgagctggaggcctcatcaggaggggtgtcccttggtggaaggacaccattcccggccttaaaaggagacgcttcagcacggctggggaagcacgtggataccttgtactaaatccactactgcagctcattcttaactgtaagtagaagaggaggacatgctttctgaagctgacccctccaagatgaccagttcctatttctgtcccctgctaccaccatggtgtagaacaacagaatcaaaaaaacattttttctgttatgggtgacctgtacgttttctagaatggaaggaggctgtttagtagctcaactctgagaacactttttctttggacaaaattaaaaaaggaaaaggtcaagttaatcattaatctctctgttttctactaatgtctccattttcgccatactttctatgtcctacatagcagccatcacagagggcaataaacacttctaatgaccgtgtaatttatatggaatgctgaaggggtgggttggccctccacacctgtggatgtttctcattaggtggaactagagacttggaaaagaaagagacacagagacaaagtatagagaaagaaaaaagggggcccaggggaccggtgttcagcatacggaggatccaccggcctctgagttcccttagtatttattgatcattaatgggtgtttctcggagagggggatgtggcagggtcataggataatagtggagagaagttcagcaggtaaacacgtgaacaaaggtctcggcatcataaacaaggtaaagaattaactgctgtgctttagatatgtatacacataaatatctcaatgccttaaagagcagtattgctgcctgcatgtcccacctccagccctaaggcggttttcccctaactcagtagatggaatatacaatcgggttttacaccgagacattccattgcccagggatgagcaggagacagatgccttcctcttgtctcaacagcaacgaggcgttccttcctcttttactaatcttcctcagcgcagaccctttacgggtgtcaggctgggggaaggtcaggtctttcccttcccatgaggccatatctcaggctatcacatggggaaaaaccttggacaatacctggatttcctagacagaggtccctgctgccttctgcagtgttttgtgtccctgggtacttgagattagggagtggtgatgactcttaacaagcatgctgccttcaagcatttgtttaacaaagcacatctgcacagcccttaatccatttaaccctgagttgacacagcacatgtttcaggaagcacagggttgggggtagggttacagatcaacagcatctcaaggcagaagaatttttcttagtacagaacaaaatggagtctcctatgtctacttctttctacacagacacagtaacaatctgatctttcttttccccacatttcccccttttcgacaaaaccgccatcatcatcatggctgtttctcgatggttgctgtctctttggagctgttgggtacacctgcagactaacaacagacaaaacaggcacacaaggattaatatgaaatttataatcgtagtacttccgatggtcttaacccaagtgacagggttaagatttgcgaggccatcagcaactcctgcgattgcctcagttcctggcaccaaatttaaatgggcttttgatgtttcaaaaatttgttcctttaatttggaaatgtctaaagtgagattatcttctgttccctgtagatggcatctgaccatgtcccagtgatgctcagactcattataaacttggggtgtaatacaaaaatctgagatattccagtcacactgtaactggaaacgatggtctaagttcataagcctgtctcccatccaaatgacagtttgtctaagatcattaatttggtttgccaatttttgatcaataccagattgtgaattccacaatcttgtagaatttttttgccaatcattaacaaagtttactgactgaacagaagagtgcaatgcaactcctgccatagcagccgtagctgtgactgcaattaatcccataatcactgtaattaaagtaaaaatgaatcttttggatctatttaaaatggcttttaatacttcagtcaaaatatggacggatggcaaggcctcccacggttggtccatggacatagaaatccacacggcttctcttgccctcaccagcagaatacactgttgccaattaaaagttgaataaatgcaagtaaacaatctgcaattttcacagcttatagtttgagagtctggtttaataactatatttcctacaactagcatataagggggctttacacaggtttggaaaggaactgttagactggaatttaggttgatagtataaaatagcttacgatctcgtttctaaagtttgatttctagaccaaattctaatgcagtatgaggccacagtaagcctccataattctggatgttcaggaccagaaacaggacttattatttttggtcttggggtagagattcctttttctccctattcccaagggtagaaagactgtaattttttagcttatgtttgtctaaactttctgttaagtcgctatcaacagctagactcacttgtgcactgggacacgactgagtttgtcctgtgcaattgtggtagaattgacctcgaggtgcccaatctataatagttccgaattcactgttttgtaatatcaccgcactattggccacacattcttcccaaactaaaacttctgtattttttgatcctttgggaatttccttggggcaaggtttccctttaggtctaaattttaatgatctttgataagaaaagtcttgtaaataatttacccgtggcctgagtgacatcccgcttaccatgtgataagtgaatctactgatgggactgacagtaggtacttctaccaaccaattttggactgcaggcattaaacatcctggtgctctccctaggcagataggaggataatgatacccaatggaaatatttatcatcatcccttcttcctcaggtttggcagggcaatgatcatctgtggggccaggtacccatacactatcattaacatatacttcaataggattatccatccatgtgactggtgtttccatctccgcggtggcgcttttctttgcatctccgatgggttcatcgtagatcttcaaatgtctagtgggtatccaaacaggaagctgattttctcctggtgaaacacaagcaaaacctctcccccacgtcaccaccttccctatttcccatgtcttatttttattatctttccaccaaatcagttttccttcatgtgggctgttctttttaccagtaaaatgttgttctgcagaagtagtagtctgatttctataaatgtttaaaaaatttaaagtatagagtgctagattaagttgcatctgaggagtggtacattccttactgtctcccccttctttttgcttaactgagttttgagtgttctattagttctttcaactatggcctgtctgtgggaattatagggaattcctgttgtatgtgaaactttccactgatgtaagaatttttggaaagctttactacagtatcctggtccattgtcagttttgatctttttctggaactcccattacagcaaaacaagataataaatgttttttaacatgggaagtactgtctcgattatctggccctaaacaatgtaaaatcacagtactttgatacacttctgaggctgtgcctacgctgacaagccctgtaacagcctttagtttaggccaatttttggccactgatttaaagcaatgatagagacatctgctccagtgtctactaacccttcaaactgttttccttgaataatggccttacacgcaggtctgttctctgagacccgacttgcccaatatgcagcctttcctgttggatcagtgcttccaaaccctcctgttctttttatctcactatttccaaccttaatataaggcaggagtaataattgcgcaatcctgtctcctggactggcactccaaggaattgaagagctaataaccaattgaatttcgccattatagtctgaatcaaccacatcagtacgaatttgaactcccttcagacttagacttgatctacctaagattagtcctacagtcccctcaggcagtgggccatatacccctgtggagattttttgtgggggctcccctggaagcagagagactgcctttatagtacataaatccacagctgcactgccgcttgtggcgggggacaattgttgtactgtggtaactggctcattccctgaggcacttgggacagtgggggttgttgtccctgaaaaccctgaggaacaaagggctgaattgggaatgccccagtttgttgcggggcctgaggctggcccctttgctcattttcccgacaatggttgcccatttctatcaaatttagaatgacattgactagcccagtgttttccttgtttacatcttggacataagtcaggtggctcttttttatttgagactgggcaattcttttttagatgaccaatttgatcacaattataacatttccctccaaatgttctaacttgtcctcctaaagcaactcctgttattgtggaataaagtttagaaaatatccaaagcttatcagcctgtaaattctgggtagttcagttgtctaccatgctgttaattaaatgaaaacatcctgttatttcagggtccttccttgacaaagtactatacagctgaagaacatctcgaatacaattttggtgggaaaggagccaattgatttcaacagaatcagatctgagcttcataaagtctttgaagtgacttcacagagacgcagacatgtgcacttgaagatgctgccccttccctggtacctagcaaagctcctgcctctttgtgtgcgtcactgtgaaacccccacccttctgcctcgtgctaaacgcacacagtatctagtcaggggaaaagactgcatttaggagatagaaaatagtttggattacttaaaggaataaggtgttgcctggaatttctggtttgtaaggtggtcactgttcttttttaaaatatttgtaatatggaatgggctcagtaagaagagcttggaaaatgcagaaagttatgaaaaataagtcacttataattatgctacctactgataaccactcctaatattttgattcattttctgcctatcttctttcacatatgtgtttttttacatacgtacttttcccccttagtttgtttccttttattttatagagcagaaccctagtcttttaaacagtttagagtgaaatatatgctatatcagtttttactttctctagggagaaaaattaatttactagaaaggcatgaaatgatcatgggaagagtggttaagactactgaagagaaatatttggaaaataagatttcgatatcttctttttttttgagatggagtctggctctgtctcccaggctggagtgcagtggcgtaatctcggctcactgcaagctccgcctcccgggttgacaccattttcctgcctcagcctcctgagtagttgggattaccagtagatgggactacaggcacctgccaacacgcccggctaatttttttgtatttttagtagagacggggtttcaccatgttagccaggatggtctggatctcctgacctcgtgatccacctgcctcggcctcccaaagtgctgcgattacaggcatgagccaccgcgcctggccgctttcgatattttctaaactttaattcaaaagcactttgtgctgtgttctatataaaaaacataataaaaattgaaatgaaagaataattgttattataaaagtactagcttacttttgtatggattcagaatatactaaattaactttttaaaacacaacttttaaaaaatgtatcaaaataataaacgtgttctgatatttttaaaataagtgaccttgtgttctttaaccagtccacatctttagagaacaaaaatgtgttatgatattatgggccatgctaatgacctctagaaaacatcagaatatttctggatatttaataatagctttatatatgactaatgctcatttctatgtaattctgtttaatagttgctttaaaggtgaattttgccacatttactttgacagcagtataaggagtgagatagacatgaacctgaatttcaatttaaaatcatggaagagagggaaaaaaaaccagcttaagaaaaatcaactgataaactgcaagaaaaaaatgcaacttacatcacaaaagctaattgctttattatttagagagtacttaaaaattaaagaccaaacttctctccacccaacaaaaatgggcaaaggacatacagctaggtcaccaagaaagaagggcaaataggtggtgagtatatgtaaagatacttgataggacttttgcttagttgaatctttagcaaatctcttttatttcttgggattttgaagaagtaatttttaaaggaggactagaaactaagtgattgggaattggcctttttagaattaaaatttcccattacaagaaaaaaaaatcctgtgttcttttttttttccagaatggagtaggtcagtgagcaatgtgattaataaatatttcaatgtctgtgacttttgatttattttggagacagggtcttgctctgttacccaggctggagtgcagtggtgctatctaggcttactgcaacctcacctgtcactttttaattgcaagaaagctgaaaggtttttttctattatatcagttataatgataaatactgtatatactaactatgagtaaaatactatattgcctaacttgtattattaagcaattctgctaacctgtgaccttacattttcatctgaaaagcaggggctggacaccaattgccctatgaagctattgctagtcctaacattctttgttttgtttgcttttttggcacacttaagtgtgtactatgaagtttatgatgctttaatgaaattttctgtctctaccattgtaatgagaaaggaataaaatactttattttgcaaatcta

SEQ ID NO: 196 - DNA, 23552 bp, Homo sapiens
  source 1..23552: mol_type = genomic DNA
aagagttgctgacaccttctctgtcccgctggaagttattttctcctccctctccctgtacagctgaccttccttccctgctgcagggccagggggtctgttccaggactggattctcccatcaggagcctctggactggtcgccgagggtcagacggcccctccctctcttgctgtcatccctggctcttcaagctaatgagacctgtcctgattcctcagccaggcctgtagccttaatctctcctagcagggggtttgggggagggaggaggagaaagaaagggccccttatggctgagacacaatgacccagccacaaggagggattaccgggcgtgtgtgtgtgtgtgtgtgtgtgtgcttgcgtgcgtgtttgggtgcacggggaagtgaaacagacccgtgtgggacccaggagctcagggacatattaatatctagagagacagacgagaggagagagacacaaagagggccagagaccaggaaaatcagaaatacagagcaacagaggtaccaagacagggagaaggacagaaatgaaaggaaatcctcccagctactcgggaggctgaggcaggagaattgcttgaaccggggaggtggaggttgcagtgagccgagatggtgccactgcactccagcctgggtgacagagcaagactctgtctccaaacaaaaacaaaacaaaacagaaatgaagggcaatccagggagaggggaagcaagaatcagagagagagagagagagagagagagacagggaaaaagagaaggaggaacagagattggagctgcagaggataagcgaggacagagggacagagatgaggctggagttacagggacaggtggacaggcagaaagacagcaaagggagggacagacagacaggaacagaaggacatggaggctgagggagaggggagaaagagcaagatagacagggagacacagagaaaaagaataagagagaccaaggggataatgcaggtttatcaacagagacagggacggagaggagcagatggagaatgaaagagtggtattcaggaaagtaggcagaaatgccacagcctaaggcccacaggaaaagaaactgaggtacagagaagccagacaaagaccaatggtgtgtagagagatggtgagtgctgggtttgttggctcacgcctgcaatcccagcactttgggaggccgaggtgggaggattgcttgaggccaggagtttgaagccagcctgggcaacatagagcgactccatctctacgaaaataaaaaaattagctgggcatcgtggtatgtgcctgtaaagtctcagctactggggaggctgaggagggaggatcccttgagcacaggaggtcaaggctgcagtgagctgtgatcatgccactgcactccagcctgggcgacagagtgagaccctgtctcaaccaaaaaaaaaaaaaaggaaaaaaaaaagaaaaaaatcccaaaccccaaactccaccaaaaacagaaaaacaaaacaccctttctaataagtctgcctattttcagtgctggaagcagcccctgccacctccgcccccaaaaagaggagaatatcatgtctgacaacacagagacagagaggccacagacaagacttgaccaagtcaaagagagagaaacaggggaaactgaggcagaaaccgagaccaatgaggcactacagagataaactagctgtcggacagactgttgtggagagaaagggggacccaggagagggatcccgaaagctccgtgcctctcttttttcagacgatctctcaggaccatctgacagtgctctccttcctctttgatgcctctctcttgggatactagctgaagctggagagacaccagttagacctaaggaaggacttccctgaggagtaggggcttatggtcaccggcaggagctggggcctcccttccccatcagccctaattgccaagatgtcatggggggaagaggaggggattaagcagacgggtgcccctccccctcccagccaatgtcacctcctggtgcccagtcgagtcccccaccttggccgggattaccctccgagttccaggccatgacaaatgacatcactcccggcccaggcttaaaatctccccatgtgaggggatgtgtttccttcagcctctgctgtctggccgctctgtctaggtcctgggccacgggagagccccgtccctcctttctgaaggtgagcgtctgcaggagaggcggaggggaccgaggaggggagaaaaaagagaggggagaagttgggtttatcttattcgtggctgtgtttgccgtgctctgcaggtgatgtttgctgaatagtcacacacaaaacagaggtgccgtcctggcatttgtggaaacggggctaggctgtgattgcagcaggagggagtaaggttagacagcagggactggctgatggcactcggggcattgggaggattcagggtggcttgtgggcaagggggtcccctcaagccctgacggcatccggggttgggggcttctcaccgtggttctaaggcaactcctcagcataccgctctgttggatgttctttaaaactcttagcactgcctgaaattttcatttgcgcgatgatccacaaatggcctgtctccctcccttgttgagcactgatttttccccagtgcccagcgtgtggttgggatttgcctaaatatgtgttgcatagatggatggatgaatgacagacaagggacggaacagacatatacgcagagagcccaggtctgtggctgcaacaggaagaactccgggtggacttgggcctgcccgagagagccaggaatgtgatgactggggatcactgtgctggtgaattgatcacttagggcctcaatgcacccagaggctctggctttcagcccaggctctacttcgggactggggaatcctcacgcccccgccctcttagcttccagcacagtcactctctctgatcttctttctgcaaagtttttttttgtttgtttttgagatggagtcttgctctgttgcccaagctggagtgcagtgccacgatctccactcactgcaacctctacctcctaggtccaaggagtccatccacctcagcctcttgagtagctggaattacaggcgcgtgcccccatgcccagctattttttgtatttttagtagagatggggggtctctccatgttgtccaggctggtctcgaactcctgacctcaagtgatcagcccgcctgagcctcccaaagtgctgggattatgggtatgagcctctgcgcccagccggtctcctgcaaaactcttgattgacaccttgtttcccgtctgcccctgtcaggagggctgaggccttgtctgtcttgctctcggctgtattcccagtgcttgggtcagtcctagacacacagtgagtgctcagtgaatatgcagggaatgaatgaatgaatgaagggcagaagggtagaagcaggtagacagactgccacagagaggaggtgtgatgcggttttcccaaaaggaacgagcgagggctgtgattgccacagagtgaggtccgacttcagggctgcccactgtgtgtgaatttctggatgcttcagggatcacattgttgatcacggagttgatttgctcaggctctaactgtgccgtggatcccagcttcccccaggtctcatggccggcagtgggtgcatccacccagctccttgtccccgctggacagaggagccaacagaggctgcagagagaggctggagtggctgacaagggagggccctgaatgtggctgagctgggagggtcttgccaagggctggcatgaagccacatgagtctggttttttttttttttttttgagacggagtctcactctgtggcccaggctggagtgcagtggcatgacctcagctcagtgcaacctccacctcccaggttcaagcgattctcctgcctcagcctctcaagtatctgggattacaggcgtgcaccaccatgcctggcttatttttgtatttttagtagagatggggtttcaccttgttagccaggctggtctcaaactcctgacctcaggtgatccacctgcctcggcctcccaaagtgctgggattacaggcgtgagccaccacacccggccgagtctgcgtttaaatcttgttcttttctcactgtgtggccttggacccctcatgtgggctctctgggccttggttgcctcctctgcaaagtggggacaatgataagctgtcaccatgatccagccagatgagccatattgcaggcctggcctgcagtgggagcagggcaggagaccagcctcattctgtttctagggtccctaggtagacttgggggtgaagagcggggctcgggggccaaagagatttaaattttacccctggttcttccactcatcacctgtgtgacctcgggaattgacgaaacctctttcagcctcagtttcctcctctgagaaagggacctctgagctccgtggggctgtggggagcatcctaagaggccatatcgccgggtgatcaggagggcaccggctccggggcaggtgctggcccagctctggctctgccgctgacgtgcgagacagaactggagactacacttctctcagcctcagtttccttctctgtaaagtggggatgataccagaagccgcctgggaggaagtttccatggagttactgttgcctgagatcttgttcccaaggtccatggtgcatgcagtgtgtgagaagctggggccccctggaggtccttaaggtcatcagccacctgaactgtgggcacctccctccctcccaggctcagtctcccccgctgtagaatggagttatctgcatgtctgccccaccaggtggctgtgagcattcagacctcacctgtgggaacaactgctcagctgggaacctgggacccagtgagtgccgaaccccacagctctgagaatcagcctggggcctcccaggttgatccccagggcagagacactgatattctttgttccaccccttgaaatcataaaacatcagtgtctggaaattgttgtcattgtgagatcttgtatataaagcctgggccaagtgtctgccgagtgatgaattcctggacattcttttttttttttcctccccaggagacaggtcctctttcgattgattgattttttttttttttttttgggatggagtcgtgctctgtcgcccaggttggaatgcagtggtgcaatctcagctcactgcagcctccgcctcccgagttcaagagatttttgtacctcagcctccccagaagctgggacaacaccatgcccggctaatttttgtatttttagtagacggggtttcaccacgttggccaggctggccttgaactcctgacctcaagtgatccgcctgcttcagcctcccaaagtgctgagccactggcctggcctgttttgttttgttttgagagaggatcttgctctgttgcccaggctggagtgcagtggctggatcatagctcactgcagcctccaactcctgggctcaagcgatcttcccacctcagcctcccagagtgctgggattacaggtacgtgccaccacgcccagccctcactggaggcccttctgtcatcagctgcctcaggttgctgccaaacccagggaaagatttcagtggatgttcaatattattattgttattattctctgctgacatcttgtctaggcagcactttatcattattatcagctgtttgatctggggcccacactttcctcctgctgagcctcctctcccctatccgttaaaagggatgatcctggccaggcactgtggcccacgcctgtgattccagcacttagggaggccgaggtgggcggatcacctgaggtcagaagtttgagaccagcctggccaacatggagaaacccaatctctactaaaaatacaaaaaaaaaattagccaggcatgatggcacatgcctgttgtcccaggttgggaggctgaggcagaagaatcgcttgaatccgggaggtggaggttgcagtgagccaagattgcgccactgcactccagcatgggtgacagagactccgtctcaaaataacaacaacaacaaaaacaaaaacccagaaagtggtgatcgtaaatgtgagctttcttggctttcctggaaggttaactgcttagccaggcaatctgactcagatttgacggcgaagacaatgaaagtgtgtgcttttgttccaggccctgcaaatggtccccagtggggcaggttcaccagtttccttgtctccactctctggaggttcatatttaacattattggtttttggagaagtgggagaggacagagggaacccaggttagggggctgggggaataggaccttcaggaattactctagccttgaaatcctggattctccactgccagcctgtgtgtgatcccgggtaagtcacactttcgagcctgaagatgttctctaaactgtaagcatcaggcaaaagcagtgtctcatgcctgtaatctcagcaatttgggaggctgaggcaggaggatctgctcaggccaggagttcaagaccagcctgggcaacatggcaagacacctctctctacacaaaaatttaaaaaattagctaggcgttgtggcacacctgtagtcccagctacttgggaggctgaggtgggaggatggcttgagctcaggaggtcgaggctgcagtgagctatgattgtgccactgcactccagcctgggtgacagagtgacatgctgtccctaagaccaaaaccaaaaccaaaatgtaagcatcatagtaatacagtctctacctcccaaggttgtgctggggatttaatgactacctgtatagagaaggcttgtgtattagttaactattgctgggtaacacttatcctaaaattgagcagcttcaaacaataaacatttctgatctcttatagtttccaagggacaggaatccaagagtggcttaactggattattccggctcagggtgttccatgtggttgtggtcagatgtcggccaggactgaagtcacttaatggcttggctgaggctggggaactaacctccatggtagcttactctcatagctgttggcaggaggcctcatttctttgccacatagacctctccgtgggatggcttgagcatcctcacaacatggcggctggctttccttagagctagccttggaagccacgctctgtcatttctgcaatatcctgttggttacacacgtcagccagcttgttagtagggactacacagggcatgaatatcagggggtaaggattattgggagttaccttggaggcagtttgattttggggatttaatgtagctgcttttgattttattgtcagcactgagccttctcgtgacattcctaccaggttttacttgttctttctgcttttctccatgatcaatctgctatggtcacacagggtgccttgtttcttctccaacaagaccaagttggagaccctgtcttgctcagggtgacggtgtgagattccagcctccaagcctttgcacctgctgtttttttaattttttttttttgcctggaaatctctattccagatccacacaaattcctagatgcctcacccaccccaaatgccttcactctcataacaacctgttttattttcctgggagttcttgaaactttctgaaggctttttttttttttttttttttgacagagtcttgctctgttgcccaggctggagtgcagtagtgccatctcagctcactgcaacctccgcctcccgggttcaagcgattctcaagtagttgggattacaggcacccatcatcatgtctggctaatttttgtattttagtagagatggggtttcaccatgttggccaggctgatctcaaactcctgacctcaagtgatcctcataactcagcctcccaaagtgttgggattacaggcaagagcccctgctcctggccatggcatctttattaaaaaaaaaaaaaaaaaaaaaaaaaaaaaaaaaaaggcagggcgtggtggctcacgcctgtaatcccagcactttgggaggccgaggcgggtggatcacatgaggtcaggagttcgagaccagcctggccaacatggtgaaaccccatctctactaaaaatacaaaaattagccaggtatggtggcaggcccctgtagtctcagctacttgggaggctgaggcaggagaatcacttgaccctgggaggcagaggctgcagtgagccgagatcaagccattgcactccagcctgggggacaagagtgagacttcatctcaaaaaaaaaaaatttttttttccttgtttgttattggtttctctaggaacggaaccaagaagttcaattctatgagaacagagaagctgcggtcttatttcttcctatattcctagttcctagagcagggaaggcattcaaaaaatatttactgaatgaacagtagaatctcaacttaaaataaacagaatctgtccccctcctcatgtgagggatgagaaggaaaggacagtgagaggaacggaagagtgggagctcacaataaacaccatccatttttaattctttttcttatgtttcaaatatttattgggggtgctggggacatggcaggaaccgagatattaccagtccctgaactcaggtaactgatagaatttgagggagagagatagataaacaaacatataaatatgtcgtttaatacaagctgtgtcttgaagaaaaggaggtagggagcgtgtgtgtgtgtgtgtaaaatccagtttaggggcgtaggttgctttctctggggaaagtagctgagctgagacgtggaggagaaggggttagctggtgagaggggctttggggtgggggagaggcgttcctagcccaggaaacggcttatgcaaatagctgtggagggtgagaggttttctgagtccatcctaatgagggcaatgaggaaccctcagagggttttcatgttctgtttgcttttttgaagattttattgttgtttttgcttttgacaagaacacacacacacacacacacacacacacacacacacacacacacacacaattaaaaagtaatccaaactatagagacaagatatggctttagcattccttcccagaggcagtcactggtgccagtagcttgcttccttcctgggaattttctacgcatatacaagtgtatattctacacatgagtaaaatcaatgcctcattttgtttattaattcataattataatacttattatttttgagatggagtctcactctgcctcccaggctggagtgcactggcataatctcggctcactgcaacctccacctcccaggttccagagggtctcctgcctccgcttcccaagtagctgggattacaggcatgcaccaccatgcctggctaatttttgtatttttattttattgtatttttatttttaaatttactttattattatgactctttttttgagatggagtttcgctcttgttgcccaggctggagtgcaatggcgtgatctcggctcactgcaacctctgcctcccgggttcaagtgattctcctgcctcagcctctggagtagctgggattacaggcgcccaccaccacgcctgcctaattttgtatttttagtagagacagggttttgccatgttggccaggctggtcttgaactcttgacctcaggtgatccatctgcctcggcctcccaaagtgctggcattacaggcgtgagcaactgcacctggcctatttattgttattattgagacaaggtcttcctctattgcctaggctggtgtgcggtggcatgctcatagctcactgcagtctccaaatcctgggctccagtgatcctcctgcctcagcctcctgagtagctgagactacaggtgcggaccaccatgcctgaccaatttttgtatttttttttttgtggagacagcgttttgccatgttacccaggctggtctcgaactcctgggctcaagcaatctgcccaccttgacctcccaaagtgctgagattataggtgtgagacacagcacctggccatctgcattgttttaaaaatcacaaatggttgcgaggtatacatactgcccagcaccatacttgtttcctttgaatatataaatattataattttataatatttataatatataataacacaaataataataaatatatatggtttggtcatatacaatatataaaataacattcacaaacacttattgtcaaagtgcaattaaatgggaaaaaaagaaaaacatttggccaggtgtggtggctcatgtctgtagtcctagcactttgggaggctgaggtgggaagatcacttgagcccaggagttggaggctgcagtgagctatggcaacgccgctgcactccggcctggatgacagagggagaccttgtctcttaaaaaaccccaaaaaacaaatctgattctctgacgcatatataataagcacaggtcaaagatttatttaagtcatgaatgaaggaaccagctgtttcaaaggagaatttgggccgggtgcagtggctcacgcctgtaatcccagcactttgggaggctgaggtgggtggatcacgaggtcaagagattgagaccatcctggccaacatggtgaaaccccgactctactaaaaatacaaaaattagctgggcgtggtggcgggtgcctgaggtcaggagttcgagaccagcttggctaacaatggtgaaaccttgtctttactaagaatacaaaaaattagctgggtgtggtggctcatgcctgtaatcccagctacttgggaagctgaggcaggagaataacttgaacccaggaggtggagtttgcagcaagccgagattgtgccactgcactccagcctgggcgacagaacaagactccattaaaaaaaaaaaaaaggagaatttgatgaacagaagttgataggtttagtcaggaaagacgggctggagaaaatttgccaggttagatacaaaactggttaaagacctacaggacaatacaactgtaacctttgaggttaccttttctaccagagagaaatcatttgcaaccaaacttcctggggttaccatttaccttgtcgaagtctagactctaatcaataatgaataacagaccgggtgtagtggctgacgcctgtaatcccagcactttgggaagccgaggcaggcggatcacgaggtcaggagttcgagaccagcctggccaacatggtgaaaccccgtctctactaaaaatacaaaaattagccgggcatggtggcgcatgcctgtaatcccagctcctcaggaggctgaggcaggagaatcgcttgaacccaggaggcagaagttgcagtgagccgagatcgcgccactgcactttagcctgggcgacagagcaagactctgtctcaaaaaaaaaaaaaaaaaaaaagaatagtaaatcaaatacaggtacagtcccttagaatagggtccccaacccccggtttgtagtctgttaggcatggggttgcacagctggtgagcaagcattactgcctgagccccgcctcctgtcagatcagcggtggctctagactctcacaggaacgtgaaccctattgtgaactgcacgtgcgagagatctaggttgtacactccttatgaaaatctaaggcactgcccactcccatccatggaaaaattatcttctacgaaaccagtttttggtgccaaaaaggttgaggactgctgccttggaatatgaagcaaactttgggtgggtctgttagacaagactcccagatgacttggaaatggcatgctgtcagctttttttgtcttattgccgagcctagaactttttttaatttttattttttttgagatgaagtcttgctcttgtctcccaggctggagtgcagtggcacgatctgggctcactgcaacctctgcctcccgggctcaagcgattctcctgcctcagcctccagagtagctgggattacaggcgcctgccaccacgcccggataatttttgtattttagttgagacgtttcaccatgttggccaggctggtctcgaactcccgacctcaggtgatccgcctgctttggcctcccaaagtgctgggattgcagatgtgagccaccacacctggcccctagaacaattttttaaaactatataatggagatcttttaaaatcagttcagagagcagccttatgttttttttttttttttttgagacggagtctcgctctgtcgcccaagctggagtgcagtggcttgatcttggctcattgcaacttctgcctcccgggttcaagcgattctcctgcctcagcctcccgagtagctgggattacaggcacgcgccaccatgcccggctaatttttgtattttctgcagagacggggtttcaccatgttggccaggctggtctcgaacttctgacctctggtgatctgcctgccttggcctcccaaagtgctgaaattacaggcatgagccactgcgcccaggcttactttaaaaaaaaaattaattttttgtagagacaggagagtttcgctatgttgccacctgaacataaatgctattttctttttcttttcttttcttttttttgagacggagtccgtagcccaggctggggtgtggtggcaccattttggctcactacagcctccgcctcccaggttcaagcgattctcctgcctcagcctcccaagtagctgggactacaggcgtgcacccctgtgcccagctaatttttgtatttttagtagagacggggtttcaccatgttgaccaggctaatctcaaactcctgacctcaagtgatctgcctgccttggtctcccaaagtgctgggattacaggtgtgagccactgcgcctggcccataaatgcgattttcattcccattttccaacaaggcgactgaggtatacattgaaggtgaattactaggacaaaagaaagatggcattttacttcaataacagtttgttacaacctgtactgctacctatctgccatgggagtgtgcctttccccacactgacaccagtgctggaagttatcaacctccttcatctttgccaacctgataggtcaaaagtgatcatggaagatccacactcgctttttttttttttttttttttgagataggggtctatttctttttcttttttcagagatggggggtctcactatttctttttctttttttcagagatgggggtctcactatgttgcctaggctggttttgaacttctgggctcaagtgattctcctgccttgacctcccaaagtgctgggattacaggtgtgagccgccttgcttagcccttactgtcgtttttttgtttgtttttgtttttgtttttttgttttgttttgttttgtttttgagacagagtctcgctctgtcgcccaggctggagtgcggtggtgcgatcttggctcactgcaacctctgcctcccgggttccagtgattctcctgcctcagcctcccaagtagctgggattacaggcacccgccaccacacctggctaatttttgtatttttaatagagatggggtttcaccatgttggccaggctggtcttgaacttctgaccttaggtgatccatccatctcagcctcccaaagtgctgggattacaggcgtgagccaccttgcctggcccttactgttggtttaatgccactctcccttagggtgaccaaccaatccagtttgcctgggaccattctggctctagcactgaaagtcctgtgttccaagaaacacccacctctcctccaacctgggcaaagagggacggttggtcaacctgcagtcctgggttataagtgaggctgagcgtgtttgcccatggtcaagaaagaagggatcttggatgagggtgtgtaacaggatcagatttgttttgtttttttcttagagtcttgctgtgtcacccaggctggagtgcaatggcctgaacacagctcactgcagccccaaactcctgggctcaagtgatcctcccacctcagcctcctgggtagctgggattacaggcatgcatcaccacacccagttaactttttaaagaacactttttttttttttttaagagacagggtcttgctatgttgctcaggctggtctcaaactcctgggctcaagtgatcctcccgccttggcctcccaaagtgctgggatgacagatgtgagccattgtgcctagccaggacgagatttttagagggtagagtaggaataagagcttgcacttatgaggcacatgatggcttcagctgtctgctttgcagagtctcaagaaagctctgagaaccttaagcagaggccattttacatgtgaggacacagaggtacagagaggtgagataaatggccaaggtcacatacctaagaggagaaggaggcaggatttgaatcgcagcctgcacgtcaccccatggtgagtaactggtaagtgagtgagcatccctcctcttctcttgcaggccccctgacttgggcctcagtgtccccgaagatcatgatggcgtatatgaacccggggccccactattctgtcaacgccttggccctaagtggccccagtgtggatctgatgcaccaggctgtgccctacccaagtgagtacagtcgtttctcttggcaccccaggctggcctcatctcttggaggacctctggggtccctttgcccccaggaagaaggcaatcacaggggcgacttcagggccatacaccagccctctgggttcatctgaaatgtatgtcacttagaaaaacattagcagtcctagaaattcaggacagaggttccttttggggtgaggaagaggggatgtaatctggaaggggaatcaagaggaattttcatctgttaccaaaactttattatttatttatttttcagagacaaggtctcacactctgtcacccaggctggagtgcagtggtggtggtcacggctcactgcagcctcgaactcctgggctcaagcaatcctcccacctcagcctcctgagtagctgggactgcaggtgtgagccattgtgcctaggcccggggggcactttttttttttaattttatttttgagacagggtctcactctgttgcccactctgaagtgcaatggtgcaatcacagctcactacagcctcgaactcctgggctcaagcgatccttttgccttggcctcccaaatagctaggattacaggtgcacgccaccatgcctggctaacttttttaagtttttgtagattttgcaggatctggattatacaaaacatagaaaaaattattattatttttttttttgtagagattgggtctccctatgttgcccaggctggtctcaaactcttgggtccaaataatccgcctgactcagcctcccaaagtgctgggattacaggcatgagccactgcacctggcctgcaaagccttatttctttttctttttttttctttcgagacacagtttagacggagtttcgctcctgcccaggctggagtgcaatggcgcgatcttggctctttgcaacttttgcctcccaggttcaagtgattctcctgcctcagcctcccaagtagctgggattacaggcgcacaccaccatgcccggccaatttttgtaaagccttatttttaagagaagtgagtactcagttatttgtagcattattctttagctcttgtttttttttttttttttttcaagaccgagccttgttctgttaccaggctggagtgcagtggcataatcttggctcactgcaacctctgccttctgggttcaagcgattctcctccctcagcctcccgagtagctgggactacaggcatgcaccaccacacctggctaattttttgtatttttagtagagacaggggttccccatgttggccaggatagtctcaatttcttgaccttgtgatctgcctgcctcagcctcccaaagtgctgggattataggcgtgagccaccgcacccagcccagacttgctacttttataggctagaaacggttgaatgtcagcaatgtcatgcttcaactgattatgtcttagtgcataagaaagtttagaagagggaaaaacgactcgcacacctccttgttgagctaaagccttggggtcaggcatgagccacagagtgccaggcacacagtgaggtgtagaagggcagggaatgtgtattccatccttagtttaggcagatggcaaccaggatggaattcttggcatcccacccagcctcagggcctcacaccagcccatgtggatgacctgagggtcctgtttcccatcccaccccaggcgcccccaggaagcagcggcgggagcgcaccaccttcacccggagccaactggaggagctggaggcactgtttgccaagacccagtacccagacgtctatgcccgtgaggaggtggctctgaagatcaatctgcctgagtccagggttcaggtggggtggtgggtccctggacccctcccgacacttcctgtgatctcaggaggcctgcccggaacaaagagtgatgggaggagggagagatcacagagtgacagccaaagttataaaggggacaataatccctctccccaccatcccactgaccgcctcatggctctcattgcccctcgctcctctccagctgcgctggccctgacctgcctgccaagcaccctcctgccttgggcctttgcactcagtttcctctatctggaatgcttatttccagataaccacacagcaggccccatcgccttgttcgagtctttgcttatccatcagtgagacccacactgaacacagcatttaaaattgcatatgatttacatatggtatctcagagtctgtttatttagactctgtctctcccaactagaatgtcaattccactgacggacactcagagtagtagaaaatggttaatacatgtttattaactgactgaatagacggatggatggatgggtgggtggatgcatagatgaatgtatgtatgtgtgactgtaggtgtgcgtgtgcatgtatgactggaagcatggatgagtgtatgtatgtgtatatatgagtgtctgtgtgtatgatgggatggatacatgtatatatgtgtgtttgcatgaacgcacataggtatgattagatagatgatgaatgtatgcatgcatgatatatgtatacgtggtgtatgtgcacatgtatgtatacatgcttgcatgattggatggatgggtatatttatttatttgaaatggagtctcgctctgtcgcccaggctggagtgcagtggcatgatcttggctcactgcaacctccgcctcctgggttcaagtgattctcctgcctcagcctcctgtgtagctgggattacaggcgtgtgccaccacaccgggctaatttttgtatttttagtagagatggggtttcaccatgttggccaggctggtctcaaactcctgacctcaggcaatcctactgcctcggccttccagagcgctgggattacaggcgtgagccaccgcgcccggccggatgggtgtatttatgtatatatgagtgtatgcatgtatatatgattggactgataaataaaatgtgtgtgttagtatgattgtatataggtatgactggatggattaatgtatatgtatgcatgatgtatgtgtgtatgatgtatgggtgtataattgtatatttgtatgtttgtataatcagatggatggatgaacatgcatatgatgtatgtatgattagatagatccattaatgcatgtatgatgtatgtgtgtatgacctatgtttatataattatatgtataagatggatgaatctatgtatgatgtatgtgtgtacaattgtatgtatcatcagatggataagtctatgtatgatgtatgtatgatcagatggactggtgaatgtgtgtatgacatatatatgtgtgaggtatgtatatatgatcagatggatgtctacataatgtatgtgtgtatggtgtatgtatgtataattgtatgcgtgtatgtttgtatgctgtaggtatgatgttacatatatgtgcatacacacgtgtgtatgattggaaggataaatgaaatatgtatgtttgtgtgattgtatgcacatatgattagatagattagtgtgtagctatgtatgctgtatgtgtgtacaatgtatgtgcctataattgtatgtttgtatgtctgtatgatcagatggatgaatatgtatatgatgtatgtatgatcagatagctggataaatgtatgcatgatgcatgtgtgtatggtgtatgcatgtataattgtatgtatgtttgcattagatggataaatgcctgtaggtatcatgtatgtacgcatacatgcatgattggatgactggatgggtttatttgtgtatatatgagtgtacgcatgtatatataattagatggataaatgaaatgtgtgtctgcatgattgtatgtatggattaatgtgtatatatgtatgatgtatgtgtgtacaatgtatgtatgtataattgtatgtttgtatgatcagatggatggatgaatgtgtatgatgtatatatgtatgatcagatggctccattaatgcatgtatgatgtatgcgtgtatgatgcatgtacacttgcatgtatgatcagatgagccagtgaatgtatgtatgatgtatatgtgtatgatgtatgtatgtatgatcagatagatgggtaaacgtatgcatgatgtatgtgcgtatggtgtatgtatgtataattgtatgtgtgcatgtttgtattagatgggtggatgaatatgtgtatgatgtatgtatgatcatatagatgggtaaatgcaggcatgatgtatgtgtgtatggtgtatgtatgtataattgtatgtgtgcatgtttgtattagatggatggatgaaaatgtgtatgatgtacgtatgatcatatagatgggtaaatgtatgcatgatatatgtgcgtatggtgtatatatgtataactgtacgtgtgcatgtttgtattagatgggtggatgaatatgtgtatgatgtatgtatgatcatatcgatgggtaaatgcaggcatgatgtatgtgcgtatggtgtatgcatgtataattgtacgtgtgcatgtttgcattagacggatgggatgaatgcacatgggtatgatgtatgcatgtgttcatgcacacatgcaggtatgattggatggatagatggatggatgggtgaatagacgccccacagctggatgcaaagtagacagatgtgaacccagcacctctcaccaataagtgtcctcatccccgggcaccctgcggctctcctgggcctcttccccacttacccacccccatctccgctcttatcccccaggtttggttcaagaaccggagggctaaatgcaggcagcagcgacagcagcagaaacagcagcagcagcccccagggggccaggccaaggcccggcctgccaagaggaaggcgggcacgtccccaagaccctccacagatgtgtgtccagaccctctgggcatctcagattcctacagtccccctctgcccggcccctcaggctccccaaccacggcagtggccactgtgtccatctggagcccagcctcagagtcccctttgcctgaggcgcagcgggctgggctggtggcctcagggccgtctctgacctccgccccctatgccatgacctacgccccggcctccgctttctgctcttccccctccgcctatgggtctccgagctcctatttcagcggcctagacccctacctttctcccatggtgccccagctagggggcccggctcttagccccctctctggcccctccgtgggaccttccctggcccagtcccccacctccctatcaggccagagctatggcgcctacagccccgtggatagcttggaattcaaggaccccacgggcacctggaaattcacctacaatcccatggaccctctggactacaaggatcagagtgcctggaagtttcagatcttgtagaggacgcagtctccatctctctccatcgggcctcgggaccctttctcttctgaatctgcttccctgcagtttagatcccgggatggcattcctgagaaagcaacccgaaccagctgtccttctgacagctcggtgttcagcttacagagaccacccctttcctccacagggagaggctcctccctctcctgggacagctcacaggtcctagtgattctctcaaccctaacaccgtctggcacgattgtgaccgctgaagtacaccacgagctccaggcttcagaaagtggtgctgagaacttgctccaagaagaagtcaaaccaaacttgcagttgatttggggtcatgtttaggtcagaatcaccgtgcccttgaacaagcaggtaggggggcttgataacttaactttccacgtggacagaatttttttttttgttttgtttttgttttgcagacacagtctagctctgtcgcccaggctggagtgcagtggcacgatctcagctcactgcaagctctacctcccgggttcacgccattctcctgcctcagcctcccgagtagctgggactacagatgcccaccaccaggcccggctaattttttttgtatttttagtagagacggggtttcaccgtgttagccaggatggtctcgatctcctgacctcgtgatccgcccgcctcggcctcccaaagtgctaggattacaggcgtgagccaccgcgcccggcccttttttttttttttttttttaattgagacggagtctcactcttttgcttaggctggagtgcagtggtgtgatctcagctcactgactgcaacctccacctcccgggttgaagcgttgctcctgcctcaatctcccaattagctgggattacaggtgtgctccatcatgcccggctaatttttctattattagtagagacagggttttaccatgttggccaggctggtctggaacccctgacctcaagtgatccgcctgcctcggcctcccaaagtgctgggattacaggcatgagccattgtgcctggccctacacgtggacacttctttagcatatggttagggacctttctagaaattccaaagacagactttaagaagccccgtcgggaaaccttaggccaatgatgtggttacattaaaaataaattatctgggaatttcacagacttcacaaatgtcaggcttacatggtaggtttaggggaccgtttgagagacaaagatctacattcatatatgtagctatacatatatgtactttttcttcttagtttctttttaaagacattttatcactcattcgctcattagcacattgggaatgtgtgtatttggtagggaaatgaaaggcaccttgcctgttccatctctactccttttttcttttgttttaggattttctaaaggtgagacactggtggaactggggtagctgcttgggacgtaccacctatagttgtggctatttcacagagaagcagcagctagacagactcccatctgtaaataaacaagagataggaagagggggaaatagatttggaggaggcagccctacatttcaaacatacattcccttttttagatttttttttttttttttttggttttcagttttgatggtgggattggaaaatagagcttggcttgaggacattttcctggggtggcaccattatttcttgaaatagaatcttacttatggtgacactggcaagcacttgtgagaacctgaagacggattgaggtcatttgatgctcagaagttgggtgctgggtccctgccttctcagtccgagttctcctttcatttttgggtggggaggcgggttccaagagcccttcattggtggagttcacaaggcaaggtgtaaaaaaaaaagtagggcaggaagacagtggtgtgctggcagaggtctaacaatgggctctccaaggaagaggaaaaggttggttgtggagtgtttgtcagtttccgtggtgtaaatactcccaccacggctgacttcaagctagcaaccggaggtcactgaactaagagttgggaagagatagggcacaatatatgcttacgagttggtacacaccgtcagcagcagccagggtcaggagaaaggcgagatgtgaagagaggccgggaggtatcagatgacgtttccagcactagaccagaagaggtgcacacagcctagaccccctgaggggtacaccctgatctctagagcccacaaagaggtttttattcaacataaaacgtgttcatctctcataggcctgagtcatgctgggttctgggacattaagcccaggagtgggccgggtgcggtggctcacgcctgtaatcccagcactttgggaggccgaggcgggtggatcacctgaggtcaggagttcgagaccagcctggccaacatggtgaaaccctgtctctactaataatacaaaaattagccgggcatggtggcacgcgcctgtaatcccagctactcgggaggctgaggcaggagaattgctggaacccgggaggcggaggttgaagagagcagagattgtgccactgtgctctagcctgggtcacaagagcgaaactccgtctcaataataacaacaacaaaaataacccaggagtggctcaagagtccagtgtgggatgaaaatataaacagaggaagacaacatatgtcactggggaggctgggggagctagacaaaattcacacgggaggggcagggatgagacaatattgtgccctgggtctgtgcaaacgttgggaccagaatccactataagtttcattcttcggagacacggaagctctgcactggaggccgggactcaggcgtggaagagaatcttctccttattcaccggggaggctgtgtcttgtgcaaacaagtcatagaaacttgatgggagttggggagggactgaaggatgcatgcaaggttctgggaaggagtgagaagtagtgaaggccaaggggcccccatcacaggccgatggggtaagacttcgagagagcctgatcctggggtcttctgagactccaccaggagccggagagggcagggagccaaatccagctaggaggttacagattgcttttcctgggctgggctcctgagtgttggttcttccagctgtgcacaggggatttcaaacgttctacgtcctaaagccaggaagagtgacaaggcaggtggggacagaaggaagaagccaggagcctccctgagaaggtgtcaccttatctgtcctcctcttccccacacactggcctctgggtcccccttctctgtccacccacagagtgaaaccaattaaaatgttggatctcatttaaa

SEQ ID NO: 197 - DNA, 33570 bp, Homo sapiens
  source 1..33570: mol_type = genomic DNA
gggtcacgtggtggctgggccggggaaatggcggcttcaggagagagcgggacttcaggcggcggaggcagcaccgaggaagcatttatgaccttctacagtgaggtgaacacagagtgaggagtagtggcaccggggcgaccgctcccggatctgctttcccagtggacaaaggcagtggccgcctggcctggaccgttgggcgattccttcagtccagtcttcggggtggcgggggtctgggggtgtgtgagcgtctcccactgatagctgctgggagatcccccggggcaacgaaagagggaatggtgttcgatctatcgagggaggtggcgagtgtgtccaacatagtgcgggcgcgcgggcagagtgccccaagtccgcggagtcgggggctggcagaggctgggcccttcctgggagtgacttagccttcttggcccccgagacgtttcttagtcctttgtaatgagttgttttagtggttgtttctgccattcacgaacgccaggcactgtgtatcatgccagttaggcattatattacccccattttacagatgacgaacctgagctttagggaggtgaaatagtttggggccttacagtaggttacagcttgcttggtggtatgttaggacagcagtgggcttgttctgagcctcctttactatcgcatctccagcgcatagtatgtagtggatgctcagtaaatatttgttgagtgaatgaatgaataaatgaaataaaagcatgccgtttggagtcagaatctcagattaaattattgcaaggggctgggcacagtggctcacatctgtaatcccagcactttgggaggcccaggcgggaggaacccaaaagctcgaggctgcagtgacctatgatcggaccactgcactccatttttggcgagagtgagaccctgtctctttaaaaagaaggaaaaaaaggatagaaaaaaaaattcttggttgggcgcggtggctcacgcctgtaatcccagcactttgggaggccgagacgggcggatcacgaggtcaggagatcgagaccacggtgaaaccccgtctctactagaaatacaaaaaattagctgggcctggtagtgggcgcctgtagtcccagccactcgggaggctgaggcaggagaatggcgtgaacccgggaggcagagcttgcagtgagcagagatcgcgccactgcactccagcttgggtgacagagcgagagactgtctaaaaaagaaaaaaattcttggaagacagttaacctgactggactgggattgaattctttttttttttcctaaggcggagttttgctcttgttgcccaggcctggagtgcagtggcacgatcttggcccactgcaacctctgcctccctggttcaagtgattctctcgcctcagcctcccgagtagctgggattacaggcgcctgccaccacgcctggctaatttttgtatttttggtagagacgggggtttcaccatgttggccagactggtcttgatctcctgacttaaggtcctcccgcctcggcctcccaaagttgctgggattacaggcttgagccaccacgcctggccgggattgaatttgttcaagacattaattttgcagatcttcatattccacatctgtaaaaacaagagagttaatttaatttaatttatttattttgagacagagcctcactcttgcccaagctggaatgcacaacctctgccttctgggctcaagtgattctcccacatcagtagctgggactacaagctcaggccaccatgcctggctgatttttgtattttttttgttgtgacagggtcttgttgtgttgcccaggctggtcttaaactcctgggctcaagcaatcctcccgtcttggcctcccaaagtgttgggattacaggcatgagccactgtgcttggcaagagagttaattttaaaataaacattttcatgaggactaaagttattgtataagaaagcgtttcataaaaaaataaagcagaagcatctttctcagggttaaacaaggcagaagatgggacctctgtagggtggcatgggtttgaggaatggagttgccccccagcaggctgtgagctattcagggttaaggaccatatcacatccatcttttatttcttgcaattgtaacagtacttgttacatagtagtttctccaaagtattacatttaggtctagacacctggcaggcactgcctgtagtctcagctgcccggaaggctgaggcaagaggactggaggatgacttgagcccaggaggtggaggttgcagtgagccatgatctgtcttctgtcactgcagtacaccctgggtgacagagcaagaccccttctcaaaaaacaaaaacaaacaaaaaaccaaatggcaacctttgtttgaattggatgggaaaaaatatctaaggaagggtaattcagtcatttttttaaaaaatagagacaaggtcttgccatgttgctcaggttggtcttgaattcctgcacccaagtgatcctcctgcctcagactcccaaagtgctgggattacaggcataagccaccacactggcctcattcatttaacagatgtttattgaacattggaaatgtactagtttgctatttaggtgttgaggatacggtagtgaacaagagagaaaaaaaatcctgttttcatagagtgaagagggaagatgtctagaaggaatgactttttatgttaatgaaattctttccaaccttgttttggctataggaataaagatggcatatagcataccagagattcattccaactagcattccaactctgacagtgacaccaagaatgttttcctgggactgcctggtgcttgttctccctggcattgtcttcaggtcagggatttttcttttttctttctttcttttttttaaattaaaaatagagatggggtttcgccatgttgcccaggcttgtctcaaactcctgagctcaagcaatccacccacctcagcctcccaaaatgttgggattacaggtgacagctactccgcctggccaagtcagggattttttctaacactattagaattaggtggtggagttgtttgttccttcccatcaacagttttaaatgctgctcatagtttatgtcttactgtgattgtatttttcctttttttgctctttaaatttttttctttattttttttcctcacagagaaatctcttactttttttttttcttttttgagacggagtctcgctgtgtctcccaggctggagtccagtggcgcgatcttggctcactgcaacctctgtccctggggttcaagcgattctcctgcctcagcctcccaagtagctgggactacacgccatgccaccatgcccagctaattttttgtatttttagtagagacggggtttcaccatgttggccaggatggactccatctcctgacctcatgatctgcccaccccccagcctcccaaagtgttgggattacaggcgtgagccactgtgcccagcctattttttttttcttaaaattaaaagctataaatgaagtataatcacacacaagcacatcttccatcattaaagtggaagttctttaaaggctgtgacttatttatctttgaatcctcttgatgcctgctgtggggtcaaactgttggggttaaaattctggcttacaagttgggtaattgggaacaagtcagttaccttctctaagcctcagtattcttatctgtgaattgggtataacagcagtatctaccacatagggttgttgagattaataaatacatgtaaggtttttatattaaaattcaacaaatggtagttttaatttctcaaagcatttagcaaaatgtcttgcacatggtaaacacacaaataaatgtttgttgaacatatcagtgaacattttgttaagataattcagtttgttattgaattctattaatgaagtttttaatcctcataattttaggtgaaacaaatagagaagagagactcggttctaacttcgaaaaatcagattgaaagactgacccgtcctggttcctcttacttcaatttgaacccatttgaggtgagccgattgatgttgctagggcctctgtaatgggggagatttgcatagctgcaggcatacctacatcagaatacatacctaatttatatcatagttaggattgagaaaaatggtggagtaaagtgatggaatctgtatagtacaaaattgagtattccttatccaaaatgcttgggaccagaagttttttggattttggatttttttgggattttggaatatatacatacattctgcttacttactggttgaagcatcccaaattagaaaattcagaatgttaatgagcattttctttgagcatcagttgactctcagaaagtttcagattttggagcattttggattttgcatttttggattagggatatgtaacctgtatatagattgtctttaaacttgggtgattgtaccgagcagaactggagagacagcatgttaaggaaagtgagatggtcacatatctttcatcatcttttagcaacccaaatatataaggatttaatttcagatgtgaaggggtggctagctctaataagtttaggattctttttttttttttttttttttgagacggagtcttgctctgtcccccaggctggagtgcagtggcgcgatcttgacccactgcaacctccttctcccaggttcaagcaattctcctgcctcagcctcccgagtaggtgggattacaggtgcccaccactgtgcctggctaatatttgtattcttagtagagatggggtttcaccatgttggccaggctggtctcgaactcctgaccttgtgatccacccgcctcagcctcccaaagtgctgggattacaggcgtgagccactgcgcccagcctaggattcttgatttaaactacttgttaaaacttctgtttcactataataaatgccaaaaacccaacaacaacaaaacaaagatcacaagattttagataaatgaatatactttttgattttcttaattttatagctttaaacttttcctggttataaaagtaaatcatatttgttgcaaatgtacagaaagcaagaataatcatatataatcccacctaagagaaatagccactcctgtttacactcaaactgttttgcttaaaaacagggagcatcatacacttaatccttcttcttcttcttcttctttttcttttttaaagagatggggcctcattatgttgcccaggctggcttagaactcgtgggcttaagtgatctccttgacctgctcagcctctggagtagatgggattacaggcatatgacaccacacctggctcagctcaatacgattttattttattttatttttttgagacagggtctcactgtcacccaggctagagtgcagtggtgcaatcatggcttactgcacccttgaactcctgggttcaaacgatttgcccaccttgggctcccatagtgctaggattacagccattcgccaccatgtccagcctcagtgctgttttaaatgcttttttttttttttttttgagatgaagtctcactctgtcacctaagctggagtgtaatggtgcaatcttggctcactgcacctccgcctcccagattcaagtgtttctcttgcctcagcctcccgagtagctgagattacaggtgcctgcctccatgcttggctaatttttgtatttttagtagagacggggttttgccatattgttcaggttggtctcgaactcctgagctcaggcgatccacctgtcgcggcctcccaaagtgctaggattataggtgtgagccaccgcgcctgtccaaaaaaaaaaaaaaaaaaaaaagagagagagagaaattctttttttttttttgcaatgcttgacaagatgttaaatctgttaacatctttaatcataaatgaactcttcagaactcagtacagactaacattacacggaaagtgaaaataaaaggaacagaggaaaatggaatagtacaaatgagttataaggctatatgaagatgatatatagttaatactaatagttgagaaagcaattttattataaattacattatttgtgcttacaaatattgatatctgatgttggtacagctttagaaaatgaagaattctcaaatactgaggaaacttactctagtcatgaggagtttactcaaaaatgtagatttgtgcataaatttggccccagcagttccaaaccacagcaatcactccaacaaagtagttgggtacacacacatatacatacatgtttactacacaatagatgtgtaagtaatatgtcaccccccaagaaactttttatgaactggttataaaataatagactggggggtaaaaaaaattccatataatttatttaatcatttctttattgtggaatagtttagctagtttatttctttctaaaatttttttttttgagatggagtctctgtcgcccaggctggagtgcagtggcgcaatctcggctcaccgcaacctctgcctcccgggttcaagcgattcttctgcctcagcctcccgagtagctgggactacaggcatgtgccaccacgcctggctaatttttgtattttttgtagagatgggtttcaccatattggccaggcttttctcaaactcctgaccttgtgatctgcctgcctcggcctctcaaagtgccgtgattacagacgtgagccaccacacccagatctttaaaaagtttttttaacaggcggccctctgaaccagaataggttcagagagactccctaaactactttctaattgttcacatttacaaataattttgaagtgaatatttttgtatctgttaaataatagaaacaacacttattgggcacttagaaaaaaactcccctcacttttttttattgtggaaaaatatatataacataaaatttgccattttggccaggtgtggtggctcacgcctgtaatctcagcactttgggaggccaaggtgggaggatcactttaggccaggagtttgagaccagcctggccaacatggcgaaaccccatctccacaaaaataatacaaacattgctgggcatggtggtgcatgcctgtaatctcagctacttgggaggctaaggcccaagaatcacttaaacccaggaggcggaggttgcagtgagccgagattgtgctactgtactccagcctgggcgacagaacgagactgtctcaaaaaaaaaaaaaaaaattaccatttaaatttttttttagttttacaattcagtggcattaagtacattcacagtgttgtgtaaccatcaccactgttcatattcagaaatttttcgtcaccccaaccagaaactctgtatccactaaacagtaactcctcattttctccctgacccctggtaacctctactctactttgtctatgaatttgcctcttctaggaaacccgtgtaagtggaatggtaccgtatttgttactttgtgtctggcttatttcacttagcatgatattttcaaggttcatctgttttctgttttttgaagagtaatttttcaagaattttttcatttataaataatctcagattaacaaatatttcaaatacaatatgaagacttttccttgaactctttaagagtaaattgttagtatgatggtccatcaccctgatatactttaatgtgatttttctacaaatatcctcttactgaaccacaatataaactatcaaaatcaggaaatgaaccctgatacattgttactatgtaaatcatcagaccccattcaaattttactaattgtcccaaaaaagtctttctcagggcctctctggatacattgttactatataatcatcagaccccattcaggttttactaattgtcccaaaaaggtgtttttcagggcctctctatcactccgctcactgtatagctcactgcaacctcgaactcctgggctctgggctcaattgatcctcctacctcagattttcaaaatactgggattcaaggtgtgagccactgtgtttggctctttggtttgtttgtttgtttcgtgacagagtctcactccactgcccagactggagtgcagtggcgcaatatcggttcactgcaacctccgcctcacgggttcaagtgattctcctgactcagcctccctggttgctgggattacaggagcgtgccaccatgccctgctaattttttgtatttttagtagagatggggtttcaccaagctggccaggcttgtctcgaactcctgacctcatgatccgccctcctcagcctcccaaaaagtgctgggatttcaggcgtgagccaccacacctggcgtgtttgttttgttttgtaagatggggtctccctggccaggcgcggtggctcacacctgtaattccaacactttgggaggctgaggcgggcagatcacttgaggtcaggagttcaagaccagcttggctaacatggtgaaaccctgtctctactaaaaataaaaaaattaaccgggtgtgatggagtgcccctgtaatcccagctacttgggaggctgaggcaggagaattgcttgaacctgggaggcagaggttgcagtgagccgagattgcaccattgcactccagcctgggcgacagagtgagactccatctcaaaaataaaaagaagtgtcatgaggttactatttttcccctttgtaatgaataagtattttatgtggaggtgctttgaaacttggtaaatatcctgtccatatcaaaattttagttcatttatttgccagtatggacttaggtttttctattttattcagtacgttgtaattttatgtttattttgatgctcagattgtctcaagtttggccagtgggttacctttcaatctagctcctgtgtctttcatatgtcttcatcattctttgattagtaggcacttttgtgtttttcctgacccagcctggaattaaccatttcaccaaggagcgctggttccttttggcagagaatgatatatagaaatcaagatttgaatgctaggtagattcattgctgttgggatatcacagcttacagaccctggagtctgtgtgtttgtgtgtgtacatatatgtttacacccaacatccattttcagtccaaccccacaggatttattctaatagttagaaacctggttcccactatcttttctttattattattctttttttcttttttttttttttgtaaagacaaggtctcactatgttgcccaggttgatcacaaactcttggcctcaaatgatcctcccttggcctcccaaagtactgggattgattatagcattacagccagtgcacctggcgctggctcctacagaatttaatatctacatttacttaattgatctctctgtatgcaactaacttcccactgccactccttccctctgaatgctctcctcaccccgctgtactctgataccagcaccaggatatgtctatgcaaaaacctttctcaccacacctgggctctgaactcccatgtcaggccacccttccatgtggctctctggctttctgagcctgctctcttcctgctgggggcccttttcactgatcatgggctccagcatcccacactgatcctccccgctgagtaggcatcttccctaccctgctctggctttgacatcctccgtcaagccaccttcttccatgaacacctttctcctcttactcggggtctggctccacataccatgtctcttttcatattttttgggctctgaaccttgtgttgggctgccttttcacactggatgccctactacttggacacccttctcaccataccaggcttccataccccatgcttggctgccctttgtgggaatgtccttgcttgggttcttgtaccctgtgccaggctaccttcccctgtggacaccctccgtaccttgcttggtctcagacaccctgtgttggattctacttccacacggatgctttcctcatccctcttgggccctgatatcctgcgctggctgccctcccatgctgacattttccccctgcttaggttctgatgttcctgtgctggcctccctgtctatggggatgcctttctgaacttctttgtacaccatgttaggctgtccttctctgtggatgcccttctcaccccatttgggcttcagcaccctgtgactagccactactttctgtgtggtcactgccttccttgttccaggtgggctctgacactgtgctctgggccatgtgactcccacccagagtagacgtctgttttgcctgaccccacttaatggatttggatttattgcttaggaagggaagggggagataaaaagcttgaagattactttttttttcaatttttaaaattgtaaaatacacataacataaaatttaccatcttaaccagttcattttttttttttttttttttttgagatggagtcttgctttatcacccaggctggagtgtagtggcgtgatctcggcttactgcaacctccgccacctggattcaagcaattctcctgtctcagcctcctgagtagctgggactacaggtgcatgccaccacatccggctaatttttgtatttttggtagagatggggtttcaccatgttagtcaggctggtctcgaacgcctgacctcaggtgatccacccgcctcagcctcccaaagtgctgggattacaggtgtgagccactgtgcccagccagttcattgtttttaaatacactcatagtgttgtccaaccattactattatccatcctcataactcttttcatcttgtaaaactgaaattgtatacccattaaacaataattccgcattcctccctccccagcccctggtaaccaccattctactttttgtctctatgactttgaccaagtacctcatataaaaggaatcatagtgtttgccttttcgtgactggcttatttcatctagtacaatgtcttgggttcttcaatgttgtagcatattgtagaatttccttctttttaaggctgaatggtaatctgttgtatggatataccacattttgcctattcattcatccgctgatggacatgggttgttctacatcttagctattgagaaaagtgttgctataaacatggatgtataaatattgaagagtacttttgatatgattttggggagggcctaggggaagatgatttgctggagagatgataaagaatttatggtatgttctttctatctagccatactttaaaatcgagcatagtaccatgaaagggaacatatgaccatataatttattttttgttaaggtaattagtatctcctgtggggacctgatggatgagaagggacagattgttgggcatcagtgtgaaacgctaggattttagtgccctattagttattgtagttctgaaagtggaactcattgccctgtagcctttgttctcactataggaagtatgtttagatgtgtgacgatatggtgagtttgcacgctctgaaagctgcaagattgtgtttgagtgggcaggactccctgactgttctttctttctttgtttctttctctttttccctttttgagacagagtttccttcttgttgcccaggctggagtgcaggggcacgatctcggcttactgcaacctccgcctcccgggttcaagcaattctcctgtctcagtctcccgagtagctgggactacaggcgcccgccaccacgcccggctaattttttgtatttttcatagagacggggtttcactatgttagccaggatggtctcgatctcctgacctcgtgatccacccgcctcagcctcccaaagtgctgggattacaggcgtgagccaccgcgcccagcctggattcctttttcaagcagaagatcctaaaggagatggctgttacattttgagttcaggaacttatctgaatgcaacagttaagcatttttgtttctgtgtgatgattaattagctccctgaggttcaaaactgtgggtctctccctccatatcctaaaagcctgagacgcaacaggagttcagaaaaaccttccaagaatctgaacagacctgtgtgcttggagccatgttggtaataaggcatttatcatttttgtcagaattacttgttacttgtctctcccttatctactgtgagaacagtaattcttaaattctgtgaggacagtagagctgtggttagaatgtgtcccccaaattcatgtgttagaaatttaatcccaatgcaacagcttttcagggtagggcctaataagaggtgattaggtctctgccctcacaattggattaatgtcctcatcttgggagtggattagttatctcaagaatagacttgttacatatgtgagtttagccccctcttgcccttacctgatgacggccactcaaccttgaacttcccagcctacagaagtataagaaatacatttcttttctttataaagtgcccactgtatgggattctgttctggcaacacaaaacagactaagaaaagtagtgagcacagtatctagctatcttagaaaatttttgtgctctacaagttggtactgaatgtataaagctggcttcaaagaggaccggccgcaggtaaaagtccattgtcttcaccatgccacgtgtggcacctccagctcttaaagacaaaagaggagttggattggctttgaaggcactcagtgaatatttgttctgatataactcttggaaaaataacttttggagtgtgtgtttgtatgtgtatgtaggtatatatactctcctcctttttgcccaatcatgtggtgaaagtaagctccaggtgttgttaacacttaatgcctaaatactttagcatgcatctcctcgaaacaagaacaattccgtgtaaccacaacactatcacccattggaaaataacactaagaaagaatagaaaggccgggcacagtggctcacgcctgtaatcctagcactttgggaggctgaggtgagcagattgcctgagttcaggagtttgagaccagcctggccaacatggtgaaaccccatctctactgaaatacaaaaaattagctgggcatggtggcaaacacctgaagtcccagctattcaggaggctgaggcaggagaattgcttgaaccaggaggcggaggttgaagtgagctgagattgctccactgcacttgacagaacaagactctgtctcaagaaagaaagaaaaaaagaatagaaatcgtccgaacttcacaaaaaaagcctctaataaaactagagcttaagaaactttagccataggaaaaccacatcaagttactttatccagcatacagtccacatgcaaatgggcccagctgtccccaaaatctcctttatagctattttagtttaatttatttatttattgagacagagtctcactctgttgcccaggctggagtgcagtggcacgatctcggctcactgcaagcaccgcctcccgggttcatgccattctcttgcctcagcttcctgagtagctgggaccacaggcgcccgccaccacacctggctaatttttttgtatttttagtagagatgatgtttcaccgtgttagccaggattgtctcgatctcctgacctagtgatctgtctgcctccgcctcccaaagtgctgggattacaggcgtgagccgccacacctggccaattttagggtttttttttttaactcaagaaccactataaccattttactgtctgtatatatcccataacatcatgttgtaatccccaaatacacacagcagaatttattttttaaaaagaaatcaaccagggtttatgaattacatttggcatgattagttgtaagctataatcttatcagaggctttttttgtgagggtgggacaatttctgttctttctcatttatttgggcgccttctgggatttgttggactttggtttgcccctagagattccttttcctcagaactagtggttttcctatgaatatttttgtttgaacagttacagtccctcgtctgtaaatcttatgtgactttgctcttcctattgagtgactttcccaattcctttctccttgggaagttatgagagtggggcacactgacatgaaaattctcattttcatgcaccaccatgcctggctaatattgtatttttagtagagacggggtttctccatgttggccaggcctgtctcaaactcctagcctcaagtgatctccctgccttggcctcccaaatcactgggattacaggcgtgagccactgtgcctggccagggagaccccatctctaaaaacattttaaaaagtcaccaggcatggttgtgtgctccacgcacttacagtcctagttgctcaagaggctgagaccagaggaccacttgagccccagagctcgaggctgcagtgacctatgattatgccactgcactccagcctgggcaacaaagtgagacactgtctcaaaaaaaaaaaaattatttgtttaaagaagtgttgcttaaggctgggtgcggtggctcacgcctgtaatcccagcactttgggaggctgaggtgggcagatcacctgaagtcgggagttcgagaccagcctgaccaacatggagaaaccccgtctctactaaaaatacaaaatgagccgggcgtggtggcacatgcctgtaattccagctactcaggaggctgaggcaggagaatcgcttgaatcccagaggcggaggttgcagtgagccaagatcacaccattgcactctagcctgggcaacaagagcgaaactccatctcaaaaaaaaaaaaaaaaaagaatagaaaccatccgaccttcatgaaaaaagcctctaataaaattagagcttaggaaactttagccataggaaaacaacgtcaagtaacttcatccagcatacagtccacatgcaaatgggcccaactgtccccaaaatcccctttatagctattttagtttttttttaactaaagaaccactatactataaccattttactgtctgtatatatcccataacatcatgttgtaatccccaaatacacacagcaaaatttatttttaaaaaagaaatcaatcagggtttatgaattacatttggcatgattagttgtaagctataacctcatcagaggctttttttgtgagggtgggacaatttctgttctttctcatttatttggacgtcctctgggttttgttggactttggtttacccctagagattccttttcctcagaactagtggttttcctatgaatatttttgtatgaacagttacagcccctcgtctgtaaatcttacgtgacttcgctcttcctattgagtgactttcccaattcctttctccttgggaagttatgagagtggggcgcactgacttgaaaattctcattttcatgcgccaccatgcccggctaattttgtatttttagtagagacggggtttctccatgttggccaggcctgtctcaaactcctagcctcaagtgatctccctgccttggcctcccaaagtactgggattgcaagcgtgagccactgtgcctggccagggagaccccatctctaaaaacatttaaaaaagtcaccaggcatggttgtgtgctccacgcacttacagtcctagttgctcaagaggctgagaccagaggaccacttgagccccagagctcgaggctgcagtgacctatgattatgccactgcactccagcctgggtaataaagtaagacactgtctcaaaaaaaaaaaaaaattatttgtttaaagaagtgttgcttaaggccaggcgcggtggctcacacctgtaattccagcactttgggaggccgaggcaggcggatcacctgaagttgggagttcaagaccagcctgactaacatggaggaaccccatctctactaaaaatacaaaatgagccgggcgtggtggcgcatgcctgtaatcccagctactcgagagtctgaggcaggagaatcgcttgaacctgggaggcggaggtggcagtgagccgagatcacaccattgcactccagcctgggcaacaagagcaaaactccgtctcaaaaaaaaaaaaaaaaagaaatcgccccaccttcacaaaaaaagcctgtaataaaattagagcttaggaaactttagccataggaaaacaacatcaagtaactttatccagcatacagtccacatgcaaatgggcccagctgtccccaaaatctcctttatagctattttaggttttttttttaactcaagaaccactataaccattttactgtctgtatatatcccataacatcatgttgtaatccccaaatacacacagcaaaatttatttttaaaaaatcaatcagggtttatgaattacatttggcatgattagttgtaagctataatcttatcagaggctttttttgtgagggtgggacagtttctgttctttcttttatttgggcatcctctgggatttgttggactttggtttgcccctagagattccttttcctcagaactagtggttttcctatgaatatttttgtatgtacagttacagtccctcgtctgtaaatcttacgtgacttcgctcttcctattgagtgactttcccagttcctttctccttgggaagttatgagagtggggcgcactgacttgaaaattctcattttcatgcgccactacgcctggctaatattgtatttttagtagagacggggtttctccatgttggccaggctcgtctcaatctcctagcctcaagtgatctccctgccttggcctcccaaagtactgggattacaggcgtgagccactgcgcccggccagggagaccccatctctaaaaacattttaaaaagtcaccaggcatggttgtgcgctccacatacttacagtcctagttgctcaagaggctgagaccagaggaccacttgagccccagagcttgaggctgcagtgacctatgattatgccactgcactccagcctgggcaacaaagtgagacactgtctcgaaaaaaaaaaaaattatttgtttaaagaagtgttgcttaaggctgggcgcggtggctcacacctgtaatcccagcactttgggaggctgaggcaggcggatcacctgaagtctggagtttgagaccagcctgaccaacatggagaaaccctgtgtctactaaaattacaaaattagccaggtgtggtggcacgtgcctgtaatcccagctactcaggaggcttaggcaggaaaatcgcttgaaccgcggaggtggaggttgcagtgagccgagatctcgccattgcactccagcctgggcaataagagcgagactccatctcaaaaaaaaaaaaaatagagttgttcctcctattggccctacccctgctctatggggttggaatcagactttcgtagagtgggccagccattgctcacaggtttccacaggtgattctaatattcactctgattgagaaccactgggccttgtaaattataaagtgtccattgggctatttttttcttttttgagttattacggtttctcgacatttgcaaaaataaagggagggggagttaaactcttttaatgaatgaaggagaaatgcaaaattttctcatgtaaaaatgtctctgggtgtaaaataaattattatttttatgatgaaaataagcattatgttatttgagtaccataagacaatataattgttattctgttgatttgatcattcatatttctttagcaatttctagaactgtgtgccagcctgtgttctagaacatggggtactattctagatgctgattataatatatataattactgagcaactcttaaatatacatgtaatttattttcaccttttttatggttttgattttgatacttccaggttcttcagatagatcctgaagttacagatgaagaaataaaaaagaggtttcggcaggtacagtactatttccctgtttgaactttttgaaaatgtatgaagcacatgattcttttatcacttgctattattgacttgatatgtttgggccaaaatttaacttttttttaaggctgtgtaactgttttgtaaaaaaaagctcataataatatataaaatcttaaataatttaatgaccatagcttacctatgaatagaatgaattttatatccaaatagaatctctgcaactccttaattaagagggataagtataaagtagaataatagagcttgcatggagttgtaactaccaaaccccctgtcttctaggagggaacatatcaaatgattcatagcacatttttatctttaagactccatttgtctgtaattttatcttttatttttattcttatttttcgagacagagtcttgctttgtcgcccacgctggagtgtagtggcatgatctcaggtcactgcaacctccacctcctgggttcaagcagttctcctgcctcagcctcccaggtagctggtattacaagtgcatgccaccacacccggctaatttttgtattttggtagagacagagtttccctatgttggccaggctggtgacgaactcctgacctcaagtgatctacctgcttcagcctccccaaaatgcaggaattaccggtgtgagccactgcacccggccgtaattttatcttttgccaacttaaatgaatacctaagagataactggtataaagagtgctttttgaaagttctccaggaaaggagatctatagcttctgaatcttgcccattcgtaggtttaataactggaactacaaagttttaaagtaaacttaaaaaaaaaatccttccagttttgacagctgagtaaccctccccccagcctttttttcttaaaaattattattattttttgagacagggtctcactctgtcacctaggctggagtacagtggtgtgatcttggctcactgcaacctgtgcctcctgagtttaagcaatcctccctcctcaacctccccagtagctgggactacaggtgtgcatcaccatgctcagataatttttgtattttttgtagagacagagtttcgccatgttgcccaggctggtctcaattctgggctcaagcgatctgctggcctcagcctctcaaagtgccatgattacaggcatgagccaccgtgcctggctacctttttttctgagttgaataatcgtagtccctataatttgcctttgcaaattggattttctatatattccatgtcttttaaaaaaactttccttagcttctttatagtcttatgtacttcatattttaatagggtctgaccagagctgaatgtaattttcagcttctgatgagatacttgttaatatccagtggtgtgcttgtttcttcagtacagtaattttccccatattgctgactcatagtcattttctgatctacagttaagccaagatgttttttaacttggtctacgtaatcatatcccattatataactttatagcttttttttttccttcctaagctctactctatacttatatttagctttttcctttttctaaaatttcaaattttctaatatgcattactaatcattcccatattaataagcatttaagttcatagtcaaaacaattttttatgtagctacataaataataagagttaagaattcttaataaatcattaatatggactgatagttaagagtgtgcatattggagctatacaactagtttaaatcttgactgtaccacttaacaagcagtgtaaacttgagcaagttacatttaacctttccgtgtctgttaccccgtttgtaaaatgtaataatggtgtctatcccatgagtttgttgtaagaatttaaatgatgtattacacagaaggcatttagagtaactcttggcacataatgtatcctcactatatgctaactattgtcagcgtgtgttagtctgctaatttctttacttgcattgtttgtttcattcttatatcagcccaattagatataggtacatagtattatctcatttacagagcaggaagcggaggcagagataggttaagtgatttgctcgaggtctcatagctagtaggtgattgaagttggaattagaacccagcataatggttccagtaatgctgaacggagcgttagattcccatttgttctcattccccgacatagttccctgggttccaactagttggtttctgtcaattgacaatatgtcatggtttttaactgtgagtatctgaattacctatgaaagttcttttttttttagctggtttattataaaaattttatatagaaaaaagaatggacaagcatagtggctcatgcctgtaatcctagtattttgggacattgagtcgggcagattgcttgagctcaggagttcgtgaccagcctgggcaacatggtgaaaccccgtctctacaaaaaacgaaaaacaacaacagcaaaagccaaaaattagccgtgcctgtagtcccagctactcagaaggctgaggtgggaggatcacttgagtccaggagattgaggctgcagtgagctgggatagcaccattgcactccagcctggatgatagagcaacactctgtctcaaaaaaaaaaaaaaaaaaaagaatagaacaacgaatattcatgtatccaccatctatattgaatagttaatttcatttatatatatatatatatatatatatatatatatatatatatatatatttatttatttattgagacggagtccggctctgtcacccaggttgcagtacagtgttgcgatcttggctcacggcagcctccacctcctgagttcaagtgattctcttgcctcagcgtcctgagtagctggtattatagatgtgtgccactgtgcctgccaaatttttgtatttttagtagagacggggtttcaccatgtaggccaggctggtctcgaactcctgacctcaagtgatctgccagcctcagccttccaaagtgctgggattacaggcgggagccactgctcctggcagacactgactatatatttaactatatatttttggctgaatcattgtaaattgcaataaaccatgatgctttacccctaaatacttcagcttgtacccttcccaaaaaaaggacattttcttgcataatcacttatcccacctaacaaaataagggctaattccctacgatcatctgaaacccagtctagtagaggtttacaaagtgcagatgccaaagactaactcagaaggtctgagggtggaaattagaatgttgtctttttcagaagcttcacagggttggagcacaggcagaatgagaaactgctttagattaggagttcttttaggagagagttgatgtctcatacctgctttagccaccttagtgcttagtacaggttgagtatcccttatctgaaatgcttgagactagaagtatttcagatttcagattttttcagattttggaatatttgcagaatgcataatggtcgagcatccctaatccgaaaattcaaaatgttccaatgagcgtttcctttgagcatcatgttagcactcagaaagtttcagattttggagccttttggattttgggtgctcaacctgcataaggaacataataggaacttgatacctttcagtctccctcctcccccaaattattacaacatcttcatagtgctaggcttccatttgtttttgtttttgtttttgtttttgttttttcctggagacagggtctcactttgttgcccaggctggagtgcagtggcacaatctcaacctcccaggctcaagtgattctcccacgttagcttcctaaatagcttggactacaggcgaccaccaccatgtctgggtaattaaaaaattttttttttgtagagacagggtcttgctatgttgctcaggctggtctcgaagtcctgggcttaagtaatcctctcacctcagcctcccaaagtggtgggatgacaggcgtgagcctctgtgcctggcatgtttggtctcaactttgtgattaaaacctgaaatgtttcctagttgtacctttaccttttggtgcttgaattttgttaaagatcagtatttctgggcatttaaagagatttgttaattttttaaatgcttttgctaagagtctctttttgccgtaggaccttagagcttttggttgtaacgagacagggcaggctggaagttagtaaatgtttcccttattgacaaccccaacttttctcttattgtagttatccatcttggtgcatcctgacaaaaatcaagatgatgctgacagagcacaaaaggcttttgaaggtatttgtaaatttacctgcttctgagtattagattgtgaatggcagggcctaactgttccttgtcctagatcaagcaaagactgttatagttttgtcttctggtcaccaagaagctgtggttttcagtagagcagttgccatttcaaagcagaatgttgttgtttaagaagtagaccttaactttgctttgttaaaacttttatatgccaacaaagactgttattgcataggatcattttttttctttgaacataaagaattttatcactgaattaaatccagatgtagtgtatttagccttgagtatatatttaattttttccaaggctcttaaggaaagtcattgctatagttgaatgttttttttaacttagtttaacgacagtaaataattaaagtagggaatgctttagagagcacaagtccatttacactgcctgagtatagttcagactttcagagggtgtttgcagaaacagttaatttcaatgttttgcattagctgtggacaaagcttacaagttgctactggatcaggagcaaaagaagagggccctggatgtaattcaggcaggaaaagaatacgtggaacacactgtaagtatttatagtgctgctgtgtttacaggaagtatcagcaagccttgggcaccttgtagaagggtacatatgaacatagtaatgcctactggcacaacctgtggctacttctgtgctctctaccactttgctgtggtggtcatgaatagtgtgtgcctgaagctgtaattcacccctaagagaagaactcagatgaggagtagctggtacactgctcctacctctttccctaccagtcctgtgttggggagaaagggttgttctctccctctcatcacatattgccacttaccccattcttagagtggaaacgtggagcagcctgtgactcttgactcttgatttttattcttgtccctgtgaagggtttgcaacaaggcttggcaaaggctagcaagaggataggcgtaaactttttttaaaataggaggaggtttatgtccatcttaataacagagttgggaagaactcagttgaaggaaactgagttgtagctggtgttatttttgtttgctcttgagggcatacataagtctccaatgtggtgggaaatgtcagtatggctttcccaaggtaagaaaggtcttttaactttttacttgctggggcaagaatcttgaggtcatttgtaagagctgcttcaattgtgattggatgacttttcacatgaagagctttgaaatctgagacaactttataaccataataatgaatccagtttcggtgaggaaaatggataagaagaggagacaaagggcccataactatatcctgcgggtcatgtgttggaaatggcacttgtaggccctatcctggtagaaatagggaaagtgcctgacagtttctccttaaatcattgtggcttcgtatgtctttcacctgtaagaaagtcatccttaggcttcctgaccacagggtggcagtagggcctttctgagcttagagggtacttggcctttgctggtataatagactggttagttcatggagtagtgtcattcttgtatgaattcgtatatttatttatttattttttatctcagtagtggccaatgtgataaaagtatcagttaatatgatatgtggtttaaggaggttccatggtgaaagtgatcaagaatgcagttatagaaatgccagaaaaactacttggacataatgccacagattctgtagcttcttctaaaacttgacagatatatttgctttgctctaaacacataaccacaagccaagaaaggtaaataagtagtctgtttcaaagactttttggatctgatgagttggggacaacctcccgttggtcccctttcatctttcattcttcctggtagattggattttagatgagattagaaaaaggacttgtggttcctaattttccttgattctgttgttcttttgaggagggaggggaggggctctttttttttttaatgaaaactttttgctatacccgtgcctatagaaagttaaatatattgtatgtgtacagcccagtggatattctcaaagcacagatgctcgtcttttgatgaaaaaaaattctttttaggtgaaagagcgaaaaaaacaattaaagaaggaaggaaaacctacaattgtagaggaggatgatcctgagctggtgagttaaatataggaaaagccactgtatcttgtgtgattgtgtctacgaattggtgggttacagagacagaagccaaaagaatgatgaatatatgctatttcacatttatttatttatttatttattatttttgagactgagtttcactcttgttgcccaggctggagggcaatggcgcgatctcggctcactgcaacctctgcctcctgggttcaaacgattcttctgcctcagcctcccaagtagctgggattaccagcatgtaccaccatgcccggttaattttgtatttttagtagagatggggtttctccatgtttgtcagtctggtctcgaactcctgacctcagatgatccgcctgccttggcctcccaaagtcctgggattgcaggctacaggcatgagccaccctgcccggcctctggctaatttttttgtatttttagtagagacggggtttcatcatgttggctaggctggtcttgaacttctgacctcaggtgatccacccgcctcggcctcccaaagtgttgggattacaggcatgagccaccgtgcgcggcctaatttttattttttaaaaaaacattttatttggctgggcgcagtggctcacgcctgtaatcccagaaatttgggaggccgtggcgggtggatcatgagatcaggagttcgagaccatccgggccaacatggtgaaaccccgtctctactaaaaatacagaaattatctgggcgtggtggcacgtgcctgtaatcccaactacccgagaggctgaggcaggagaattgcttgaacctgggaggcagagattgcagtgagccaagatcgcgccactgcacctccgcctggtgacatagcaagactctgtcttaaaacaacaacaacaacaacaacaacaacaaacattttatttgaacttaaaacatataaatatacatttatttatgtatttgtttgagacggggtcttactctgttgcccaggctagagagcagtggtgcgatctcagctcactgcaacctctgcctcccaggttcaagtgattctcctgccttagcctcctgagtagctgggattacagatgcccgccatcaagcctggctaatttttgtatttttaatagagacgggatgtcatcatgttggtcaggctgatctcaaactcctgacctcaagtgatctgccctcctcggcctcccaaagtgctgggattacaggcgtggaccaccgcacctggcccaatttttttcagttgtttttttttttcctgattataaaagaacacatgctaatgatagaaaatttggaaaaagagaaatataaaaaatataaaatcgcagtgtctgtctatcccgtgtatggagcttttaaatatactgagctattcattacagactcctttatccctttgatgtttgtctttattagggactggggttgaagcattgcttttagtgagcagtgtctagcaggtaacaggataaaagagaagtcacagagatttagggacttctttattttcctttctctccatatatcactctttgctccagtgtctgattttagaatttaggcactattaaatatgcatgacagattacttttgtacttccatgtctatttaaaatactttatatctggagaaaaatatttaaaggtagaataacataagctgtgttcttaagaactcttgaaaataaagaattaaaaactggtagggagggcattgtgatttcattaacttagtgtgacaggggctgggtcacttacgttcacttatttttttgtaattctttttagagatagggtctccctttgtcaccccggctggaatatagtggcatgatcttaactcactgcagccttgacctcctaggctcaagtgatcctcccaccttagtggatattatacattctaataataacctctggtggctcatacctataatccaagtgctttgggggctgaagtaggaggatcttttcagcttaggagttgaggctgcagtgagctatgatcacaccactgcactctagcctgggtgacagattgagaccctgtttcaaaaacaataataataaataataatagcttctgttcctatcattgtaagactatcatataatatacttttttaaaaaagagatagagtcttgctctgttgtccaggctggagtgcagtggcatagtcatggctcactgcagccttgacctcctgagctcaagcgatcctcccacctcagccttctgagtagctgggactacaagtgtgcgccaccacacctggttaatgttttatttttaatattttttgtagagatgggatctcactatgttgctcagggtggtctcaaactccagggcttaagtgatcctgctgtcttagcctcttgaaacgctggatctacaggtgtgcaccaccatgccccgctaatttttgtttttgagacggagtttccctcttgttgcccaggctggggtgcaatggcatgatctcagctccctgcaacctctgtctcctgggttcaagtgattctcctgcctcagcctcccgagtagctgggattacagtcacgcaccaacatgcttggctaatttttgtatttttgatagagacagagtttcaccatgttggccaggctggtcttgaactcctggcctcaggtgatctgcccaccttggccttccaaagtgctgggattacaggtgtgagctactgcgcctggcctgcacgctagttttaaaaaaaatttttttgtagcaatagagtttcactatgttgccagggcagtcaagctcttagcctcaaacgattctcctgcctttggccttccaaagtgttggaattacagatgtgagccacggtgcacagcctgtgccaggttttaatctgctttatcttggactccaggtgaaagtacatggttcaagttgctggtaaaaatatttactctgattttcttttgttcttgattttcctgtagttcaaacaagctgtatataaacagacaatgaaactctttgcagagctggaaattaaaaggaaagagagagaagccaaagagatgcatgaaaggtacatatcagtatattcatttaaaccatatttaaatacctagattaactaacattggtctttggtgattttcctaatgagggaattatatagtataccatttaagagactataaaaatagttacctaaaaacagtcaagcttttgaatcaccagggtaagtagtttttttctttgacttttgagaattattgaataggtctgtccttagggagtgtattttttatttatttttttgagacacagtcttgctctgtagccaggctggaatgcagtggtgcgatcttggctcactgcaacctccacctcccaggttctagcagttcccctgcctcagcctcctgagtagctgggactacaggtgtacaccaccatgcccggctaattttttgtattttagtagagacagggtttcaccatgttggccaggatggtctcgatctcctgacctcgtgatctgcctgccttgccctcccaaagtgttaggattacaggcatgagccactgcatgctgccagggagtttatttataatcaagagccttgtgtgtgttcttcctgatgtcctggagtgaaataagcagttattaaggccattgttactgaagccagaaccttttgtggggctagtggctacagctttggtgagtgtatagtactgtagtgtcatcagtaacaaaatgtttaatgttctaaaatatgatttctcttgaacatcagaaatgttagaatttcgcttttgttgcccaggctggagtgcaatggcatgatcttggctcactgcaacctccacctccccaggttcaggtgattctcctgcctggctaatttttgcatttttagtagagacggggtttcaccatgttggtcaggctggtctcgaactcctgacctcacatgatccacctgccccagcctcccaaagtgctggcgttacaggcatgagccgctacatccggccgagttttgtttctgtatgtattttatattgttgcttggtaggtaccagtaactaaaatttgctagttgaggttgtgtgaaatatctttgttttcggatagggttttgtccagagatcttaagaactttggctttataatggtcattctgctgaaataaggtggcctgtgttctcgacatagctttgtcactgaaagagcccaaaacctcagattgctcttggctgggctttagttactttatctgtgtaacaaggatatttatgtctttccccacagccatgcccaagtctgatctgcgtgttttagaatgagacattcatgaaaatgctatgagccctttccagacagccatctttgtagacttctagggaattgatttactatatatgcttgcttctgtggggagatgccaccttgtatggttaattcagtctgtaagtatcatataaatactatgatctggttttcctcctaggaaacgacaaagggaagaagagattgaagctcaagaaaaagccaaacgggaaagagagtggcagaaaaactttgaggtaaatttccaaggtggccagggattctaattccagaataaggcagcttggttcctgtggcgctcccaggactgagtggggcagtcagaggggagtgggatatgtggggaagagtgggagaggtgaagaatgaggctgggcctgcctcagcctcctgtaagctctgtagccttggcaaggacgatgaggatccctgaatggcttttttaaaatttatttttaaaaattattgtttaatttctttttacagcacactaacagtttcaccctgaatggttttttagattgtagtaggcacagctgcccagtgggctcaagaaaaatggattgcacttttaatttagggggtaagcatagagtattgtgctgcttagagatctgttagtagatgctgaagttcttgtgcccacagtgtcctacctgcagagagagttagaacctttgaacttgactcttctttgacaccctggttatatgcttcaggtggttggacagaaggattgtggcaacattcggtcttttcttctatagggtttaggactcatggttaggggctggctaatcagagttgatgactttgtttctgttgcacttcatgtatggaaagagaaaaaatgataatgaggtagaggtcctagtggccacccctacacaactcgctaggcattgtactggctttggagcagccatccaagttttggggggcagcagaaaggtgcagtggaaagagtagctgtactgctagctagctgtatggcttttagaaaatcatttaacctttttgagcctcagtgttatttgtgaagcactggtagcagtacacaccatagtcggcttttggtgacaattagaaataccatatgctggccgggcgtggtggctcaagcctgtaatcccagcactttgggaggccaaggcgggcagatcatgaggtcaggagattgagaccatcctggctaacatggtgaaaccctgtctctactaaaaaaatacaaaaaattagccaggtgtggtggctggcacctgtagtctcagctactcaggaggctgaggcaggagaacggtgtgaacccaggaggtggagcttgcagtgagccaagattgtgccactgcactccagcctgggtgacagagccgtctcaaaaaaaaaaaaaaaaagaaaaaaaaaggccgggtgaggtggctcatgcctgtaatcccagcactttgggaggccacggcaggcggatcatgaggtcaggagatcgaaaccatcctggctaacacggtgaaaccccgtctctactaaaaatacaaaaaattagccgggcgtggtggcgggcccctttagtcccagctattcaggaggctgaggcaggagaatgatgtgaacccgggaggcagaggttgtagtgagccgagatcgcaccactgcactccagcctgggcaacagagcgagactgcatctcacaaaagacaacaacaatgacaacaaaaaaaaccatgttaaacgtctagcctcgaggtccccaacaaatggggcctcagtgttgtgatgattattactgatttcgtcctcctcttgcaacctgcagctcatcctgcgttctaggggtgctatgacactttcttgggcccttgggagtgggaagaaagctctattctactttttttttgagacggagttttgcccttgttgctcaggctggagtgcgatggcgtgatcttggctcactgcgacctccgcctcccaggttcaagtgattctcctgcctcagcctcccgagtagctgggattaacaggcatgcgccaccatgcccggctaactttttatatttttagtagagatggggtttctccatattggtcaggctggtctcgaactcccaacctcaggtgatccacctgatgtgtgagccaccatgcctggcctattctactcttttttctttttttcttttcttttttttttttttgatacaaagtctcgctcttgttgttcaggctggagtgcagtggcatggtctgggctcactgcaacctctgcctgccaggctcaagcgattctcctgcctcagcctcccgagtagctgggattacaggcacctgccaccacgcccggctaatttttgtatttttattagacacagggtttcaccatgttggccaggctggtcttgaactcctgacctcaggtgatctgcccgcctcggcctcccgaagtgctgggattataggtatgagccactgtgcctggccagctctattctactcttgggttattccagaggactgaagtgggctgggctacaggagggtgagtggatggcagaccaggtttaggcctttccactcattgactggtctcctcacctcaaacttcttttgtacttaggaaagtcgagatggtcgtgtggacagctggcgaaacttccaagccaatacgaaggggaagaaagagaagaaaaatcggaccttcctgagaccaccgaaagtaaaaatggagcaacgtgagtgaccgcccaaggtcacaggcacagaacctttcccctgctatctcccttcctgcttcgaaggactcattctttcctcccacttccaccccaacatagagtagtatttgctttttagtccattttgttttcaatacgatttaatatcgatcagagtaattcttttgtacattgaaatgaggggcttggtttaaaaaaagacctttccctctccctgcccctagaacaaccagtattagaaggtgccaccattggtgctgccttctcttcccacagcctgtaactcagtgttttgtacttcactgaattgtgatggttagaaacttcgtggatagtttgtggaaatcatccaattaaacatactgcttaaaacagtgttgctgtgacttcagagacaagcctggaaggggcaccttaggaagccccttcgcttcagttgctcgcttctgggtgtgctcccttcgaaggcccagataagacagggaacacttgtgagcacacagagcagcatctgatgccctgtggtgtttggcatgtgccccctgtctactgaccaatcagtgtggcatgaggcccacgccacccaaacctttcactttccaaagagctagccgtcctccacccagtaccatgtcctagcctgtctgcatttgttagtggtaatattctttatgtataataaatttttatacccaagccattgatgtacttttccttgtactctcccttgtgggtcccttgtctggcttggctgaaccccaaaatgctttggggttggacagacctggctgaaccttagtttcttcatctatgaaatgggaatatgaattactgcagcagcttttagggcagatttgccatggcatatacaaggtaactaccatagtgctccttgggtattgccaatatcctattatttctgtgtaaaatgaagatactgattgttttgaggattaaatgaagtaatatatgaaagcgtccagctcacagtctatgcttaaatgtcctgcttgctttcagggacagaatcagccctcaggaggggcccaaagtgagaaggggaaaggtgacacttgaaatgtgaagatacaggaaactaggtgactcaaaactagagttttgctttttgcaatgtcttgtagatgagtaaacaggcacaatgactacgaaaggcaccatgtcttttagtatcatgagaagtgcaactttcatttctctgtgggagaggacagaggcttgggtgtcttactgtccttccaagtaccactgagcacatccaaaccacatgtgaagtagagcacagtgatgagtgggtgggtgggtgggtgtgcttctggctaaaactggaccaaggcagggggagaaaatgtttagttgccctgcaaaagtgatacatgccgtgaggtaatgcagtcctgactaggggggcagtgattatcttttctagccaagcaaagccaagcaaccccatttcagtccaggatgtgggtgcacacaccgcttccttagaggttaagtggtggtggttcagttcagctatctgcaaacttacctttgccctcaaggaggctgtgccagcaattagctatgggtgttagttctcacactgctatgaagaactacctgagactgggtaatttataaagaaaagaggtttaattgactcatggtttcacaggctttacaggaagcatggctggggaggcctcaggaaacttaacagttgtggcagaaggtgaagaggaaggaggcacgtcttacatggccggagcaggaggaagagagcgcagggagagg

SEQ ID NO: 198 - DNA, 122359 bp, Homo sapiens
  source 1..122359: mol_type = genomic DNA
gacagatgtccctgaaggcccgagggacaccagccgctatgccaggctccaaagaacccgaggcaaaccaacgctggtcccggtctttgaggactccccggcccagtgagggagaccgacaggtaagcaggcagtgtccaagcctggggaagaggctgtaaggcagacaccgcaggcactggcagggctccctatggaacaatcagggaagacatcctgaagaagggggcattggggtgaggcctttcccccatgtaatgaggccaagcccaataataataatgatattaataataatggccactggccgggtgcagcggctcacacctgtaatcccagctctttggttttgtcatttgtttgttttgagactgagtcttgctctatcgcccaggctggagggcagtggcacgatctcggctcactgcaaccccgggttcatgtgattctcctgcctcagcctcccgagtagctgggattacaggcacctgccagctctttgggaggctgaggcgggaggattgcctgaggaagggagttcaagaccagactggccaacatggcggaaccacatctctgccaacaatacaaaaattagctgggcgcggtggcgcgtgcttgtagtcacagctactcgggagactgaggcaggagaatcacctgaactggggaggcagaggatgcagtgaggagagagcacaccactgcactccagcctggttggcagagcgagactgtctcaaaaacaaaaagtaaataataataataataatagtagccaccagcatttatcgagggcttgcaatgggccaaaatcactacgctaagcacaggacgtgaactaattaatttaacccttcaacagctgtaaatcttttcccatcctgccttcctgccttgccctccctccctccctccctccctccctccctccctcccttccttccttccttccttccttcctttcttccttccctccttcgagacaggatcttgctccgttgcccagactggaatgtgcagtcgtgcaatcacggctcactgcagcctcaacctcctgggctcaagtgatctgcccacttcaacctcccaaagtgctggggttacaggcgtgagccactgcacctggccagcagatacttttatcactatcccccttcttacagatccaggaacattgaggcacacacttgtttccttccctcaaaatgttcctgctgtggctagggagatggtcatggacacagtgtcagtctggtgaagctgtgctttgacggtagcagcagaaggcattgaaaggaagtgagaggagagagggactgattctggctggggaaggaacggagggttggggatgccgcttgcagaaggcttctgagaagcgattgccctccaggacagatccttttatagggcgtggactttggtgcatagaattccgtcatattttccgttcctgtttctctatcatttgtccatatcccgattttgctttctttcttatttttctctttaatgctccagcctcactcctgttacctcctctggtgccccataaacaaaccctaacacctttaacattcacgcaatcttgggtatgtagaaatgcttacagaccagacagcattgcttcgtgtaattatatcttctaaattgacacaaaggataaatgctatcttttaaattgtgctatagactgttttatttcctactgtttcaattcaacattaatttttttttgttacgttgttttttgttttttaaaacagagctggtgccttagcctcccaagtagctgggatcacaggtgcgcaccaccacgcccagttaattcttatatttttagtggagacggggtttcgccatgttgcccagggtggtctcaaactctcggcctcaagcgatctgcccacctcagcttcccaaagtgctgggattacaggcctgagccaccatgcccggcccagtattatgtttttatgatctctccacgttaccaagtgaaactgatttattgcttccaggacaacatggaggaatccactcccttttgcttaccagctccccacgaaacagacctcatggtgttctctacctccctattcccacccgtaatgctgccctggtcatcctggggtatgtccttgtatgttacctgtgcatgcttctctatggtacctacttggaagtgggatcgctggatcccgggagaaatgcacagtgaatgtcacaaaattctgccccattatctaaggtgggtcttgaagctctagcagcatgtcaccaggcagagaagggcggagaagggaccaaccagttcaaaggactgagagtccacagcatgtccagggttcagtgaattataggtgacccacccgaggggtggaacctttcagggaacagccgtgtaataaacacttgactgcactggtttctttttcattttttttttttcctaaaaaggaaaatagtcttgttgtgggtggcagcttggcaacgtctatgaaaatcttaactgcatatactctttgacctagcaatatcactactcatgcatgaggaagtaggaagaaggaggctcagtgtgttgcggtctgtaaaggtggaacaaggaaaaccaccagcagccccaccaatcggcgaggagtcaaaggaaccatagataggctgcggctattggatactgtgtggtgtagacaagataaaggtgaattaaaacataggagcacaggctgcgcgcggtggctcacgtctgtaatcccaacactttgggaggctgaggcgggtggatcatgaggtcaagagatcgataccatcctggccaatatggtgaaaccctgtctctactaaaaatacaaaaattagccgggtgtggtggtgggcgcctataatcctagctactggggaggctgaggcaggagaatcgcgtgaaccgaggaggtggaggttgcagtgagctgagatcgcgccactgcactccagcctgggcaacagagtgcagctccgtctcaaaaaggaaaaaaaaaaaaaaggcgagccagatttccctatatcaagtatcatcctatatccctgaactcaagagatcataatatttctcagttctgaatctatatatgtaaaccaggagttggcaagctttttctgtaagggctcagattgtaaatattttcagctttgaacatatggtctctgtcacaattgcttaactgcgtccttatagcatgaaagcagccacagccacagacaatactaaaccaacaagcatggctgtgttccaataaaagtttatttataaacccaggcagtaggccagtgtggcctgtgggctgtcatttgctgaccccaatgtaaataaatagtaaatgttagatccggctcagtggctcatgccactgagcactttggggagccaaggcaggacgatcacttgaacccaggagttcaagaccagcctgggcaacatagtgacacctcatctctacaaaacaataaaaaaattagccagacgtggtggtgagtgcctgtggtctcagctactctagaggctgagatgggcagacagcttaagcctggggtggcaagtttaggctgcagtgaactgtgattgcaccactgcactccaggctgagcgacacagtgagaccctgtctcaaaaaaaaatatttgtggaagaaattacaacaaaataccaggggtacatctggaaggcagagtgaaaaggaagggcctggtcaagggaaatattaccctcgtgtttacattttttctactttgtgtaattaaaattgctttaaattaaaaagaaaaaagtgttttaaaaatagctttggtgaccttcttctttctgatcagcatcttagaaatgccagcagcagcagggcctagtgggtcacacctataatctcagcactttgggaggccaagaagggaggatcagtggaggccaggagtttgagaccagcccgggcaacgtaacgagaccctgtctctatttattttattattactattttttattttttgagacagagtcttgctctgtcacccaggctggagtgcagtggcacgatcttgattcattgcaacctccacctcccaggttcaagcgattctcctgcctcagcctcccaagtagctgggattacaggcgcctgccaacacacccagctaatttttgtatttttattagagacaggggtttcaccatgttgaccaggctggtcttgaactcctgacttcaggtgatctgccagccttggcctcccaaagtgctgggattacaggtgtgagccgcagcgcttgggccccatctctatttgaaagaaagaaagaaagacaatgccggcagtacatgaaagcaatgaggaagcaaagttctctagcaccctaccagctagaggagaatttctcagagagtttcttttattcacttagcaggtatttacccggcacttaccatgtgcaaggaactgtcctaggtgctagggatagaacagtaaatgaaaccgagtccctcccctctatagggtggatattctgcagtcagagagacaggcaacaaataacaaacacaacaaataaataaatggtatagcaggtgagaaggtcagaagtgctatggaaaggcagaaacaaggggcaagtaaaggggatggaggtgcctggtgccaggtgaggcattaaacagagtgaccagagaaggcttcattgcgaaggtgacatttaaacaatggcctgaatgaatgaggcgagagctagggggatgtctgggaggaagagtgttccaggcagaggcagcagccgtgcaaaggccctgaggtgggaacgtgtcggttgcatttgaggaacagcaagggagcaagttggctgtagtggcatgagccagggggagagggtgagaggtgaagagaaatgaaggacaaagcaggtcacagcctgcacagccccgtggtccatggtgaggactttggttttactctgggccacggtgaggtgggggcggtgtctgagcagaggagggacaggagctaacttgaggtctaagagggtcctctgactgccctgtgggagcagacgcagtgggaagtggggagaccagagaggaggcacctgcagtggtccagaaaggagatgatggtggatttgaccagagtgaggcagtgggggtggcaagaaggggtcggattctggagctagagctagagattatatagatatagatttttttttgagatgaggtctcactctgtcacccaggctggagtgcagtggcgcgatctcagctcactgcaacctctgcctcctagattcaagtgatcctctcgcctcagcctcccaagtagctgaaactacaggcatacaggcatgcgctaccatacccagctagctttttttttttttttttttgagatggagttttgctcttgtcacgcaggctggagtgtaatggcacaatctcagctcactgcaacctctgtttcccaggttcaagcgattctcctgcctcagcctcctgagtagctgggattacaggcatccactaccacgcctagctaattttcgtgtttttagtagagacagggtttcaccgtgttggccaggatggtctcaatctcctgaccttgtgatccacccgcctcagcctcccaaagtgctgggattacaggcgtgagccaccattcccgaccttttttttttttttttgagttggagttttcgctcttgtcgcccaggctggagtgcaacggcatgatctcagctcactgcaacttccacctcctgggttcaaacgatgctcctgcctcagtctctgagtagctgggattacaggcgtctgccaccacgcccagctaatttttgtattttcagtagagatggggtttcaccaagttggccaggctggtcttgaactcctgggttcaagggatctgcctgcctcagcctcccaaaatgctgggattacatggcatgagccgccacatccgatcagattctggatatattttgaaggtcacattgacatttgctgataaactggatgtagaggtaagaaggaaagaggaatcaaggatggcgctaagtgttttggctcaagtacgatcaagagccatctgccacagatcacctggggactcgtaaaaatgcaagtccctgtccccgcctggatctactcagctggcaactctgggtgggacccaggaaactgctttctgagtaagctgcccaggaaaagactagaaacccagaggcaaccatgatcctcttggggtgggggggggtggtcgtctcagggtagaacattagagtggttgcaagactccccaggttcaaatcctggccctgccattccacctatgtgagctggaatgataccttaaattctcccagccacagtttcttcatctgtaacaagactatcgatggtgcctgcctcacagggctgacttagggcctgaatgagttcatgtgtataaaatatataaaatggtgccaccacatacaacttcccaataagggcagctagaattagcatccagttccaaagatgatgaattcttctttttttttttttttttggacagtcttgctctgttgaggttggagtgcagtggcgcaatctcaactcactgcaacttctgcctcccaggttcaagcaattctcctgcctcagcctctcaagtagctgggattacaggagcctgctaccatgcctggctaaaagatgatgaattctaataataaaatccacaccaaaatattatcaggtgtcagaggtacattttgttggttaagtgaaacagaggatattggtcaagggaaacatttctctatcccttgattttttccatcttgtgtaattaattaaaattgttttaattcaaaaataaaataatgttttaaaaatagctgtagtgggccagtcttggtggctcacacctgtaatgagcactttggttggcaaaggcaggaagatcacttgagctcaggagttcaagaccagcctgagcaacatagggatacccccatctctacaaaaaaatctcaaaaaaaattagctgggcatggtagcacatgcctgtggttccagatactcgggaggttagatgattcaatatgtatatataagtaagcccaagcatcataaaagtattatctattattatttggccaaacatgaggagtcagacgttttctcaaagggggaacttttagttgggttttgaagtatgagtaggagctcaccgggtgacaaaaagtcatacttcctttcattatcttagtcaagacactcccttgaggcatgctgtgttccagatcttgtgctgggagatcccagggacctaacatgagtctgactctgacctacgcggagctactagtcccagggatggatcagacctaagccctgtcctctagtgcctccaagctggtaggagaggcagagagggatacaattcagggtgaccagggcaagcagagagaggaacagagtgagtcatggactccgagcaggtcagcactgagcaaaagctttgaaatggctagtctgacccccctctcccatttactaaagcctggagagggacagggtttgctcaagattacacagaatgaataaatatcctgatcttggagtctggggatttcaaggaccaaacgagatgccagagatgcagacctgccccctcgcagacccttcacccagatgcccaacacaccccaaatccccactcaaatctgcagactaacccctggccccgcagacaatgatgctgtcagagatatctgcctccccagccctcaggctcagagacccacttcatccctcacccacatgcacagcacacatccctgcaagcccttatcatcctatgtgccctgtgctgggtcaggctggacacagacgtgactcagatgcaggttgagccctggaagggctgctagtgtggaaaggtaccaggagacagagcatcccaacccagtgtgaagagtgtgtggaagccgtggcagggcatgggatgggaggagggtgagatgagatgagggaacccttaacacgctttgaaccttgggaagttcacctggagtttcctggcatggggagatggaaagagggagtaacaggcagaaagcacagcatatgtgaagccacaaaagcatgaaacactatttattccttcatccatccatccatttatccattatccatcatccatccatccatccatccatccatccatccatccatccatccatttatccatccatctatccatttatccatccatctgtccatttatccattcaaccgtccatttatccatccatccacccatccatttatccacccatctatccatccatccatttatccatccatccatccatccatccatccatccatccatccatccatccacccatccatttatccatccatccatctgcccatctgtctgtccctctgtccatctgtatgtttatctgttcatgtacttatgcattaatcgattcttccatccatcttatttatttattcattgtgtatatcattcattcattcattcatgtatccatctattcaaatgatcatctgccccctcattcatccatttatttatccactcattggtcacacatgcatccgttcatatagttatcagcatcagctgtcatatgatccttccccagcaacacctcctcagagagcctttccgaaccctttctaaaataatacccagccaccttgcctctattaccctcctttttattttcatcacagccctgaacgagacttgccattttgccctgtaattgtatgtttacttgttcggtgtctgtggctaccatgagaacatgatcatttattcaatgagtgtttctctctttttaaaatttaacttttaggggtacctgtgcaggtttgttattaggtaaattgtgtgtcacaggggtttggtgtatggattatttcatcaccccagtaataagcatggtagcccagacaaatatttcttgagcatcactgtgtgccaggctctgttgtagacactggggataacagagacaaaatccccttctgcatgaagctgacattctagtggtgatgtcagacaataaacataaacataaataaacataaaggtagtaaataaattataaggcatgttggaaggagggtgctgcggcaaaagaaagcatagagccaaatgagggtgtcaggggtccagggggatgggtgctcaaggaagacctcaccaaggaggtgatagctgaacaaacgctgtgggggagagaaggagcccaagcggttatccaggggaagagcattgcagttagagaatggcacatgcaaaggccctgaggcaggactgagcctggtgtgttttggggacattaagaaagccattgtggctggaatggaatgaggaaggaggagagagcaagaggtgggggcagagagggcagagaggggacagaggggaccagatggagcagggccatgtgggggaagactctgttttcactctgagtatgaccagagccagaggaggattctgagccaggaagaaacaggatccaactgcctgcaggatgtggttccctctgcctgccatatagggagtagattaatacctgagttttgtgagagccaggatcatgtctttgcacctgtcgcctcctctgtgtctgggtgaagtctgggtggggcacagtggctcacatctgtaatcccaacggttttggaggccaaagtgggagggtcgcttaggcccagaagttccagaccagcctggacaacacagcgagaccctgtctctacaaaatcttaaaaaaaaaaattagccagggccaggcacggtgactcacgcctgtaatcccagcactttgggaggccgggttgggtggatcacggggtcaggagttcaagaccagcctggccaacatggtgaaaccccttctctactaaaaatacaaaaaaaaaaaaaaaaagctgggcgtggtggagcgcatctgtaatcccagctactcggagggctgaggcaggagaatcgcttgtaccgggaggcagaggttgcagtgagccaagatcacaccactgcactccagcctgggggacagagcaacactctgtctcaaaaaaaaaaaaaaaaaaaaattagctgggcatggtggcaagtgcctgtagtcccagctactcaggaggcttagttggaaggatcgctcgagcccaggaggttgaggccgcagtgagccatgattgtgccactgcactctggcctgggtgacagagtgagaccccatctcaaaacaaacaaacaaaaacaacaacaacaacaaaaacaaacgaaataacaataaacaggagtctgcaaactacagactatagcccactggccaaattcctcctgtctgcataaataaagttttattggaacactacctcacctattcatttgcatattgtctctggctgcttttatactgcaaggacagtgtggcacaattggagccaaggcttctgtcccgcaaagctgaaactatctactgtctggccttttacatgaagaagtttgctgacccctggtctagaacaattcttggcacacagtaggcactcaaaaaataattgttgcagaactgaacctgtcactcatctgtgacccacacggggttgctagcttgctcttgtctcagagccagttccagctccgagtcacatgcaggaaaacaacagcccagcgaccaaaaataaaatactggaaccattccagtctttgctgcagagaaaatgcccaggcaggattgcagtcaggacccatggcaaaacttagcaccctcttcctccttttgctctagtaagactcaggcccctttccctccatcaggcatggaaactgctccctaattttttttgctcaaaatttccccccaaactctcttccacaaagctgccctgtccttggttctcccgtctcttcccctttcagctccaactttttatcttctttttctttttttctcaccctgtcttttggtgctgacagctttttgttttcatcagcttagttccttgctggctttccccacacctgtgctgctccttactcagattctgcataacgaggtcacgtctgggggctgtgccagctggtgggaatccagcttccctggaggctcagaatgcccccatattcccctttccttttccccggcacacacccgtcgtggtattccatcccccttcactgtctgggttccctctctgctgcagctgatacccacaggacccacagaggggtcagccctggacagccaaggactcacaatttaatgtgaatgatcccagtgcctggagttcagagagggatggctgacggggtggccttgatccctgagataatgagtttggggctttatcctgaggaccttctctggcaggcctggatggaggacagatggagaacttagaggcagtggagtgcctcctttggacttgattttctgggtctcagcctccctctgctggctttgtgcagcccaagctctacagccagactacattgattcgaattcaggctctgccacctttaaactgtgcagactacattgatttgaatgcaggctctgccacctttaaactgtgcaaccttggtcagctgtgcctcagtgtcctcatctgtaaaatgggtttgacattagaacttaccacttagcgttatcaggaggattataggatttagcacacagaaggggcttagaactgtgcctggaacacagtaagcactcaataaataccagcaactttcaaaatgctgatacagccgtccaccacatagaatgccctccgcaaaagaaagctcattactatcactcagtgatgtcatcaattacctcatagactgagcagaattgatgacatctccaattatgaggtcaatttagaacctggtgggcatgatgatatcacaagttgccaggtaaatctacctgggtaatcccaggctaaatctagccctgggtagtgttgatgacatcaccagttaccaggcagattatagttaaaatgtgggtgcccagtgccttctttcctgtttgaaattctgttgtgtcccagtccatactctttcctagcaccgttgggaacaggactttcatgtctctggacctcaatttttctttctttctctttctttctttctttcttctctctcttttttttttttttttttttgagttttttgtgatagagtctcagtctgtcacccaggctggagtgcaatggcacaatcttggctcactgcaaactccacctcccgagctcaagcaattctcctgcctcagcctcccaagtagctgggactacaggcgcccactgtcatgcctggcttatttttgtatttttagtagagatagggtttcaccatgttgggtaggctggtctcaaactcctggcctcaggtgatcctcccacctcagccccaaaaattgctgggattacaggggtgagccactgtgcctggcgtggacctcagttttctatccatcaaatggggataataaaagcaccagcctcgtagggttgtggagagaatccaatgagttaatacataaaagggcaaaatgtccagcacacagtcagcactccatacacagcagcactcattatctttactgtaggatgtttccatggagcacgctccagccagagtgacaggagccctcagctctgtcttggttaagacagatgcctgcaggggcctgtttcctaggagttggagcccagatccgccattagcagtagtcaggagaccctggacatgttgctagcctataaagtggggtaatgaccatgccagcctcacggggctggcatgaggatgcactgacataatgacagtcatgtttccagcacacaatcagacctcacaactgtgagctgtgttatcactgcgagtactctcagaaaggtccttttctccccaggatgttgtttccccatctgcaaagaagtggaaggtggctgtggcaatctcaaagccatggcaatcttgacactatgaccacagggatggtcctgtgattcacctttgctgttgctgagcaagtgcattgggagttggatgcttgaatctgtgtctgccctcagcacccaactccagcttctcttgtctcttttctgcccatctcttatctcccaacatttcctttcatatttctttggcttcttgctcgtacgctagacttcgtatgtatatagtttctctcctgcatgctgtttgtaggacaataaatggcaatagtcatgataatcagtattttctttttcttttctttcttttttttttgagatggaatcactctgccacccaggctggagtgcagtggtgctatctccgctcactgcaacctccgcctcctgggttccagtgattctcctgcctcagcctcccgaaaagctgggattacaggcgtgggccactatgcctggataatttttgtatttttagtagagacggggtttcaccatgttggccaggctgctctcgaactcctgacttcaagtgatctgcctgcctcagcttcccaaagtgctggaattagaggcgtgagccaccgctcctggccagtactttcttattcagccttttccctggtgccaggactgtactaagagctttgtaggcactaattcacttaatccactcaatacaagcactcattaccatttactcaacaaacacttattaaacacctactgtgtgccaggcactgaggattcggcactgaacaaaataaagatctttgtcctcgtgggacttaaattctagtgaggagacagatgataaacagataaattagcaaacactcccagtgctatgagaaaaagcaaagcggggttaaacgagagagagtgatgagaggaactgtcttatataggatggccaggaaaggcctcttggaagaggtgatattggagcagaacggatgatgtgggagagaggttgtcatgcaaaacctggggaagagcattcctggtggacccaacagagaatgcaaaggccttggggcagcaccaggcctcctggtttgagaaattgagccagtgtagctggagcagtatgaaggggagggcctgggggtgagatcagagagagcaaaagggccagccacatcccgcaggacctcattggccatggtgagttcttagacttttactgagtgaaatgggagccatggaaggctctgaacagaggaaaggccccatctgaatagagtagactgtagggagagcaagggtgaaggcagacagtccatcactcccattttacgagtgcagaaataaatggaatctcaaaaaagtccagcaactggcctgagcccacacagctgctgagcagccgagccaagctggcaggcctccttgggttcagtggagccattcctttgtgcccttggctctttttattttccttttaaatagagatggggcctatgttgcccaggctggtcttgacctcctgggctcaagtgatcctcccaccctggcctcccaaagtgttgggattacaggtgtgagccacggcacccttccaaccttgggaagtcttttggctctcctgagcctcagttttcccatctgtaaattgtaaatggggaatcattaccacgtttgggcatagcatggcggttaaaagcacaacttctggttggatctgagtccttgctctgccatcggccagctctgtgactttctgcaattaacaccctctttctaagcttggggttacctcatctagaagatgaagatcttaatagcaccaatttcaagggcttcgttgtaaggattaaatgagatcatgcaggtaaggcgcttagcacagctcccggtctacatcgaagtgcttgataaacgatcattgttattccgatagtatcacggcccacacctccccggtgggtgagagcctgggagggtgcctggtacatggtctacgttcgacaaaagtgaattctgtctcctgtctctcctgcccgccgggtcccgggggacccaggcattccggccttcggtcggcccccccacgccggcccttacaaaggcccccattcatgccttgcgcacaaagcggcccattcaccctggccccttgggcctcccgcccccggccgccccccgcgcctcgctattggtggcgccccgtgcccatcaggcctcggcttccacccccgaccgcgccgcctagctccgcgcccgggccgcgttcttttcccacggctggcacccttcgacaacttctgattggcccagcccgccagccgctctttttgattggcggctcccgtcccccaggggcggggccgtagcttgccgcagcgggcgccgattggcctctgctgctctcttgggggcggggctgtcctggcggacacgcccctctttctccccaggccgaagcctcgggacggccctggaagccggtgagtgcccggggccggcagccctccgggggcggcggaacgggactgagccaggggaagctggagcctgggggctgcgatcggggcccgggagcccgggcaggcggccggggacggcggggaggtgacgcggacactcaccttgggcgcgcagcgggacggcggcgagggaggtgggggggcgggacgtctacactcccccaactccagttgccgccgtgtgcgaggcccggtcggggtcctcgttgtcagccccgggcctgttccgcagaaggggaaactgaggctgtctttggaacctcggccgctttaatacctgagtcatcgcctccagtcccccgcccccagcatgacatgtctctgttctcacgtgtcagaatcggaggccagagagaggggtcgtgactggaagaggcggaggggtagggaaggacatatttgagaacctatgatgtacttggacgcttttattttttataactaaataatttcctttccttatcgtgttgactcgaggtgagttatattgtacccattatacagagaggggaaggctgagactgggccgaattggtgactgcagggggacctggtggagaagaacactccagagaccaactgtgtgctgggtcctttaaccttttcagtcccacaggagtcccctaaggaaagcggtggtccctgtggcatagatggggaagcaggttggtagtaatcaccaactgggacgcagaaattcatgtctttagggacctgctacaagttctttccagaccccctcctttagaatggcagaaaacggtataggcttgaattccagacctccctcttacgctgtgtgatcttgagtgccttactttgacccttcctgcctcagtttccacatcagagaaatggacatgctgatcacccctatgtcattggttgttgaggttattctaggccgggcgcagtggctcaggcctgtaatcccagcactttgggaggtggaagcgaaagaatcgcttgagcccaggagttcgagaccagcttgggcaacacagcgagacttcgtctctacaaaaagtaaaagagttagccgggcgtggtggcgtgaccctgctgtcccagctactcgggaggctgagcagggaggatcggttgagcccaggaggtcaaggctgcagtgagccatgatcgtggcattgcactccaagctgggcaacagagagagaccctgtctctccctctttttttttttttaaatcattttatgatctcaaagagctgttctaagaggagaaaatacccgacacatagtaggtactcttatcaccatgtagtctttatttcactcccgagactgaagctcaggacagaataccattgtcctcttctttggtactcttactgtctatagattttgttgttcccttcccgcagttgggaaactgaggctcagggagattaatgatgaagcactgggctggggaactttctgaacgtcgttttattaatttcactggccgcaatgcacagcagggaaagctgaggcccaggaagctccagcggggtttgaatcccgggaatcctcagccttctccgcggcgggccctcgacctttgccctccataagggggaggagcccctggcgccgccgccgccgccgcccacctggcaacaggctcaacccccgccttcccccggcccccgtcagaggccctgaagctccaggcccgccccgttcccagccgggcaggtgctgggtgacatcagagccgggctcccgccctgtgacgcgacggggccccgccctgcgctggaccgcggaggtcgctgcacctgaagagaacggggattcccgcgccctcaccccatctccccgctccggtcggcgcccccaggtagccccgaggatctgcgagttgagggggcggcgacacaggcgcttgggtccaggggaatgggtacggggctctcagactcctggatctgagaaggggccttgggggccggctgtcccaggtctgaggaaggactgcgccgcgagcccgaacttctgggtcctgggggaggaaaggactggggccaggactgcagagctggggtcttaggggaggagggggctgcaagcccggattctggggtctgtaggagcaggggctgggggcctgaactcctgggtctgagacaggagggcattgagtactgggactccggaaacccagcgctagaagccagggtcagacggctggatgccaagggccccaacctctgccccagggcggatccctggctgcttttctttttcaagcccagcagtctcggcccctcccagggcaggtgctttcacctgcccaggtgacagtaattagccctggcagagtgttcctgctggttgaggaagggtagggcagtcagagaggctcggccacttggagccaaggcctgcaggccctgcccgccccatcagggctgtgatccatcttcagaactcagcatcctcacctctagcccggctgcagtgaggtgagggggcctgcacttcccaatccataggaggagggggctgggggctcagactcctgggtcctgggagaggaggaggctgggagctcggactcctcagcctggggaaggaaagggctgggggcttggactcttggctccagggaggagaggcatagggcatagggtgattgcaaaaactccgaaacccttcctggtcaaaggccacagggctggtgaggaagtggatggggtggggtggggtgggtgggggtgagggtaaagtcccagggatggagtttgggtccggtgtatccaggtcacactggagatatggggtgagccttgacgatttgggggccacggggtggagaaactccctgctgccttcagagtgcaagggtccagcgtttgaggcctgagagcctcagggccaagagtcactggaagctggagctgctgggcttggggatgggaggagagggtctgggaggaagtgggtcctctcagcggagctgggattcccgtgggagaggcttgagggaaaggcaggagtctgttgggaccagatccaggggggcctccagggcagctgggcgtttagaaggacttctccaggggtatgtgggagcgaggtggggacggcagttgcatataggtctatcgggcagaggtgaagtcctgctgttggggagacagaaatctcccactgtttctgtgactgatgtggtggggcagtgatggggacatttgaggcagtggatgagagtaggggccgggcgtagtggctcatgtctgtaatcccagcactgtggaggccaaagcaggaggatcacttgagcccaggagtttgagatcagcctgggtaacatagggagaccctgtttctaccagaaaaaaaaaaaaaaaaaaaaaaaaaggctgggcctgatggtgcgcacctgtggtcccagctactgaggaggctgaagtgagaggatcacttgaacacaggagttgaggctgcagtgagctgtgattgtgccactgcactccaactccagcctgggcaatagagcgagacctatctctaagaaaaaagagagagagagagagagaaagagagagagagacagagagagagagagagagagagagagagagagagagagagagactaggggcagacttctttagcaggagggggccacgcagcaggatagggagaatatttttcctgcctggtgcttggaccgcgttggaattgccactactgcccatggcccgctggatggtgggaggggcctaacacattctagttcccccagcacctggttgcctccgagatagctggagctggatccacccctaggccaggagctcctccaggcagggctcccagcctactcttctctgggtcctcaggcccactcggggcggagtctcgtacttgaaagtcctcagagagttgaatgaatgggtccagtctccccattttatggagaaggagtcaggttccagagaaggaaggaattgttcactgaagcagtgagattcgagtctattctgcaggcatgagataggcgtgaccagaggtggtcagggaacctgaatgacaaaaatcaggtcaattcccaccctgggctcatatcttagagtaaaagcaaggttgtaccttttgtcccctctcttacatcccctcccaccctctgcccctcgatcatttggctctagccatgctgcctacctcacagtgacacagccacacagatgcattgtggccccaggacctttgcactgctgtctggaatgatttttctcccaacaacccccttcctcgctcctgtcatctcccttgggtcttcatttaaatgccacaccagagaggccctccctggccaccctaatgaaaacttcaacatcctcaaccctaacatttcctgtcccctggtttattcctccccttggtatttatcaccatttaatgtactatctggccgggcatggtggctcgtgcctgtaatcccagcactttgggaggcccaggcgggcggatcacctgaggttaggagtttgagaccagcctggccaacatggtgaaaccccatctctactaaaaatacaaaaattagccaggcatagaggcatgcgcctgtaatcccagctacttgggaggctgaggcaggagaatctcttgaaaccgggaggcagaggttgcagtgagccaagatcaagccactgcactccagcctgggtgacagagcaagactctgtctcaaaaaacaaaaacaaacaaacaaacaaacaaacaaacaaacaaaaaaacccaacaaacccaccaaacataccatatttggtttctgtaaaaaaataaaaaagagagagagaatttttaaaaaacaaaaaccatactatctaatttacatttttaatctttttatctgtctcctgggattacagcagctctgtcaaatagcaatataatacaggccagatgtgtaatgtaacattttctagtagccacatttaatgataaaagtaaaaaaggaacgggtaacattaatttaatgatatattttatttaacccagtagattgaaaatattatcatttcagcatgtcatcaaatatttaaaatctcagcaaactatctttttgttgtactaagtcttggaaatctggtgtgtatcttacacttagaactccagatggggatatttatatttaaattttaagatggggctcggtggctcacacctgtaatcccagtactttggggagccaaggcaggaggatcgcttgagcccaggagtttgagaccagtctgggcaacatagaagaccctgtctctacaaaacaaatttaaaaattagtaggcatggtggcatgcctgttaatacatttattttttaattaataaatttcagacatgaatcacctgaggctgggaagtcaaggatgtggtgagccgtggttgtaccactgcactccagcctgagcaacggagtgaaacctcatctcaaaataaaataaaatagattgaatttaaatgaatgaaattgaaaatgtgtttcctcagtgacacatgccacattgcaagtacccggtagtgcacaggtggtggtggcttctgcagtggacagcccggggctagaaagtaaacttttggaggcaggcgtcttcttccagcttgtctgttgctccattgtcagtgcccagaactgagcctggccaggagtggtggctcacgcctgcaatcccagcactttgggaggctgaagagggtggatcacctgaggtcaggagttcaagacctgcctggacaacatagtgagaccctaatttctacaaaaattgaaaataattggccaggcgcggtggctcacacctgtaatcccagcactttgggaggccgaggcgggcagatcaccaggtcaggggatcgagaccaacctggataacacagtgaaacgctgtctctactaaaaatagaaaacaatagccgggtatggtggcaggcgcctgtagtcccagctactcaggaggctgaggcaggagaatggcgtgaacccaggaggcggagcttgcagtgagccgagatcgtgccactgcactccagcctgggcgacacagtgagactccatctcaaaaaaaaaaaaaaaagaaaataattagccggggccgggtgtggtagctcatgcctataatcccagcactttgggaggccgaggcaggcagatcacctgaggtcaggagttcgagaccagcctggccaacatggtgaaaccctgtctctactaaaaatacaaaaattagctgggcgtggtggcagacgcctgtaatcccagctacttgggaggctgaggcaggagaatcacttgaaccctggatgccgaggttgcagtgagctgagatcacgccattgcactccagcctgggcaacaagcgagactccgtctcaaaaaaaaaaaaaaaaaaaaaaaaaaaaaaaagaactgaccctctgagcctggttcacagcctagcttattaaagaatgaatgagtgcctagagaggtgaatgaatgaaatgagtaagctgggtctgttaacccactttgcagaagtatggcaagaggtctggtaaaggaaggcagaggtggctgcctggggaatttggggtagggaagggaggcccgggggacggagccccatctgacccccaccctctttctttgcccctgcagaccatggcagccgtgaccatgtcggtgcccgggcggaaggcgccccccaggccgggcccagtgcccgaggcggcccagccgttcctgttcacgccccgcgggcccagcgcgggtggcgggcctggctcgggcacctccccgcaggtggagtggacggcccggcgtctcgtgtgggtgccttcggagcttcacgggttcgaggcggcggcgctgcgggacgaaggcgaggaggaggcggaggtggagctggcggagagcgggaggcggctgcgactgccgcgggaccagatccagcgcatgaacccgcccaagttcagcaaggccgaggacatggccgagctgacctgcctcaacgaggcctcggtcctgcacaacctccgggagcggtactactccggcctcatctacgtgagtgggctcctgctggggggcgcgtgcggcggagttgctgccggttggggaaccaggtccaccacccggctcccctgcattaacttgaggctgtttatcatctgtatcccatgtcccgtgactgttcctacacttacatggttgccaaattatgaattgttggattactaggacagcctcggaacctactggggacattgcatgatacatatggtagataaactgtattattttcctaaagtataaaacgttccaatttctcagatatagctcatcccgagttttaaggaacggaaacagatgtgtgacaatcattaatgtgaatcactgagtatagaaatgtgttgcttgaggttcaagaccagcctgggcaacaaaacgagaccctatctcttaaaaaaagataaattagccaggtgtggtggtggcccgtgcctttagtctcaccttctaggaagactgaggcaggaggatcacttgagcccgggaggtcaaggctgcagtgagctatgatgataccactgcactccagcctgggtgacagcacaagaccctgtctcaaaaaaagacaaaaagcaaaaaccttatgctaggctctgtgctaaatgcctatctattaattcattcaatctcaccataggaaagatagagtctattattattaccattttacctaagaggcaaatgaggcccagagagagttaataacaataaaaatgaacatttattaaacatttaccaaccattcttccaagctttctaaaatacattgcctctgtacattttcagaattataaagcatctgatcctcattttacaggtaagaaaactgaggcacagagagttcaaggtcacacaattagacctgacagagccaggtagtctgtcttctcactttgctgtggtgcctcttaagattgagatggggctgggaatggtggttcatgcctgtaatctcagtactttgagaggctgaggtgggtggattgcttgagcccaggagttcgggaccatcctgggcatggcaaaaccccatccctgcaaaaaaaaaaaaaatacaataaattagctgggcatggtggcacactcttgtagtcccagttacttgggaggctgaggtgggagaatcacctgagccctgaaggtggaggctgcagtgagctgtgatggcgctactgtactccagcctgggtaacaaatcaagaccctgtctcaaacaaaacgaaacaatacaaaaacccattgagaagagattgatgatacttaggttgactatggtagtcttcccacgtctgtgctaagcattggaggttcgttgcatttttaaaactctttacagcaaacggatggggtagagcagtggttcttaaccccacctctatggtagaatcatttggggaattcttagaaaataccagtgacggagccccaccccagaactttcagtcgagctctctggggctgtgacatgaacattggtatttttaataagcttccaaggaggttctaatgggcagccaaggggttattaatttcattgaacaaaagagcaaacaggattagagagattgacaaggaatatggacaatcataatgaaaaataataataagaggaggctagcaaatatttaatcgagcactcgtgatgtgccaagcactgttctaagtgtggcgtgtgagttatcagcttccctctgggccagggactgctgatatcacctgatgttcaggatgttaagtgacccacagccatgaaggaatcacgccaggatttgaacccaggcagctggttccagagtcatgctccaaactctagcttagactggtggggtctcacagctttgctccaacatccacccctctgaggttcacaaagcggaagattagaatatttttgtgaagtcccactcctacttggagatcgaggctctgagataagcagtggctggctcagggtccctcagcttgtggtggcaggtgtggaatttgaatcgagggctgtcggaccctgcatggggttggtgtcttctccagtctgcactggccctttccaaatcctcaaacacctttactagccctggaaaagaggcctctacatgatccactcccccacatctcacccaaggccacagacatcaggatgacatccaaaacatggatccactagttgccttttattcatttatatatattttttgagacagggtctcactctgttgcccaggctgcagtgcagcagcatgatcttggcttactgcagccttcacctcctgggatcaagcaactctcttgcctcagcctcctgagtagctgggactacaggcgcctgccaccaggcccagctaatttttgtatttttagtagagttggggtttcaccatgtttgtcagagctcgaacctctgagctcaagtgatctgcccaactcagcctctcaaagtgctgggattacaggggtgagccactgcatccggccactctttgccttttaataaatactctgagcgctcccagcaaccttgtaaggtatctgctgtcatccccgctctgcaggtggggaagctgagcctcagactagggggcaggatttgaacataagccccacaactaggaaccagctaagctagaacttgaaaccaggtcactgtgactgcagaccccaggtcctagccattgcactaggaagattattcagaaagttcaggagaaaaagtggtagggcctgagctaaggtggtggccagggagccagacttttggggcctaagaaatgaatgtgagagagaagattctagaattccagacaggaagcacattgggccttaataaagatcattagcacttagtgagtacctgctttctctgctgggtgctgttctaaatttctttccaatatgatcttattgaccccctccccatccacataaggttgtgaggtagggattatcaccctctttttcccacagcttggagaggggaagccatttgcccaacagaagctgatagtggctaaaatattgagcatgcagtgtttcaaggtccatgttctgttttttgtttgtttgtttgttttagacatagccttgctctgtcacacaggctggagtgcaatggcatgcttacagctcactgcagctcaacctcctgggctcaagtgatcctcctgcctcagcctcctaagtagctgggactacaggcacataccaccaagcctggctgattttttaatttgttgtagagacagtgtttcacaatgttacccaggctagtctcaaactcctggactcaagtgatcctcttgcctgggcctctcaaactgctggatttacaggcttgagccactgctgtgcccagctggggttcacattaaaccctctgcatgccacatgaacttgtggatgactcccaggcaccttatgtaggaagcactatttctgtccccgttagctaaagacactgagaccctgaaaggttgcttgctggagccacctggcctgaaaatgttacaggtgtgattcaaactctgccctatttaagacctgtgcttaatacatgtttgttgactgaccaactgatgatggggatggtggtgttgtccagtgaaaagtgggacatccagggctccagaaacccagtttctgccactaataggctgtttggctttgagttgctaagagtctcagtccctttcctgggacccttggggcagggagggaaccccttcgtagaacaccccgctctgagaaacacggaagatgcattatgtgatttcacactcagaacacttctaggtgatgggttaaaagccgcattttccagggctggaaactgaggtttagagaggacacatccttcattcaaattcacacacagctcaaaaatgctgcatctgaatttgaacactggatggcttcaaagtctgagtgatgagcctgagagtttgaggctgcagtgagccaggatcgtgccactacactccagcctgggcgacagagccagactctgtcccacccgcccccgtccaaaaaattccgagttagcctagggctcccaggtaggatgagtgatgtaagagtctccagacccatatctggcgtgtgttgcatgggccccgcctcggcctggctggtttttatccatgatctcccctaatccccacagcctttgtaatgaggtggggagtgtcgccctcggtttcccaaggaggaaactgagactatggggaaagtcaccaggctgaggggagcgggggggcaggtctgtcttcagagccccgagggctggagcagccattcctgacccttccaggagggcttccccagctgtctcccaccctgtgggggtgcaccagcctttgttcttccccccagccttgttgaccagctcaggtttccgttcccagggtgtcgccctggaaacaaggtgtggctggcaggaggggccagggtgggagggtggcgtggggagtgggttcctccgccagccaggagtgggggccggggcgccggcagccatgagataccctcccagggaatgtggtccggccgccccaccctctgagagctggggggagctcccggagcagccctttcaggcagggagggcagacacccagcaaaccggttgttctgctcctggctggccacccaggccacccaccctcccaccgttagaaggttggcacctgggaccaggcagcctgtggtggccacaccctactgtgcttgagaagctcaagctccctgggagcttaaaacagttctgctggccgggcacagtggctcatgcctgtaatcccaggcatgccggggtgggaagatcacttgagccaggggttcaagaccagcctgggcaacatagtgagacctgatctctacaaaaagtaaaaattttaaaaattggccaagcatggtggtgcatacctgtggtcccatctgcttgggaggctgaggtgggaggattgtttgagcccaggaggtagaggctgcagtgagctgtgttcatgccactgcactccagcctgggtgacaaagtgagatcctgtttctaaaaaacaaaagaaaaagatagtcctgctgctaaccagcttagaaaccagctagctgggtgactagcagagtaggttaccctactttatcacacacagctagaaaacacatctgaatttgaatcccgggtggcttcaaagtcaagcgacaagcccagagtagctaactagctaagccactaagcaggtaattctctggctagtttagctagctaactttagatagcttggctagttagctctctggctggtttagctaagtggctaactagctctctagctatgtttaactgcttctgtgagtgttgagcccctcttgcctacatgatacccttgtgagctggatttgttcttaaactgttacagagtcctgaggccgggtgtgaaggttcacatctctaatcccagcactttgggaggccgaggtgggcagatcacttgaggtcaggagttcaagaccagcctgggcaacatagagagaccctgtgtctacaaaaaaatacaccaggtgcggtgactcaagcctgtaatcccggcactttgggaggctgtagtgggagaattagttgagcccaggaattcaagagcagcctgggcaacgtagtgagaccccgtctctactaaaaataagaaaaattagcctagtggattgacacacacttgtgatcccagctactctcgaggctgaggtgagaggattgctttagtctaggaggtggaggctgcagtgagccatgattgtaccactgcactccagcctgggtgacagagtaagaccctgtctcaaagaggggaaaaaaaaaaaagactaggcatggtcatgtcagcaggactgttatgtgtctattatcagtagaaaccgcaggtatgttcctgttgcatttcggttattgcagataccacaggcacccttccagagatagtccatgcatattcaaatgaatatataaaaatatataaaaagattcctcttccatcctttcttttttttttttttttttttttttgagacagagtctcgctctgttgcccaggctggagtgcagtggcgcaatcttggcttactgcaacctccgcctgccaggttcaaacaattcttctgcctcagcctcccaagtagctgggactacaggcatgtgtcaccacacctggctaattttttttgtacttttagtagagatggggtttcaccatgctggccaggctgggctcgaactcctgacctcgtgatccacccgtctcggcttcccaaagtgctgggattgcaggcgtgagccaccgtgcccggccctcctcttccatcctttctaatgcaaatggtagctcctcacgcagtcctcaactcacctccttttacttgatattgatttgaagacagtcccatgtctatacataagagctttgtaggaatgcatcgtatgaagatgcattcaggtcgtttctagtcttttgctgctacaaagagtgcctcaaccggtcacctcgcacatggtcatttcctgtgtgagtccaggcagccacaggctgtgacccaagtctggctggctgcaaaggccttgttctctctcaggacaaatcctcacccagacagtgcctttgtgcaatttggaaagattctttgctaccatcagcctgaaaatgctcataacaaacattcaaatctacattgttatggtgtagacataccatgtgcagatagatgcccttgtgcagtgcacggcctgctcagcagccccatgacgcctttcaggccgtgggcagccatctgagaccctctcccctctcacccactgcagacgtactccggccttttctgtgtggtcatcaacccgtacaagcagcttcccatctacacagaagccattgtggagatgtaccggggcaagaagcgccacgaggtgccaccccacgtgtacgcagtgaccgagggggcctatcggagcatgctgcagggtgagtgctgggtggggctgtaggccagcgaggcggctcttcaacgggggcctgacctggggctgccggaagccagagtccaggtcaaatgacagcttgtagacttgactctgtagggcttcttagggggctggagggagcacaagtagaggcctgagtgggtgaggtgctaggtcctagagtctttttacctgtctccatgttcattgtctcttttattattgttattattattattagtttgagacggagtcttgctccgtcacccaggctggagtgcagtggcatgatcttggctcactgcaacctctgcctcctgggctcaagcgattctcgtgcctcagcctcccaagtggctgggactacaggcgtgcaccactgcgcctggctaagagatggggtttcaccatgttggccaggctggtctcaaactcctgacctcaagtgatctgcccacctcggccttccaaagttctgggattacaggcataagccaccatgcctggcctctttttaaatttttaaataaattaatttatttttggccaggcgcggtggctcacgcctgtaatcccagcactttgggaggctgaggcaggcggatcacgaggtcaggagatcgagaccattctggctaacacggtgaaaccccgtctctactaaaaatacaaaaagaattagccgggcctggtggcgggcacctgtagtcccagctactcgggaggctgaggcaggagaatggcgtgaacccgggaggcggagcttgcagtgagccgagatcgcgccactgcactccagcctgggagacacagggagactctgtctcaaaaaaaaaattaatttattttttatttcaatagtttttgggaaacaggcggggtttggttgcatggaaaagttctttggtggcgatttctgagattttggtgcacttgccatcggagcagtgtacactgcacccaatgtgtaatctatccctcaccaccccccactacccttcaccctgagtccccaaagtcagttgtgtcattcttatgtttttgcatcctcagaacttagctcccacttacaagtgagaacatacgatgtttgattttccattcccgagttacctcacttacaataatggtctccaatttcatccaggttgctgtgaatgccattatttcattcccttttatggctgagtagtattccatggtgtatgtgtgtctatatatcccatggtgtgtatatatatattttttatatatacacaccatgggatatatactctctctctctatatatatatatatgagtattccatggtgtgtatacactcacacacacaccatgggatatatatgtgtgtgtgtgtatacacaccatggaatacatatatatatgtatcacagtttatctactcgttggttgatgggcatttagtctggttccatatttttgcaattgtgaattgtgctgctataaacatgtgtgtgcaagtgtctttttcatataatagcttcttttcctctgggtggataccccagagtagggttgctggatcaaatgatatatctacttttggttctttaagtaatctccatactgttttccataattaaaaaatcaaaaaataacatgttggtgtggatacggtgaaatgggaacacttttacactgctggtggaatgtaaactagtacaaccactattgaaaacagtatggagattctttaaagatctttgttccctctttctccgaacaatattggttgggtgtggggcttttacgaacatttcccttgagacagtaattcccagagtgttcattcatttattcaacatttatcgttgaattgtagatctgatctccattgtcacggggtaaatgtagccccttagacagatggcaggtcaaggcagttgtgtacagctgagcaggttgtacactgaacaagggtatccatccaaggggctgccattcataccatgacaacatagatcagtcctggcagaattacatgattaacatctattatagatataatgcccttattatatatttgctatatatcatctattttcatagatatttagtattttttgtttatatctattaaacatttaaaaattatatctatttacatcatataacatataataggccaggggcggtggctcacacctgtaatcccagcactttgggaggccaaggcaggagaattgcttgagttcaggagctcaagaccagcctgggcaacataacaagaccctgtctctacaaaaaaatttaacaagtttttgttaaaaaaggaaaaaccccatgtaatagtacacaacattcagacccttcgatcatggcttcgaaacccatcggtgccgctcgccatttccgtcccgcaccccagcctcacccaccttcctgtctgtcaaacatccctaagtcagtcctacctcagggcctgaatatgaatatattatacttattgaatatgcatattaaatatgagcaaattattaaatttatatatttgattaaatagtataatattgtgaatatattatgcttatttaatatgcatattcaataagtattttattttattatactttatttttattatacttcatttttattttattatactttatatttattttattattatataaatgtaatgttgatttaataaattatacctattaatatgcatattcaataagtataatgtgttaaattaaatagtataacatattaaattaaatggtatattaaatagcataatattgtaaacatattatgcttatttttttttttgagacagagtctcactctgtcacccaagctggagtgcagtggcatgaccttagctcgctgcaacctcctcccgggttcaagccattgtcctgcctcagcctcccgagtggctgggactacaggcacatgccaccatgcacagctaatttttgtatttttagtagagaccaggtttcaccatgttggccgggctggtctcgaactcctgacctcaggtgatccgcctacctcagcctcccaaagtgctgggattacaggcatgagccaccatgcccggcctaatatgcttatttaatatgcatattaaatgggagtatcaaatgggaatactgaagtctccaggtagaatagtggattcatctatttctcctggcaggtctatcagtttctgctggattaattcatttaacctcgtagcaaatctatgaaataggttatctccttgtccctgatttctgggtggggaaactgaggcacagagcaaaacagtcatggtcacactggtgggtgtatgctgaggtgggattcgaacccagggcccctgaccaccgcctccctgtatgtcacactgtgtgttatatttcctcctgtgccgtgcactgtgctgagtgcattttgagcattctgagttctgactacagccctgggagatggcagctgttttgagccccatttttcagatgggaaaacagaggcacaaagcaactcagagactggcccaaggtcacgcagcaagtcagagaggcagccgggcggtgaacctgtgtgcatatagtcccccataccaggctgccaagtctgaggtcctactggacgcagcttactccctggcttgaagacacccagaggatgcctgtcctgcttaaaaaaacattcagaccctttgatcatggctttatttatttaaatttatttatttagagacggagcctcactcttgtcacccaggctggagtgcaatggcacgatcttggctcactgcaacctccgcctcccgggttcaagtgattcttctgcctcagcctcctgagtagctggggattataggtggcgccaccatgcctggctaatttttgtatttttagtagagatggggtttcaccatgttgcccaggctggtcttgaactcctgacttcgggtgatctgctggcctcggcctcccaaagtgctgggattacaggtatgagccactgtgtccagcctaatcgctgctttaaaacccatcccaccactcgccatctctgccctatcccccaacctcactggcctttctgtctctcaaacatttctaactcagagcctttcccctggctgtgccctctgcctgaaatgccacctccactgagaagccttccctgctccttcccccaagtcaattcttattacctaacaccagggttttggaatcctggctctactgacatttggggctggatgattctttgtcgtgggaggctgtcctggtcattgtaggatgtttagtagcaccccggcctctacccactcagtgcccatggagctctcctctctcagggtaataaccaaaaatgtctcccagacattgccaggtgtctcctggcgggaatggaggacataattacccccgtttaagaaccactgcttcggccgggtgcagtggctcatacctgtaatcccagcactttgggaggccgaggccggtggatcacgaggtcaggagatcgagaccatcctggctaacacagtgaaaccctgtctctacttaaaatacaaaaaattagctgggcgtggtggtgggcgcctctagtcccaggtacttgggaggttgaggcaggagaatggcgtgaacccgagaggcagagcttgcagtgagccgagattgcgccactgtactccagcctgggcgacagagcaagactccgtctcaaaaaaaaaaaaaaaaaaaaagaaccactgctttattctagtactgattcaattttcttcccagtgctgatcggtatttgattgtaggtttctgtcccctacatcttaagtggaagctctgtaggggcacacaccctgccagttccccactcccctccatgcctggcgctcagtaggtggtcagcatgtgattgtggaatggctgtgttaggcccagggcaggcgctggggtagacatcttatattacaggacctcgcttctgtctttgaatctcacatgcccagcatgaggcagcacacagtagggtctcacgttgaggtcgttgaatgaatcatattctcttcagttgagggaggctgtctccattttacgggtgaggaaaccaaggctcagagagggacagctgctttcccagggtcacacagcgagcagggggctgagctgggtggggaattagaatccaggattgttacacatcaagacccaagcttttccttactccctgggaataatttttaaaatgcagcggccagtgtaagggaccagagggccctgctagagactctctcagatgacatattcccccactctgtcccctacagatcgtgaggaccagtccattctctgcacgtgagtaatctggaaggacttcctggaggaggagaggtctgggtggggcgtggctgtgtttggaatgggcagggcaggtggggagcttgcctgaggtcattgccaacccctttgcttccccttgtcatccccacagtggagagtctggagctgggaagacggaaaacaccaagaaggtcatccagtacctcgcccacgtggcgtcgtctccaaagggcaggaaggagccgggtgtccccgtaagcaaccccgccttgggtcacccccgggccctgccacagcactgccccttccatcttgggctttccccacaattgtctcttcccctcatggaggtccttctcctagacgcctatgccacctgagcacctactgtgtgcctggggtggggctggaagcagagtcagggggacacagaggtgtgagggtcagtcttggtctcactggctctcggaatggctcctagtacttagtaggtgctttcttttctgagcacctactgtgtcaagcctgattttaggtgatcatgatgcctgggtttgtcgtctaagtgaatgttatatggtgccctccactgttccaagccctgttctcacactgccttacttacccctcgggtggggtgggtgctgttttcctgcactgaagacggagagcccaggcatgggaggggtgagtcagttgttggtcatgcaccgaggaagaggtacagtgaggccgggcacagtggctcatgcctgtaatcccagcagtttgggaggccgaggcaggaggatcgcttgagcccaggaattcaagaccagcctgggtaatatagtgggaccccatcgctacaaaaaacatttttgaataaaggaggtagagtgggattcaaacccaggagtgtggtcctccaggccaccctactccacatgcccggtttccccagtcccccttcccccaccccccatgccaccacctgagatcactggttcacctgtgtgtctgtccacgttccatgtgctgtgtcctggtccgtgtctcgtgtcccgtgacttcctcaggcctccgtcagcaccgtgtcttatgtgagtagcaggggatcacctcgagtcttgctgcccctaatgccttcccggccacccaatgcatgatcttcttggtagacagggcccaaggcagcagtggtcccacctgccagggacccctctgccccaccactgctattcatggcggccctgctgtgtgagtgtgtgcagatgggccacagacaccaacatgaaacaatccagagaacaaaactgccacttactgctgatctactaaatgtgtccagccagggcccacagatgctgcgtgcacacaaccagagtgaacagtgtagcaagggaaatacacgcatgtcccatgttcttctgtgtgccaagtcatgtgcccttcactttgtgtatcttttcatttgacaaagcatccacctagctagatcatttcatcttaacacaagcaagacatggactgagagaagacataaacaggctgccatttatgaagcacctactgtgtgccaggctctgacaccaagggggctggagggaagtttggagtagagttcctgccaaggagtagcctggtggggctaggaacccactattttttgaaggcctattatatgccagactgcttgaagcactttacataggtggtacagatttttgccttacttaaaaattctaggctgggtttggtggctcaggtctataatcccagcactttggaaggctgaagtgggaggattgcttgaggccaggagttcaagaccaggctaggcaaaagagtgagaccccatctctactaaaaattttaaaaagtagctgggcatggtggtgcttgcctgtagtcccagctactcaggaggctgaggtgagaggattccttgagcccaggaatttgaggctgctatgagttatgaccatgccactgcactccagaatttctacaagcaacacatgagtacatattcattgtaacaacaacaaatcagatgaaatgaaattcctgtttcctcccctcagtccccttccttggagtgccttacactgttgacagtttggtgtgcatccttgcagacctttctccatatgtttacaaacatgtatatatctgtagatttaagagtcctgttttgtggcgtttcttccttaattcatttcttattaatgggataacattgtagacattgttctgcaacttgtttttttgtttggcttggtttggtttggtttccacttaacaacatgtcttggagatgcttccctcttcccctcacaatagacagatgggcaagacccggatatgggaagtgggtacacgcccagacacacaaaggcccctcacacacagatactcagtcagctggagacacagcccgagctgggctggcctggcctcctgccccattctcactgacctcatgcatcatctcctgtgcccggcagggtgagctggagcggcagctgcttcaggccaaccccatcctagaggcctttggcaatgccaagacagtgaagaatgacaactcctcccgattcgtgagtgccaggggtgggcagtgctggctgtgtcagggatacaggagctgggaacctcagggtgggcttcagggggaaagacacgtggatctgttgagggaggaggggctgggggtctggactcttgagtctgagggaggaggggctgggggcctggacccctgggtctgagggaggaggggctgggggcctggactcttgagtctgagggaggaggggctgggggcctgaacctctgggtctgagggaggaggggctggggccctggattcttgagtctgagggaggaggggctggggacctggactcttgagtctgggggaggaggggctgggggcctggacccctgggtctgagggaggaggggctgggagccccagacccctgggtctgagggaggaggggctgggggcctggacttttgagtctgagggaggaggggctggggacctggacccctgggtctgagggaggaggggctgggggcctggacttttgagtctgagggaggaggggctgggggcctgaacctctgggtctgagggaggaggggctggggccctggattcttgagtctgagggaggaggggctggggacctggactcttgagtctgggggaggaggggctgggggcctggacccctgggtctgagggaggaggggctgggagccccagacccctgggtctgagggaggaggggctgggggcctggacttttgagtctgagggaggaggggctgggggcctggacccctgggtctgagggaggaggggctgggggcctggacttttgagtctgagggaggaggggctggtggcctggacccctgggtctgaaggaggaggggctgggggcccagatccctgggtctgaaggaggaggggctggggccctggactcttgagtctgagggatgagggagtgcaggcccggatccctgggtctgagggaggaggggctggaggctgcgtgcctagttccaagggaggagcagctggggaccagggggctggggaaagaagtccaaggggcccggaccttgaattcccaaggagccccccgatggggactcaccacaggatggggttcaggtagagggagcaaggaagtgggggggcagccgcagctctgggagcagtgggtgtggggtttgggctgttgttcacgtgtgagtggggaaggggaccctctgctgaagcccacccactttggtctctcccagggcaaattcatccgcatcaactttgatgttgccgggtacatcgtgggcgccaacattgagacctgtatcctctcacagcccatgggggtggcagccaaggggggcagcctttcagacagcactgagtatggaaagcacctcccactgcagggaccccttacctgctactcagatgggacctgatgctcaggcggcatctgcatggggaggggagggtgggacttctggtgtgtatgaggccagcacagcctcgctatggggtggtgggttggggtccacccagttcagccataaggggagtcccagcacttagcctgcagtggcactcatggtgacccatgacagtgaaatgacatagagcagtataagcaaagggaaaaggcacgtggggccaagtccccagggaccaggcacaagctcctagaaccctctccagcagaggcacacaggacaccaggtgcgacaacacttatgaaatgctgtcccggggaagcacagagagactcactaccagggttttcactggtggctggccacatccccgcctgcaccccccgtcccccgcccttagtatgaaccaaaattccacactcccgggaggaaagcaggtgatcagtgtaaaccacagtgtttgcacaaaccctttaggtctagcgaacccctcatcctgttagaggatgctggaaccctcccgaaatccaggtgcccagacgctagccaggggcccacctggccagcaggcctttccaggggagcatctcaggacggctgttttctgctcagatggcatatgggcgtttaaaggaaattaaacaataaaacacaggcactctgggagtgcagaaattaagagaatgggccaagaaatcgtaccaacctgggttcaaatcccagttctgccactttgagactctggggacttgggtacgtgacttggcctttccctgcctcagtttctccctctgtagaaggagaaggaacatagaacctacccaagaggggtttggaggattttggagttaaatgcttggccacagcacctgctacatagcaggcactcaagaacaagctattattagcaattaatgattaaattagtggccaggcacggtggctcatgcttgtaatcccagcactttgggaggccaaggccggtggatcatttgaagccaggagtttgagaccagccaggccaacatggtgaaaccctgtctctaataaaaatacaaaaaaattagccgggcgtggtggcgcatgcttgtagtcccagctactatggaggctgaggcaggagaattgcttgaacctgggaggcagaggttgcagtgagccgagatcacgccactgcactccaacctgggtgacagagcgagactctgtgtcaaaaaaaaaaaaaaggttaaattagcaatatctgtatcaatgctaatattattgactaatattgattgataattactaatcaataacattaacaactgctaataagccacatccccatcccagaggcatctgataagctcacgctcttccataatcagtggggaggggtttctcctaagtctgctcagggcatgaagcagccagccggcccgttggttctgctgccttgtgggagatgcttcctgggctgtcaccaccccaagtccccagcagcaccgcagcccctgctcctgccgttttctgctcatggctgctccttcctccaggtcctcttgcccttggctcccacctctccatggtacctgcatatccaggttcttggagctcatggctcttcctgccaaactgtcctggcacttgtgtgtctctgcttatattcatatttgccttctctgtccgcttccacctgctcactttctcctgtccacgctccccatgcagtgtggctgcccctcctgggcacagctgtggtcccggctgtctcaggcaccagtggattgatgctcatgaatcaggtcccgcccccaggccaatcgtatgagtcttgggatggcctgccgggtaaggagcaccaccctgtgtggctgacccctcggcactagcatcagtgccatcgtgaccagcttttctggagtgctgactgtgtgcccaccgccacctcgagagtccccatgatatctcagttcctcctctctgcaaccctgcgaggtggctgctgctatcacccccgcttcacagaggaggaaaccgaagctcagggctgttgtcccccagggttcgacagcctgcgtgtgctccctgccttccagctttccttgtgggagcccctccacctgtttctccccatctaaccaagcaggttacaccccagggcttctgggaaatggacctcaggtttgcagctgatcttggtccaaatatgtatttggtggtgcatgagtgtggtggtgcatgagggacacagaggggttaagcaaagtgtatggtgttttggtgttttgttttactctaagatgttttggctgggcgcagtggctcatgcctgtaatcccagcactttgggaggctaaggctggaggatcacttgagctcaggaattcgaggccagtcagacctcctctctactaaaataaagaaaatttaaaaattagccaggtgtggttgtgcacacctgtagtcccagctacttgaggctgaggtgggagtattgcttgagctggggaggcggaggttacagtgagctgtgattgtgctgctgtgctccagctgaggcaacagagccagaccctgtctaaaaaaacaaaacaaaacaaaacaaaacaaacaaaagtcttgccaccttttaatatgtaagtttgacacgtgactttcttgggagggagagcatgcagagtgacagtctagttgaaggtgggagctgattatctgcatggggaagctgaggctgggagagtactaatggcaggagacattctcacctgcgggtaactttgaaccaggcattgttcagggtgcttcatgcacaataagtcatttatcttcacagcaactcatccagggtcgatgaggtttctttgttttgtttttgtgacagagtctcactctgtcgcccaggctggagtgcagtggcgcaatctcggctcactgcaacctcctcctcccgggttcaagcgattctcctgcctcagcctcccaagcagctgagattacaggcacccgcgatcacacctataatttttgtatttttagtagagatgggattttgccatgttggccaggctggtcttgaactcctgacctcaggtgatccgcctgccttggctttccaaagtgttgggattacaggcgtgagccactgcgcccacagggttgatgagttttttagagacagagcaagaccctgtctctaaaaagagagagagagagagaggaaggtctcctaaaggtgttattttcaagccccttgaacaggtagatgaggaaactgaggcacaagtgcttaagtgacatgagcacggctgctcttccagttagtggcaaagtcaccagcctgggctgtgagcgactccactacaccacaggagagaagggggcagcgtgggcagggcaggctcctgtagtggcctggcagcgtcggggccgtcccttcccctctagcaccttgactcgctgtgtccagacctgctggagaagtcgcgggccatccgccaggccaaggacgagtgcagcttccacatcttctaccagctgctggggggcgctggagagcagctcaaaggtcagtgccgccccgtcctaccctgctcacccgggagagggtgggcaccatgtctctcgggggccccttctggggaggaagcaagagtggggggctctaatatccgtcaaacaccgacttcgcatgaggctcccgcagcccctgctctcgctgcgtagtggcgtctgtcgcacggtgggttctgctgcgctctggttccagctctgtcccgggtctggctcgcgcccgctgtcacggccacgcagcccccgccgcctggtggctcctgctcacgctcgcttccgaagctccgtggcttctctctcgcgcggcttctcctcactccggcgggtgactccggctttgctgaggctcctcctggttcctgacgacgctggtttgtgttgcttctcggctcgtgctgcctcgtgctcccctctgctctggctcctaggccacggctcttgccggagtcctcctgtccctgctccctgttcctcctgccctctggctgcccaagcgcccttggctcctgtttgcagtggctggcactgccctgtagctccctctgctcctggctccttcctcctggtggctcaggccgcttcctggctcctgcggccacatagcccctcctcatccaggttcccactcactgtggcctttgagaccgcatgtccttgggcgccggcccctgccatcccatggcctgtgctgacttgggcctgcagccccactgcttctgccaaccagtggcccctgcctgctctgggcacttctagagactcaaaagtccctgcggagggagcaaagaggagtggtatacactgcgtggggactcatgcctgcaatcccagtactttgggagggtgaggcaggaggattgcttgagcccaggaatttgagtccagcctgggcagcatagtgagacccccatctctgtaaataataacaataataataagctgggcatggtggcacacagctgtagtcccagctatgtgggaggctgaggtgggaggattgcttgagcccaggagtttgaggctgtggtgagccatgattgcatcactgcactgcagcctgggcaacagagcaagaccctgtctctaaaaaattaaaaaaaaaaaatagagacagagtggtggtctcataggtgctaaacgcccactccacccccgacccttcccaccacacttgtgagtaaaggcccccacccacttgacagtgaggatatggcatgtcctgggattgccaccgatgaatccaggatgagtctgactgcacagcccacctttgaccttgaccccactcattgtccctgcagccgacctcctcctcgagccctgctcccactaccggttcctgaccaacgggccgtcatcctctcccggccaggagcgggaactcttccaggagacgctggagtcgctgcgggtcctgggattcagccacgaggaaatcatctgtgagtgagccccgtggaggccaggggtaggggggaaccccacggagagctggggacctggccattcatgccccgatctctttgagcaagtgtttattgagcacctactgggtgcaggcaccggggccagagcagggaatgaggctcacagacatctctgccttgaggaagctgacaaaatgagagcccccaaccaagtcaataaggaatcacatggcctgttagtagactatgagtgcagctgggcgcagtggctcatgcctgtaatcccagcactttgggagtcccaggcaggtggatcatttgaggtcaggagttcaagaccagcctggccaatatggtgaaacaccgtttctactgaaaatacaaaaaagttagccaggcgtggtggtgggcacctgtaatcccagctactcaggaggcttaggcaggagaatagtttgaacccaggaggcggaggttgcagtgagctgagatcgcaccactgcactgcagcctggtcaacagagcgagactctgtctcaaaaaaaaaaaaaaaaaaaaaaacaaaaagaccatgagtgccatggagaaagatgggggagggaggggcacagctttaagcaggggctcaggggagggtggactgagatggggatgtttgaacgaagtcctgaggaagtgagggaatgagcactggagatgtgggggaagagcattcctggcagagggaacagcctgtgcaaaggccctgaggcaggaaaggggtggcatatttgagggattgacacttctggtggtggagctgcagaggggtggggagtctcaaacgccagcctaggaggttgggactttgtcctggggtgctggggagctgtgggagggctgggagcaggggttggacaaattcagctctgggagcaagaagaccccttgggggccgtgtgagagacacactggagtgggtggtgctgagaccagaaggaggctgctgaggctctagggaaggctcaggacgctgtcccagggctgctcaggttggcccaggctgcgcggcactggttatttggtgttaaatgctcagctcatcacccccgtgtcagggtgctgtgcccacccccacttttttttttcttttgagagggagtctcactctgttacccaggctggaatgcagtggtgtgatctcagcccactgcaacctctgcctcctgtgttcaagtaattctcctgcctcagcctcccgagtaactgggattacaggcgcccgccacctcgcctggataatttttgtatttttagtagacatggggtttcaccatgttggccaggctggtctcgaacccctgacatcaggtgatccaccctcctcggcctctcaaagtgctgggattccaggcgtgagccgctgcgcccagcctgtgcccccacttttttcaccaaacagcatgttttgacagcagctctgtctcagtgctgcattagtttgcttaggctaacaaagtaccacaaacctagtgcctaaaacaacagaaattgattgtcttgtggttctggaggccagacgcccgggatcgtggtgttagtgagggtggttcatcccgggagaatcggctgcaggtctctccctaggctcctggtggttttctggcaatcttcggcgttccctggctcatagtcgcatcacccgatctctgcttttgtgttcacatggcggctccctgtgtgtgcatctgtgtccaaaattccccctcccccctccccccgacccccccgccccaacctttttgtttttttgagacggagtcttgctggagtgcaagtggtgcaatctcggctcactgcaacctccacctcccgggttcaagcgattctcctgcctcagcctcccaagtagttgggatcacaggcgtgtgtgccaccacacccggctaatttttttgtacttttagtagagacagggtttcactaagttggccaggctggtctcgaactgctgacttcaagtgatcctcccgcctccgcctcccaaagtgctgggattacaggcatgagccaccgcacctggcctcctaccctacactggtatgattttatcttaactcgttacatccgtaatgaccctgtttccaatactgtcacattctgaggtcctggggtttagatccccaacatgctttttaggagggggtggtgtagacatgattcaacccgtaacaagtacgtaggtggacctccgccttttcagaggctgcgtaatgtttcattgtttgcgtgaactatgattcttttaaccaagccctccaaagaaagacctttaggtgtttctgggctgagccagggccgcctctgggtctgattgtcttctggtctctggcgctgtgggaggccccaggagctattgttggctccagggccggattggaagtgctggaaatggagcgtagcttggctgtctacccaggctgcaaacagccgggcctcttgtggcctattgacacagggtcttgggcctctcccacccccaccccgccgcatttcccaaccagggttgcataattccccagcctgcatgactccgcagctgggcagctggcacacaaattcagactgtggctgcaatggggacctgggcctcccagcctgtcctcttaggtcctgcctggcctcttgtcaccatgagctcatgtgaccctcctggcagctgccctgctgtgtggcaggcgcaggcagcagctctgatttttggaattcagaaataaaaactttgcagcaacctatgcatgtagtaacataaactgaatgtggctaaaggttgtactgacaaaaccaagccttcccactcttccctggccctagtttcccactgttgagcttcttgtatctccttccagaaatattttaagaatataagaaaagacacatattatttgtctataggaggaggcattctctaaccccacagctgatgttcagctgtcaacatcactgtggtgataaaaaaaatgtgaagcaatttctctattggttcaaaagttccggccaagtgcagtggctcacgcctgtaatcccaacagtttgggaggccgactgaggtcaggagttcgagaccagcctggccaacatggtgaaaccccgtctctactaaaaatacaaaaattagccagacatggtggtgggcgcctgtagtcccagctactcaggaggctgaggctagagaattgcttgaacctgggaggcagaggttgcagtgagccaagatctcaccactgcactccagcttggagcagagcgagactccatccaaaaaaaaaaaaaaaagttcctggatgttggttgctccagctggccccccagctccctacccttccactagagacccccctggaccctggcccagcactctggcctaggttagtctgggccaggcagtgctagagttaaatactcagcttgtcattggctcactcctgtaatcctaacactttgggaggccgaggtgggagaatcacttgaggccaggagtttgagaccagcctgggcaatatggtgagaccctgtctctactaaaaattaaaaaaaaaaaaaattaaccaggtgtggtggtgcaaatctgtagtcccagctacttgggaggctgaggtgggaggattaagtccaggagtaggagactacagtgagctatgattgcaccactgtactccaggctggtgatagaatgagaccccatctcaaaacaccccaaaacaaagaaacaaattactcagctcatcattcccatggaaggatgctctggaccccctctccactgccctttcctacagactggtatattttggccatagttgtggttcaaaatagatggacctcattcctttttgcagctgcgtaaggttttattgtttaaataaactatgattctttcagccaatcccttgcagatagagccttaggttgtttccattccattactattggaacaattaaaaaaaaaaatgctaagccagcgcagtggctcacgcctgtaatcccagcactttcagaggccaaagcaggcagcttgcttgagctcaggagtttgagaccagcctgggcaacatgatgcaacctcgtctttacaaaaaacacaaaaaattacctgggcgtggtggtgtgcgcctttactcccagctatttggggggctgaggtgggaggatctcttgagcccgggaggtggaggctgcagtgaaccgagatcatgccactgcactccagcctgggcgacaaagtgagactctgggtcaaaaagaaacaagctaccgtgaatatccttgtaaacaggttcttgtgctcttgtggaaacagacctgtaggttcaattcttagaaacgaaatgccagctgggcgcggtggctcacacctgtaatcccagcactttgggaggccgaggcaggcggatcatgaggtcagaagtttgagaccagtctgaccaacatggtgaaaccctgtctctactaaaaatacaaaaattagctgggcgtggtggcacatgcctgtaatcccagctactcgggaggttgaggcaggagaatcgcttgaacccgggaggcggaggttgcagtgagccaagattaagccactgcactccagcctgggtgtcagagcaagactccatctcaaaaaaaaagaaaaaaaagaaatgaaatgccatttccaaggagacttgtgattcttgtttgcgttcagcattaaaaaaatcgaacagctttaagatataattcacgtcacaccattcacctatttaaactgtgcaattccatagcattttgtgtattcatagagttgtgcacctatcatacagtcacttttagaacattttcagtagcccaagaagataacgcataccctttagctgtccccccaggccctgtccacagcctctggcaaccactcttctgctttcggtctctatggacttgcgtattctggacatttcatagcagtgaaatcatgccgtatatgatcctttgtgactggctgctttctcttggcatcattttcaagtttcatccacattgtagcatgcagtaggtttccttcctttttattgctgaataatttttattgttatcttcttatcatggaaaatttcaaacatgtatgcaaacagagtgcagaatgtaatgaatgccccaccaccaccagctggcagctgtcaccagctccatcaatgatgaaccggtgacctcttgtgtttcatctctccccaacctccctaccccaactcaggtgtgaacatttttttttttttttgagacagagtctcgttctgtcacctggggttggagtgcagtggcacgatctcgactcactgcaacttccacctcccgggttcaaacaattctcctacctcagcctcctgagtagctgggattacaggcatgtgccaccacacccgctaactttttttgtatttttagtagaggcagggtttcaccgtgttggccaggctggtctcgaactcctgacctcaagtgatccacccgcctccgcctcccaaaatgctgggattacaggcgtgagccaccgcacccggccatgagcattttttaaattgcagagaatctacctcgtcgctgtccacagggtggcgctagtttccagttcctccagcatatacctggagcacctgtgtccccacctgcacccagcaacgatggctggagcttttttgtctttgctgatgtggcagatgaatgagctctcattacagtttcattctgtgttttgcttacaaggagtggagttagtcaccttttcacagactttttttgacaagagacagagggtcagggaggtggggtgtcctgtcctaggactcaccccaattcaagaggaggaggcaaagccatggtggaaacgtctgaccccaaagccagcccatgatccagagagagaggtggacacctcagtgtcacccacagggagcccaaggcagaaagcatttggggccaatcaaggcagggtgtctgtccatctccttccccattttacatctctgcctgccaccccttggcaccataaatgccatgctgagaggttgagcaggtagcctgggacacagggaggcatgccagcctctcacatgaggcatccgcaggctgggcttgctagtgatgggcgagtctgatgtcagcaacaagagctgactgccaggtcctcagggcatcagatgcgccctggggcctggcacaaacacagcttcctaagccaactgcaagaggccattttaaaggccattgatggaagccaggtctggacggggtctaagctgatgttaaggaatgatcattaagtttgctgggccagatgcactgtgggtctgtaaggatgtgtccttctttatttatcttttttattttttattttttttgagatggagtctagcgctctgttgcccaggctggagcagagtgcggtggtgtgatctcagcttactccaacctccacctccctggttcaagcaattctcccatttcagcctcccgagcagctgagattataggcgctcgccaccacacccagcttatattttgcatttttggtagagtcggggttcaccatgttggccaggctggtctcgaactcctgacctcaagtgatccccttgccttggcctcccaaagtgctgggattacaggtgtgagccaccacgactggcctaggatccttcatttaatcacatctgcaaagtcccttttgccatggaaggtcacattcacaggtcccagggattaggttatgggtatctttggggtctgttattcatcctcccacctcctctgaaaacatcagcatgtatttcctacgaacattcctttatacaaccacagaccagcagtgtcaccaggaaatcgagttcagcacagcactgttatccagtccacagaccttaggccagttgtcccccaacctccaaaaaaaaacaaaaaaaattctctcttgcgcatgatggagtctcactctgtcccccaggctggagtacagtggcgcgatctcagctcactgcaacctccgccccccagattcaagcaattctcctgcctcagcctcctgagtagctggaattacaggcatgcgccgccacacccagctgattttgtatttttagcagagacggggtttctccatgttggtcaggctggtctcgaactcctgacctcaggtgaaccgcctgcctcggcctcccgaagtgctgcgattacaggcgtgagccaccgtgcccagccctcttgctctctttttttcctggtcatccatctctttactctccttcagtctgaaactcttcctgagtctttctttatcattcatggttttgacacttgggaagattacagactggttgtttcatctgtatctgggtctgtttccctgcaattacattctagttacacgtttttggcgggagtattccagaagaaatgctgacctcccacccccactcacacacacctttttctttttcttctttttttgagacagtgtctcactctgtcacccaggttggagtgcagtggcccgatctccgctcactgcaagctccgcctccccggttcatgccattctcctgcctcagcctccagagtagctgggactacaggtgcctgccaccacgcctagctaattttttgtatttttagtagagacaaggtttcactgtgttagccaggatggtctcgatctcttgacctcgtgatctgcccgcctcagcctcccaaagtgctgggattacaggcgtgagccaccgcgcccggccacacacacctttttctaagccacctttgtgtagaagtacagtatacacaccaataaaaggagcacaggcccttggcatccagcctgggggagttttgggagggaacaccctgtatatccagcacccaggagccccccatgtcccttcccaccaccagcaccccctcaaggtaaccattattccgacttctaagagcatggagttgtgttgcctcttcttggatttggtacaaatagaatcacacggtgtgcagtttctcacctggcttctgtcactcagccgtgtgtttgtgacattcatccatgtccagtgagggaagggggctttggagaggccagttccacagacacattcactttgtaaacgttcctggagctggatgtctatagtatgtgtccttttctgtatgtgtgctgcgcatatgtatttacattcataaacctatgctacgccggcacggtggcttatgcctgtaatcccagcactttgggaggctgagttaggagaatcgcttgagccggggaatttgagaccaacttgggcaacatgccaagatcccatctggacaaaacatttttttaaattagctgggcatggtggtgagcatctgtagtccagctactcagaaggctgtggtgagaggatcgcttgagcccaggaagttgaggctgcagtaagctatgatcacaccacaccactgcactccagcctgggcaacagagcaagactctgtctctttaaaaaaaaatctatgctaaaatgaaaaaggaaaatggaagcacagaaattaaaagcactgcctcccaggccaggcacagtggctcatgcctgtaatcccaacactttgggaggccaagtgaggaggacttcttgaggccaggagttggagaccagcctgggcaacagaatgagatctcatctctattaaaaaaataaaataaaataaaaaaataaaaacagaaaaacaaacaaaaaaacccaaaaaaacaaccacagactgccctggtttgaatcccagctctgccagcctatgtgagctgggtgatcttgggtgagttgattgagtgcctcagttaccctatctgtaacatgggaagcatagaaggacctgccttgttcagtggttatgaagggtacctgaagtcatttgtaagtgtttggaacaggttgtggtatggaggaagtgaaaaataaatcaaggtccatttcagtgcacaaatggtacaaactgttctagaatgaatggttgaccaggcggctgaggggttgcactgacctatggccccaccatgaaagcatcagatgcagccaggcttggtgactcatgcctgtaatcccagcactttaggaggcccaggcgggcggatcacgaggtcaagagattgagaccatcctggccaacacgatgaaaccccgtctctactaaaaatacaaaaattagctgggcgtgttggcatgtgcctgtagtcccagctacttgggaggctgaggcgggagaatcacttgaacccaggaggcagaggttgaagtgagccaagattgtgccactgcactccagcctgatgacacagcaagactctatctcaaaagaaaaaaaaaagaaaaagcatcagatgcaaacacaaacacagcctcacctgctgtccccttgactcaaacaccacacacagctctgctgtcaggggagagtgttctgaaaaggtgatcaattttgattgagtcctgagcaaagcaaagaacagccttctctgggatttacacagtggctgtcctcctggaaaattcactgtatattaattttttttttttttgaggcagggtctctctctcattgcccaggcttgagtgcagtggtgcaatcatggctcactgcagcctcgactttccaggctcaggtgatcctcctacctcagcctcccgagtagctgggaccacaggcatccaccaccatggccacctaattttttgtatttttagtagagacaggttttcactatgttgcccaagctgatctcaaactcctggactcaaatgatcttcccgcctttgccctcccaaagtgctgggattacgggcgtgagcccgtaccaccaccaccacaccgcaccaagcctcactgtgtattaaaaccaagcacaaaacactgctgtatttatacgtaaaactgttgggaatttgttgcagataattacaaaccatgacttcatggacgcaaatgtccagggggccatttttcagaagccatgtgggctgtagaaaccgtccgcatccaagtggactgcctagtcctggtgacgtccagaaacacccgacccctccacaagttcctgagacatattctagggggcagcactacccacttccaatgcactttctagaactctgcacagcctactcgccaaatctatttgtaacccccaattcaaggtccatttctgtattagtcatgctgctgataaagacatacccaagactgggtaatttataaagtaaaagaggtttaacagactcacagttccacgtggctggggtggcctccacaatcatggcagaaggcaaaaggcacatcttacatggtggcaggcaagacagaatgagagccaagcaaaaggggtttccacttataaaacctcagatctcgtgagacttattcactaccacgagaacagtatgggggaaacagcccccaagattcagttacctcccactgggtccctcgcacaacacatgggaattatgggagctacaatttcaagatgagatttggctggggacacagccaaaccatatcaatttcgatccacaaatcgtgaaaactgttctacaatgaacagctgatgatgtggctgagggattgcattggtgcatagcatcaccatgaaatcagtactcctggtgtgttcgtggtcatttacggtcctgcgtagaatggaggaaaatttgagtcaccgagtgcacactcagctcacatcagacaggggtggtgttctgccttctggtttcagttctcatactgtacagtgtcctttcctaaatagtgccatgttagtcacaaatttgcactttttgctggtgattgcactgtctcaaatgtcccctgagcacagtgctgatgtgctgtctggcatccccaaacacaagaaggctgccatgtggctttggagaaatgataaaatacgtgtgtgagatcagcttcctccaggtgcgagttacggtgctgttggcctcgagttctgtgcgaatgagtcagtagtatattaaataaggtgtctctaaaacaaaatgcacataaaacaaggtgacgaggctgggtgcagtggctcacacctgtaatctcagcactttgggaggccgaggcgggtggatcatctgaggtcaggaattcaagaccagcctggccaacatggcgaaaccccatctctactaaaaatacaaaaattagccgggtgtggtggtgtgcaccagtaatcccagctacttgggagggtgaggcaggagaatcgcttgaagttgggaggtggaggttgcagtgagccgatatggcaccactgcactccagcctgggtgacaagaatgagactccgtctcaaaaaaaaaaacaaggtgacttattgatcggttggtgaaaatgtgaccagaggtggtggtacacacccgtggtctcagccactctgggggctgaggcaggaggatcacttgagcccaagaggtcaaggctgcagtgagctatgatcgtgccactgcatacctgcctgggcaacagagcaagaccccattcaaaataattttttaagaaagaacatgaccagtgcaagtcacaagaatcgactatactttatatttcctcccttttgcacatagatagcagtaagccacacacagcattgtttgtttgcctcctgtttttcactcattgtggtagaagtctttccatatcactgtagaccttcttcattcatttccctaagtccttttaaattctacttgcattgttttacaaaatacacaacgtaagcagacactgtttaagtatcatagcgatagggcaagcctcagatataataaactcaaccggaattcaccgatctgttcacatatttcaaggcctgcccagtgtcaaagatggattcttttttttttttttgagatggagtcttgctgtgttgctcaggctggtctcaaactcctgggctcaagtgatcctcccgcctcggcctcccagagtgctgggattacaggtgtgagctatcacgcccatcccacaagtagattttaagctgaggggtggtgatataatttgccttaagctttttaagttacatgtttaaggggccagttaagaccacacatcggggtccagagccacacgtgacctctgtccttgcgtccccagccatgctgcggatggtctcagcagttctccagtttggcaacattgccttgaagagagaacggaacaccgatcaagccaccatgcctgacaacacaggtactgcccccggcctgcctgcccacgacctccagcccccgcccaggtggtgcccagccctcctgcacccctgtcccacgtagagagcatcccccttccagccacacctgtctccaacccaggatcactctgatttcctgcattttttttttttttttttttttgagatggagtctcgctctgtcacccaggctggagtgcagtggcgtgatctcagctcactgcaagctccgcctcccgggttcacaccattctcctgcctcagcctcctgagtagctgggactacaggcgcccgccaccacgcccggctaattgtttgtatttttagtagagacggagtgtcaccgtgttaaccaggatggtctcgatctcatgacctcgtgatctgcccacctcggcctcccaaagtgctgggattacaggcctgagccaccgtgcctggccgatttcctgctttttgctgagtctttgccaaaataacatcaaccactcttttcctgattctaaaagcgtgagctctgctgaaagtgaaccgcaccagcacgacagtggggaacagcaggagcccatcctcccagaccccctctccccacagggagccaccattagcatttggcgtagcttctccagcctctgcactctgcagagacacacttctttttgcctttcaagaacagaattatagtcaatatcccttactttaaaccaaaatagaaatagctatgtctctttattattataaaataatacaagctggaagggggaaaaatctggcatgacagaaaagtagaaaggaagagagaaaattacccataatcacctgtaatcccagcactttgggaggccaaggcaggcagatcacttgaggccatgagttcgagaccagcctggccaacatgacaaaacttcttctctactaaaaatacaaaaattaactgggaatggtgatgggtgcctgtagtcccagctgctcaggaggctgaggcaggagaattgcttgaacccaggaggcggaggttgcagttgagccgagattgtgccgctgcactccagcctgggcaacggagcaagaatctgtctccaaaaaaaaaaaagaagaagaaagaaagaaaaagaagaagaaagaaagaaaaagaaaaagaaagacaattacccataatcatattcccagagataattgctgctcacattttgggatgtgtctctctgggctttgttctgtgtctgtatcactgtggatatagagtgtcacagaaatggaatcgtgcttcaccccctcttcccctggagacagcaagagctttctgtcctgattatgaaatccgatgggctcatttctgaaagctgcacagcacagaaaataggaggacaggatgtattaccccactatgctgctggtaacagcattacctgaggcacctgggggctctgtacataggcacccagcaggtgtgccgtgcacacacatttactcatttgttttacaaaactggagtcagaccctgcaaactgttttgaaacctgcttttttttcccctgaatgctttcgggataacttttcaggttattcacaagaaactctactgggatcccttccctccctccctccctccctccctccctccttccctccctccttccttccttcttttagatagaactgtactgggattccctcgctccctccctcccttcctcctgccctccctccttccttcttttagatagaactctactgggattccccccctccctccctccctcccttcctttcttccttccttccttccttccctccttccttccttccttccatctttcctcttttaaatgaagtctcgcccagactggagtgcagtggcaccatctcagctcactgcaacctctacctcctgggttcaagcgattctccctgcctcagcctcccaagtatctgggattacaggcacgcaccaccatgtcgggctaatttttgtatttttagtacagacggggtttcaccatgttggccaggttggtctcaaactcctgacctcaggtgatccgcccaccttggcctcccgaagggcctccctgggattacgggcgtgagccaccgtgccccgcctccagtgtagcttttagtgactgcagaacattctttcaaatgggccaggcacctgtaatcccagctactcaggagctgaggcaggagaatcacttgaaccagggaggcggaggttgtagtgagctgagattgcatcactgcactccagtctgggtgataagagccaaactctgtctcaaacaaaacaaaacaaaacaaacaaaaaaaccatcagaacattctttcaaatgaatgaagcccgacccatctaaccaattcccgcttcttgggcactgaggttgtttcctagctttctccgattataaacaacactgcgctgaacatccttgtggcacggtctttgctcacatgcagggttattttgccagtgctggttcctggaaaaaaaatagttgggcagagaatgtacacacttttgggactcgtaatgcctctcctgggaaaggcggggcccgtcttctgctcccccaacagtgtgggaaacggtaccctctcccttgctgggcagcaagcacctcttcccagtgctgatggaatcttggtgcctctcgccctcagctgcacagaagctctgccgcctcttgggactgggggtgacggatttctcccgagccttgctcacccctcgcatcaaagttggccgagactatgtgcagaaagcccagactaaggaacaggtaggcggggctggcggtgggcaggcacagaaagagccgcgcaccccggccctgggtctttaaacagtgtatgctgtttttcccaccactcaacagacttttgctgagtgcccgctccgttaccgatcctggtctaggtgccaggcgtaaaagcagtcatcgaaacaaataaccaggccctcagggacctcaagttatagtaaggaaatggataataaaagttcaacaggatgtgtctgggagtggtggctcacacctgtaatcccagcactttgggaggccaaggtgggaggattgcttgagcccgggagtttgaggctgcagcgagctgtaattgcgccactgcactccagcctgggtgacagactgagactctgtctctaaaaaaattaaaaaatttaataataatttaaaaaaacaggatgtaaatgcaacatggtatcctagaaaaacaaaaaacaaaaacccaggatgcttttagatggtgagagcacctgtgaaggggaggttttgttggtcaggaaagtcctctctaaggaagctctaaggatgaaacattcgagatgagacctagatggttcgaggcagacggaaccgcaagtgtaaaggccctgggggtggagcaggcttggggagttgggaacattaagcaggtcagtgaggccgggtgtgggggctcatgcctgtaatcccagctctttgggaggctgaggcggacagattgagctcaggagttcaagatcagcctgggcaacatggtgaatctccgtctctactaaaatacaaaaattagctgggtatgtggcacacgcctgtagtcccagctacttgggaggctgagacacgaggatcacttgaacctaggaggcagaggttgcagtgagctgagagcacgccactgcacttcagcctgggtgacagagcgagactctgtctcaaaaaaaaaaaaaaaaagaaaagaaaaaaagaaaattgaaggaggtcaggtcagtgaggctgaagagcaagggagagagggtgggtgaatccacagtcagaaatgtcagcaaggggcagatcatgcagggtcttaggggccacagtaaggaggtgagttttattcaaactacataggaggccattgaggttttaagccagggagtgacttgattcagtttgtctttcatagaaagatccccttggctgctgcatggagaattgggttcagggatgcaggtagaggcggggagacctaaggaggctgcatccagagtcttggcaatcgtgggagctcacaccatgagcagggagggtggagtggagcgaccacaggccagggagggtttcagaatccagcttttgggcagaggcctctgctggccccaggctgggcagtgaggtacctggatgaagaccccgtgggggagatgaggagtctgggagccacactgacccgggttcaatctcagctggggtactgttgttagttcccattttacagaggagaaaactgaggcacagagaggtttattcacatgcctgaaatcacacagcccctaagtggcagagctgggattcaaacccaagttgtccggctccagagtccacgctcttaaccgctgtgcggtagaaactgctttgagggggtgagggaaggattcaagggctaacacatccgagcccgtcatgtagtacctggtgcgcagtaggacttcaggaatgtctgcctgttgttcatggcattgttcttgatggtacttacactcaaggagctgggaggcgaccttaagggggacgagctgggggcccttccccggttcacccccgacgtctttcagtctgctgatgtgcaggctgcgcccttaccatgagccctgtcccacaggctgacttcgcgctggaggccctggccaaggccacctacgagcgcctcttccgctggctggttctgcgcctcaaccgggccttggaccgcagcccccgccaaggcgcctccttcctgggcatcctggacatcgcgggctttgagatcttccaggtccacccttgtgctgggagggggatgccaacttcctcactccggtcctggtcctttctgaagccctgggtctctccccttctccctggtctctgtccccctctctctctctgagtctctgttcccccctctctctggtctctgtccccctctctctgggtctctgtcccctgtctctgggtctctgtccccttctctctctgggtctctgtcccctgtctctgggtctctgtccccctctctctctgggtctctgtcctctctctctgcatctctgtcccctgtctctgggtctctgcctctctgtctctgggtctctgtcccctgtctctggctctgtcccctgtctctgggtctctgtccccctctctctgggtctctgtccccctctctctgggtctctgtcccctctcgatgcatctctgtcccctgtctctgggtctctgtcccctgtctctgggtctctgtccctctccatcctcccagctcacgtgtcctgcgtccctgcagctgaactccttcgagcagctctgcatcaactacaccaacgagaagctgcagcagctcttcaaccacaccatgttcgtgctggagcaggaggagtaccagcgtgagggcatcccctggaccttcctcgactttggcctcgacctgcagccctgcatcgacctcatcgagcggccggtgagccccaggcccctcccagcccacactcacggttcagatccgtctctcccagcatctgcgagaccagggtctagctcctcctctgctgggcctcaggatgccccatgggttctgtggggaaggtgacagcacctgcttcctcgatcttttgtgaccataggtgattagggcccagaatgtgcctgccacagggcccggctcaaatcaatcggttaatcagagctctcaccgtaactgttgttctcacgtttgttttttgtttgtttgttttgttttgttttgtttttttcttgagacggagtctcgctctatcgcccaggctggagtgcagcggcgcgatctctgcttactgcaagcttcgccccctgggttcacgccattctcctgcctcagcctcccgagtagctgggactacaggtgcccgccaccacgcccggctaattttttgtatttttagtagagtcgggggtttcactgtgttagccaggatggtctcgatctcctgacctcgtgatctacccgcctcggcctcccaaagtgctgggattacaggcgtgagccaccgtgcctggcatctcacgtttgtttttatgtccaagtgtgacttataagagctaaaaatcagcagccacctgagtgtccaatatgtggggatctgacttactctccccctgctgtcaatggccaggccaacccccctggactcctggccctgctggatgaggagtgctggttcccgaaggccacagacaagtcgtttgtggagaaggtagcccaggagcagggcggccaccccaagttccagcggccgaggcacctgcgggatcaggccgacttcagtgttctccactacgcgggcaaggtaggggctggggccggccttggggcatgtgggagtggggatcaagggatctccactggctacagatggggggagggtgcagagggaaaacagggtcctcctgaggtccagacaaacagagcaggggctaggagagcccagggaggagcaaggattctgtctgatgggatcaccaaaaacttcctcaaagaggtgatatttgcagtgggttttgagggatgggtaggagttcatcaggaggcgatctatgtgcattttatccacttattcagcagatatgtgcggggtgccatttgtgtgcccagctcggggccgagcaaagctggatacacagatcaaacatggtttctgtcctcacaaagatccctatctgggagggaggcaaatacagacgatcaggatataaggttaataggtctttcagtggaggcagctgagggtagtgtcagagcccagaagagaagtacctgggaaagcttcacagaagagaatatgctcaatctcaaatctcagtcaagggccggcaaacattttctgtaaagggtccgatagtaaatagtttcagctttgtgggccagacgatctctgtcacagctacacaattctgctgtggtcacacaaaaagagccacagataatacataagtatcttcaagcccccagggaaaaagaaaggaaaaacagactgagaaacagtttcgagggctctcttgcccccagaagggcccccatgagtttgactatgaagacataaatgaaggttctattcctatatatatatacacatatatatatacacacatatatatatacacacatatatatatacacactacacacacacacacacacacacacacacacacacacacacacacacacatatatatatgtatttttttttatttgagacagagtctccctctgttacccaggctggagtgcagtggcacgatctcggctcactgcaatctccgcctcctaggttcaagcaattcttctgcctcagcctccccagtagctgggattacaggcacctgccaccatgcctggctaatttttgtatttttagtagagacagggtttcaccatgttggccaggctgctctcgaactcctgacctcagttgatccacccgcataggcctcccaaagtgctgggattacaggtgtgagccaccgcgcccagccctattccagtgaaagtatttgcaaaaagaggtggcaggctggattttgcctgtgagccatagtttgctgacccctggttttgatgatgtggaccaggcagccccagaggatgggtgaagggtgggaagggctctccaggcagagggaacagcatagacaatggctgggaggcaggagattccatgtgttctgtgtctagccctcagtttcttccccagacatactccagaactccccctgtacccagccctctgctaggccgtgagtcagacctgggccctgccctcgggggaccgctgtctggtggggggcacatatgcagagaattgtagcggccaagatcgtgactctatggagccccacagcaaagccctgagtacccagaaggagccagtggtgtgaaacccacagagacagaaccccaggtggcaggaaccgcaggggtaaaaccccgaggtgggagtaagctcgcatgtttgaggaacagtgcggaggccagggtggctggagcggaatgaataggaagaaagtggtggtggtggaggtcacagaggtggcagggggcatagaggggaaggagagagaggggaccatgctggtggggtgcagttcagaatatggacacaaggtggcaccagtgctcgcttgtccatggtgagctccagacctgggagtctcagagcttctggaaggctccttaggaaatccagagaatgtctgagcctgcaagtcatcgccctcctctacctgacttcattcaggtcgactacaaggccaacgagtggctgatgaaaaacatggaccctctgaatgacaacgtcgcagccttgctccaccagagcacagaccggctgacggcagagatctggaaagacggtgaggacccacttcccccaccccggctctaggggtctgtgcggccattctccaaatccacagcgtgagcacctttgtttcagaggcggaggtctgaacctgagttttctgctcagacccagaatagccagtgtcacaaatagtatttcaaatcagtgatggatggatccatagattaattgattgactattgatttgattgataagccagcatccttctcaaggataaagcactccgccttaatcagaaacgtggcaaagatacccactaacactactgttaaacatcgtttttttagcaatactagcctatgcaatcagaccagaaaaagtatgaatatcgaacaggaagaagtaaacttattatttttagatggcctgtgttccctaaacaattaggagatttggctgggcatggtggctcacacctgtaatcccagcacttttgggaggccaaggtgggcggatcacttgaggtcaggagttcaagaccagcctggccaacatggtgaaaccctgtctctactaaaagtacaacaattagccagatgtcctggtgcatgcctgtagtctcagctactagggaggctgaggcaggagaatcgcttgaatctgggaggtagaggtttcagtgagccaagattgtgtcactgcaatccagcctgggtgacagtgtgagactctgtcccaaaaaaaaaaaaaaaattctactgagaaataatttataacaataagagaacacagaatgatgatcttttgcaggtcagtcaacttttaggctttgctttctttgttttcttacaaagttcccttcacgcccccagggaagaagaaagaaaaaacagactgagatacagttttggagggctttcctgcccccaaaaggcccccatgagtgtgactgtctttttggattgacacttctaggggtcataggcagagatgccaaatgccctgtggtaggactctgaccttttccaagccttttctgccactgcccctgcccccccatccttagaggaggtttgagaaatggttttagaaagctggcagaactggcatcctgttttttccaggttccaagtttctggcatttgtcagtttgccttaatcttttattgacatgaaaaggtagctgtagaaataccagtccatgcaatttggcaagaaaacaaaatgagcggccaggcgcggtggctcacgcctgtaatcccagcactttgggaggccaaggtggacgggtcacctgaggtcgggagtttgagaccagcctgaccaacatggagaaacctcatctctactaaaaatacaaaattagctgggcgtggtggcacatgcctgtaatcccagctactcggggggctgaggcaggggaatcgcttgaacccgggaggtggaggttgtggtgagccgagatcgtgccattgcactccagcctgggcaacaagagtgaaactctgtctcaaaaaaaaaaaaaaaggaaaaaaaaagaaaacaaaatgagcaaggtgagtggttcccaaaacacactcacagagcaaaacagcatggagggtcttgatcttgtgagctcatgctagaaagatagattttatttttatgtctcatatagtatttacacaaggagattggaaagcagagtttgatgttcaggaacagaaccagattatgctacgagaatcatctcccggctgaaaatctgctgcccttttaaaatatttgtgctgtcttcataaacacatgattctccacagtgagccctcatttgtcacactctgtgtgtgcctgactctcagagggttccaaaagaaaaagtggaagctgcaaaacctcctggctcagcctcccgagtagctggggagctgccataatgtcacttcctccataatcctcctaaacaaagctagtcacaaggtcttcccagattcaaggagctgcaagacacaggcaaagggtgtcaatacaggggaaagtggggaatcggggccatttttgcccaatctctgctagagctgctttgagcccagaattggatgcccagcatcctgacagcccagggaaaaacggaaatgagattagctctcctctgagaggcaaaaacaacaagtggcctgggagcatcaagttcattcttgagcttcctggcagccagagcaaaaagggcaacctactaaaacagacacaacctctagagggagagattttttattctttgcactgaattcttacagaggacattcgtccttttggccaacagtgtgtggatacaaagatgaacaggagttcagaagtttatggccaacattctggttttccatcttgctttgctctgtactgttgactaataaccctctcctctttttcttcctgccacctcctctccttcccctcttttcatgcatctctctccgccatctctctgccatctcccctccacccacccacacatctgtcctcactccccagaacatgggggcttccagcagttctctttccttggctccttcccaccgtcgcccccaggatctgcagagaggtgcagctctgctatttctccgccagggggtgggtgtctctgtgcatcgatgggtgaggcttgctggaggaggagggtggacctgttgggctggggacctggttttgaacatctgtcccctctcctcttactgtggaggtctctcactcttcctttccctccttgttggctcccttggaagtttccagactctgtagcagcagaaccccttcttctaactaaactgcatgtaaaagtacaaacaagcgtgatagtaccagctcgcgtttcttgagcacttactatgtgccgttcaccatgtgaaacccctttagaattatcaacaccccattacacaaatgaggaaactaaagcacagagaagttaagtaacttgctgaggtcacacagccagtaagtggcagagctgggatttgaacccaggacatcagattccagaactttagttcttatctgtgctatgaggacttaataaatgataattatcattttgaaaatgacagggagtacggggtaggggagacggttgaacctggggaagaaaataacatatttgagcccctgccatgacctggccctgccctaagcacagattatctagttgacggttgatggcgcttgaatgggatgagttttgcaggacatcagattctgccctagctgtgggttcctgaggaacctggcatgattcaacacatagaatttgggaccaggtgcattggctcacccctataatcccagcgctttgggaggccgaggtgagaggatcacttgaggacaagagtttgagattagcctgagcaacacaggaagaccccgtctctacaaaataaatttaaaaattggtgggcatggtggtgtgcgcctgtagtccaaactacttgggaggctgaggtaggaagatcacttgagcctaggaggttgaggctgcagtgagctgtgatcactccactgtactccagcctgggtgacagtgagactgtgtctcagaaaacaaacaaacaacagaattcgagacagtgccaatagaaggaatggatatttttcactacccaaagcagcaccgccaagcggcactagagaaaatagaatctttttgttgagacagagtctagctctgttgctcaggctggagtgcagtgacacaatcttggctcacggcaacctctgcctcccaggttcaagtaattctcctgcctcagccttccaagtagctgggattacaggcatgtgccaccacacctggcttaattttttgtatttttagtagagatggggtttcaccatgttggccaggctggcctcgaactcctgaccttaggtgatccacccgccttggcctcccaaagtgctgagattacaggcatgagccaccgcaccctgccaagaaaatagaacctctatgaaattaggctcttctggaaaaatggttaaaatagagacagtttgccctatttcaaatattgcatataatgcaagaatttattacatcttttaatatgtttcagattcctaaaatgcaactgcagtggttatgttatcactgttttctctctctatgcctcagtttccaaatctgtaaaatgggaatgattcttacaggcttataaagccattgatgtaaattgctttgagcaatgcctgccagagtatctatgctaggtaagcatttgctgttattgtcatcatttattgataaggaaaacagagatcatgtccttgaagagaagaagggtcaaagaccagagtttgagaggactcctactgtctgagttctaatctcggatcttcagtttctaagctgtgtgaccttaagcacattctcccactcttcagagcctcagtatgtccatctgtccaatgaagctgatatctaccttacaggctgtgtgaggtccttcatatgtaaagtgccagttgtgataaatgataagacccttgacctttggcccaggtccctaaaactgaccctgacctccttctctctctctctgcatctccatctgacagtggagggcatcgtggggctggaacaggtgagcagcctgggcgacggcccaccaggtggccgcccccgtcggggtatgttccggacagtgggacagctctacaaggagtccctgagccgcctcatggccacactcagcaacaccaaccccagttttgtccgctgcattgtccccaaccacgagaagagggtgagtgactcagcctggggaggaaggggtggctgtggctgtgggttaaggtttggcctctggacttggctggagccacatctgattcgaggaccctcaaattagctgtgtggctttgagcaaattgcttctattcctaggctcagggtccggttgggaaaattcatgcattcatatgacttaatgtattaagcatctactgtgctgggaacaggtactggggaggcattggagagaaaggcacagccaactcctgttctcagggagctcacagtctgatggggagcatagacattcatctaaccatccaaaatgaacgtccagttaaatctgtaggggtggtgagtatcacacagggcttgatctggtcagtgaagttagggaaggttccctgggggacgtgatgactgagccctgaaggatacgtgatattccaggcagagaagagtttgtacaaaggcccaatggtaggttggagcacgcgaggtacaagggatagaggaaggccatcagggctgggcttgttgcatgggtgtgacaagaccatggccagcctcactggccactgattttcatgttgagaaaatcagagaatgggccctacagagaagggtcaatgggaatggaaaacaacatgtttgccatgttgcccaggctgctctcgaactcctgagctcaagcgatccacccgccttggcctcccaaagtgctgggattacaggcgtgagccaccacgcccagcctgagatcccatattttatcaaatctaagccatgtattcctccccactagcgtctctgaagtcgagatgtagcttagtcaacggcctgtcagggtttaattaccagtctttttcctttcttggtggcatatttaacgacagcgtgtgccactggaatttttgtactgtttagatttttgccatttgtgcattactgttgaaaagagaaaaggcggcctggcacggtggctcatgcctgtaatcccagcactttgggaggctgaggtgggaggactgcttgagcccaggagttcaagaccagcctgggcaatggcgaaacgccgtctctactcaaaatacaaaaattagctgggcatagtggtgtgcacctataatcccagctactcaggaggctgaggcaggagaagctcttgaacctgggaggcggaggttgcagtgagctgagatcatgccattgcactccagcctgggcaacagagcaagactctgtctcaaaaaaaaaaaaaaaaaaaaaaacgaacaaacaaacaaacaaaaaccaaaaaaacatgatttaccagctttggacagacatcagcttcccaggaggccttttggcgactctcttgcgtgcaaattcagccccacccacatccctccctgcggatcttttctccttagcacttagtatttcttctttattagtgactgcttcacctagggtatttctagtttctcctactgaactctcagttccccagggcaggatttccccctggtttgagcattgctgtcttcccagggcctagaaccgttcctaggcacctagtaggtgctcagtaaattacatgtggaaacaggaaattgccaagcttgaccgtttggcgcccccgtgtggccgccgctgacccccgcgtgtccgtccgctctccccaggccgggaagctggagccacggctggtgctggaccagcttcgctgcaacggggtcctggagggcatccgcatctgtcgccagggcttccccaaccgcatcctcttccaggagttccggcagcggtgagctagagcgagggcccaggcccggcggaggggctgggtgggacccgggtctggaagccgacacacctgcattcaggtctccacccactcttgttccttctgcgctggggaagttgaggcagattactcactttgctgagcctcagtttactcgtctgtgtatgggagaacaatagcccacttgatgcactcctgagagaaagcacacagagtctatggggatctggggtacattgctgctgctgtttagggcagtaggccccaaactatgaacgtgaaatcactgcatggtgttacaaatctgcatgtctttaaaaatgaagtagaaggcggggcgcggtggctcacgcctgtaatcccagcactttgggaggccgaggcagacagatcacctgaggtcggaagttcgagaccagcctgaccaacgtggagaaaccccatctctactaaaaatacaaaattagccgggtgtggtagcacatgcctgtaatcccagctactcgggaggctgaggcaggagaatcacttgaaccgggaagggggaggttgcagtgagccgagattgcgccattgcactccagcctgggcaacaagagcaaaactctgtctcaaaaaaataaataagtaaataaagaagtagaataggacagaatagaaaataccaaggcctaatgagcaagtaatacagcaaatgtaacaaaaatgatgcttcacacaagctgtgtagagcagcaccgtcccttagaagtagaatgggaagccttgtacacaattgaacattttctaatagctacacttttacaagtgaaaaaaatgaaattaattttaacaagatattttactaaagccaatacatccaaaatactggccaatactggctgggcactgtggctcatgcctgtaaccccagcactttgggaggccgaggcgggtggatcacttcaggtcaggagttcaagacagcctggccatcatggagaaaccccatctctactaaaaatacaaaaattagctgggcatggtggcacatgcctgaatcccagctacctggtaggctgaggcaagagaatcgcttgaacctgggaggcggaggtcgcagtgaggcaagatctgaccactgcactccagcctgggcgacagagcgagactctgtctcaaaaaacaaacaaaacaaaaaactgaaacagtcgatcattgtcgatgttgctgtccttggtggtggcgtgaatgctcagatgtgagttttgtgactgtccttgttattgtcactgttgttcctgctgtgtgtcactctgagcccagtgcctggcccgcagcaggcactaggtgagcgtttgctgtaactctctcctccccacccctccctgctcattgcagatacgagatcctgacacccaatgccatccccaagggcttcatggatgggaagcaggcctgtgaaaagatggtgagtggggcagagcctggaatgcgtgtgtgcgtgtgtgtgtgtgcgtgcatgagtgtgcgtgcatgtgtgtgtgcatgcatatgtgtgcatgcgtgtgtgtgcaagtgtgtgtgcatgcacgtgtgtgcgtgtgtgtgtgcatgcatatgtgtgcatgcgtgtgtgtgcatgtgtgtgtgtgcatgcgtttgtgtgcaggggcccaggtggtcggggagtggggctgggatctccccttcattgaccttcctcattacctctccctatcaccgcccccacccccgcttcctcatcatcccctatcacccccctccccgtcaccccatcaccccctccccatcaccactcccccatcgccccctccctataactcttctcccctatcaccctcctccacatcaccccctcccccatcaccccctctccccaatcaccaccccctcccaatcactgcccctcctcaccacccccccatcatcccctgccccatcacccccttcctataactcccctcccctatcactcttcacatcaccccctcccctatcactctcctcatcaccccctccccatcacttctcccccatcacctccctcccccatcaccccctcccccattaccccctctccccaatcaccaccccttccctatcactccccctcctcgccaccccctcccccattactccccctcctcaccacccccactcccccatcaccccctctccgtcatcacccctctcccacccctcacagatccaggcgctggaactggaccccaacctctaccgcgtgggacagagcaagatcttcttccgggctggggtcctggcccagctggaagaggagcgagacctgaaggtcaccgacatcatcgtctccttccaggcagctgcccggggatacctggctcgcaggtgggcagccacgctgtctcccggggtcctgttggccgagactgggtcagggaggggttgaccagatggctctaggtgtcagggcctccaggatgggtgcagggctgaggagcaggtggatggaggtgccgggtgtccaggcttcttggttctgcagtccctgaggggccctgtgggcagggcaggccctgttcagagtaagactggcaacacagaggctggacttagccgcagggtgaccagctgtcctagtgggcctgggtctgggtttcccagggtgcaggacttccagtgctaaaacagagaaagcccggggcaacccaggtcaagctgtccgctctccctggccagtccctcgaggggctccagtctggaggtgagacttccatgggcatagagtcccagtcccgggtgagacctgctttgatgggggccatagaggtgcagcaaggaggccctgctgcaggccatgactcccccaggccacaccggacaagcaggtggatgaaggaaaatgggaaaggtgatcagggcaggagcaagcttgtgcaaagacccaacgatgcaagatcctggcacgcttcaggaatacagggagtttgcgggagagtctccttcctccttagaagtggctcagagaggccgggcacggtggctcacacctgtaatcccagcacattgggaggccaaggcgggcggatcacttgaggtcaggagttcgagacaagcctggccaacatggtgaaaccccatctctactaaaaatacaaaaattagccgtaatcccagctactcaggaggccaaggcaggagaatggcttgaactcgggaagcagagactgcagtgagccaagatcatgtcactgcactccagcctgggtggcagagtgagactctgtatcaaaaaaaaaaaaaaagctgaaagaatagagtggcaggaaaggatggcccaaacaccaggctgagtggggccttgtccagaggagctagggagccatggagggctgtgagcaggggaggggtgggtcagctctgggtgtagaaagactctctggaggcgtgttgggatgggctgataggagaggctggagaaggaggccaggcagaggatccaggcaagggagggtggggcctgaactgcggctggggctttgggactgggcagagagagtcgggagcagggggacgaacggccagaacacagtgagatctcaaagtaataagagtgcctgcacacagtaggcattttatgatggctgactaagtgaaaggagcttggcttggtcaggcatggtggcccacccctgtaatctcagcactttgggaggccgaggtgagtagatcacttgaggtggggagttggagagcagcccggccaacatggcaaaaccccatctctactaaaaatacaaaaattagccgagtgttgtggcacgcacctgtaatcctagctacttgggaggtgaggcaggagaattgcttgaacctgggaggtggaggttgcagtgagcccagatcatgccattgcactccagcctaggcaacagagcaagactctgtctcagaaaaacaaacaaacaaacaaagaaaataaataagaaaggagcttggctctcttgctaaggggatggcgcctggaggctcccactctgcccctcacccatttccccacccagggccttccagaagcgccagcagcagcagagcgccctgagggtgatgcagcggaactgcgcggcctacctcaagctgagacactggcagtggtggcggctgtttaccaaggtgagggcagcctggggaggtggccccagtagggagaggatagggccttggggcttggtctgcttgacaagtgacttcctccatgtgggcctcagttttctgcatcactaaaatggggccagtcggcccaggctttgctagctgggattctttagttagcaagcaacaagaaaaatctgactcgaaccaacatggatcaaagattcaagacaatgtgggctgcacctggatccaggggtccccaagacttctgttcaaggatttgctggaaggactcacagaacttagaaaagctgctgtactcacagctacagtttatcacaatacaaagatacagattgaaaacagcaaaggtgctgggtgctgtggctcacacctgtaatcccagcagtgtgagaggccgaggcgggcggatcacttgagatcaggagttcgagaccagcctggccaatatggggaaatcctgtctctactaaagatacaaaaattagctgggcatggtggcaggtgcctgtagtcccagctacttgggaggctgaggcaggagaatcactcaaacctaggaggtggaggttgcagtgagccaagatagtgtcactacatgtagcctgggcaatacagcaaaactctgtctcaaaaaaaaaaaaaaaaaaaaagagcaaaggttaaaaaaaaaaaaaaagtacataagtgtctcggagagaccaagcatgagcctacagctgctctctcccagtgaagttctgtggacaacacttagctgttcccagcaatgaagtatgataatatgcacggagtattgccaaccagggaagctcacctgagccttgatgtccagcgtttttcctggggctggtcacacaggcatggacaaggtcacacacatggtgacctcagttactcagtctccagcccctccagagtcaaactgatgccatgtggcccagggcccccaccacagatcccatcgttagcatagactatccagggtggcccaaggccccaggtaaaccaagacactcttatcagatgggacattctaaggacttagaggtaacctcccaggagcccatcaagggccagacttttcttaggaatgtgtggggtttggacaacccaggtctgctgagttaaccctttactgcacaagggtccaaacagtgacgtcagtatgcagtgttctgcgtctcccgcttggctttcctccgtgatgatcaccaacagaggctttccacacaggggccaccagcagatggagtcttgcccctaacaaccttggccagcctggtctctcttatcatagagctccagccagattcccaggtttcatgctcattggcccagctggagtcatgtgaccatcccagagccagttagtagggatcagatgagccaggctggcatcacatgcctacccaaagcagagggtgccaagccaggtcgccatgcaccatggagctcagggactaggtgttcccccagggggaaattggaaaggaatgagaaggatggaggttttgggggcagtaatgtaattctgaatacgatgtctgagagatcagcctgcattcccttggtcagtgttaactgagcacctactatgtgcccagaacttttatagaggctggggtaaatggtgattaaaaagagacaaggtcctgccaccatggagctcacagtctgggacaagagttgctgcactgcggcctgtgggccagatggctgtttttgcaaaagccctttcgttagcatggtgtctgcagctgcatctgagctacagcagctgagtggagtaggtaaacagccagaagctgaggttaggggctcacacctgtaatcccagcacttcgggaggccaaggcaggagcatcacttgagcccaagagttcaagaccagcctgggcaacaaagtgagaccctcatctctacaaaaaaaaaaaaaacaaaaacaaaaactgggtgtagtggtgcacacctgtagtcccagctacttgggacgaaggattgcttaagcccaggagtatgaggctacagtaagccatgatcgcatcactgcactacagcttgggtgacaagagtgagaccctgtcttgaaaaaataaatcaaaattaaaaactggccaggcacggaggcgtatgcctgtaatcccagcagtttgggaggctgaggcaggtggatcacttcaggtcaggggtttgagcccagcctggccaatatgatggaaccctgtcactactaaaaatacaaaaattagctggatgtggtgtcaggcacctgtaatcccagctactcaggaggctgaggcaggtgaatcgcttgaacttggaaggtgaaggttgcagtgagccaagatcgcaccactgcactccagcctgggtgacagagtgagactctgtctcaaaataaataaataaataaaaataaaaattaataataaataaaaaacagccagggtggcctgtaaaatctcaaatatttcctgcctggcccttgaagaaaaagtttgcctaccttaggtgttgggggttggggtcaagtaggatttgattggcatcatttgagaaatgtgaatgatacctgcgaaagatgcaaggagtcggggcagaaaaggagagaatagaagggatacagaattgggtggagaggaaaagaatcaagtagacttgtgtagaacggagtagaatatgattgaacagaaattatcagagcagatctcacttagcaagggcgacgaggttttgtgaaatttttgtttcagttctgtgtgtacctctgtcactgcagcctgaatcatgccatgtaaagctcatctctcactaaggaccttggactaacaggcttaagaaacactggcctttggccaggcatggtggctcatgcctatatcccaacactttgggaggctgaggtgggtggattacttgaggccgggagttggagaccagcctggccaacatagcgaaaccctctctactgaaagcacaaaaattagccggacgtggtggcatacgcctgtaatcccagctactcgggaggctgaggcaggagaatcgcttgaacctgggaggcagaggttgcagtgagccgagatcccaccactgcactccagcctgggcgagagagcaagactctgtcgaaaggaaggaaggaagggaggaaaaaaggaaggaaggaaggactgttccacagaatagcagcagccacagtacacagtgtctcttggatgtggaaggatcctttagccagagagattagatagatcaatagtgtatttagtggtgcttgcctgtacctgtcagtgttctaggcctgtgaccagggactgttgccaaggcggggacacacagctaataggtggaggagaagggatttgaacccagaaactcaaaccccactaagagtgtgaggtcttggcgcctgaagtcagccattccacccctttcacctccacctaggtgaagccactgctgcaggtgacgcggcaggatgaggtgctgcaggcacgggcccaggagctgcagaaagtgcaggagctacagcagcagagcgcccgcgaagttggggagctccagggccgagtggcacaggtgagggggcgggggcagggcgtgggggcgtgtcttcggggtggggctgtgtcgcatgggtggagccaggtgtgaggggcggggcttccggctgagccagcctgtgcccaggcagggctgtcgggaggatgggagcaaagctaaggtgtactgaggccgggcggggattggggctgtttagtttggttgagtcgtgacgtacagggagcagggccctgggggtgtagccagggtatgggccgggtaggggtggggtgggagagtcctgcagagccagaatggagctgggctgtaggatctgggggcaggggcctcagctgtggccgggctatggtatgcaggtggcgaacttataactgtttccagtatttcagctatcttaaaataatgctagaacatttgggaggctgacgcgggcagatcacctgaggtcaggagttcaagaccactctggccaacatggtgaaaccccgtctctactaaaaatgcaaaaattagccgggtgtgatggcgcacgcctgtaatcccagctactctgggaggtggaggttgcagtgagccgagatggcgccaccgcactccagcctggtcggcagagtgagactctgtctcaaaaataataataataataataataatgctagaacaaaccccttcttgagcatttttctgtttgccttttctgcattatttcctgtggttacattttaggtatgaaatgtattaaatgaaatgtgaggtagtagaaagacccctcgggggttatttgaaggatggactggaaggggaaaggctagagtctgggaggctggggaggaggctggagagagacaggtgagagaaggaaagacctgagcctgttggggctgtagggacagagaggaggggccagagagagcaggggtgcagactgatggctgtgagaggtgagggagggcatccccaggattctgacttagtgattagggggatgtgggctcatcctgagatggggacctgagggggaggaggtggggacaccgtgtcctcctgcccctcagtcctgccctggagaacttaaaggccaaagcaagttacaaggcagtaggcacccagtgcaggttgccctgggagcactgcctgctgaccactaacctcccacacactccccagctggaagaggagcgcgcccgcctggcagagcaattgcgagcagaggcagaactgtgtgcagaggccgaggagacgcgggggaggctggcagcccgcaagcaggagctggagctggtggtgtcagagctggaggctcgcgtgggcgaggaggaggagtgcagccgtcaaatgcaaaccgagaagaagaggctgcagcagcacatacaggtctggccccttgcatgcccaccaggccaccctccagacccctctgtctacaccatccacctttgcttctacaaaccgtgtgtctttgggccatgaatttgtagaaaactcagttctaagtgaatttgcaaaaagaatacatttttgattcagatcgcgggagaccttaaaatgtgtgagcttcacctatggatggatccaggcatccaagtgatatgttcagcttcaggcctggctggatccaggtgtctgagtgatttcctcagcttcaggcatggctggatgcaggaatccaagtgatatcctcagcttcaggcatggctggatccaggcgcctaagtgatgtcctcagcttcaggcatggctggatccaggcatccaagtgatatcctcagcttcaggcatggctggatccaggtgcccaagtgatgtccttagcttcaggcatggctggatccaggcattcaggcaatgttctcagtactccccctctctccgtctcctggctgcattcacgggcaggctgccctcatggttccccttcaaaatctagtgtgtattttacactacagcacatctcaattcagatgctaaattttcattggaaatacttgatctgtatttctatttcataatttctgcagtttataaaaactagattcacatggccaagttgttccaaacatgcttaaaagcttttcagtgattgggtgtctggttttaaatttaaaataaataaaattaaataagacagaaaatttagttcatcagtccacatcagccacatttcaaaagctcagtaatgtttttttgttttttgtttttttgagtcagagtcttgctctgtcgcccaggctggagtgcagtggcaccatctcagctcactgcaacctccgtctcccgggctcaagcaattctcctgcctcagcctctacagcagtatctgggattacaggtgtgtgccaccatgcccagctaatgtttttttatttttagtagagacagggtttcagtatgttggccaggctggtctcgaactcctgacctcaggtgatccgcccacctcagccttccaaggtgctgggattacaggcgtgagccaccatgcccggcccagtagtgttttaatcaacttctcttgatccctttggtgagggagggaccctaccctaggtttatggggatggctgagcacacagcactgggcaccagacaggtgaggggggccgacatcacaccacagacggccacatggatgttgccctcaagagcagagtgaacaagcaggggctgtgggaaacaggctttgtcacaacaacaggtggaggtgacccctgggtgccgtgggaaaatgtgtttggtttgtttcagtaattccatgggctggcagggagctggaatgtgcttctcagggataagcaggcactgtgcctggtccccaggataaggagggtccccagataaggctgggggaccttatctatgggagcagagggagtaggaggacttctgtttaggccatttgaggcccctgctacttttagcaaatgtcaaggcagcacataaaattgagtcttggctaggtgcagtggctcaatgtgtaatcccggcactttgggaggatctcttaagcccagaggttcaagaccagcctaggcaatgaagtgaaaccctttctctacaaaaacaaaaacacaaaaattagccaggcatggtgtcacacacctgtggtgttgtcacactacccacgaggcctgaggtgggaggatcacctgagcccaggaggtcaaggctgcagtgagctgtgatggcaccactgcactccagcctggatgacagagtgagacctttctcaaacagaataaaataggctgggcgcaatggctcactcctgtaatcccaatactttgggaggccgaggttggtggatcacctgaagttaggagttcaaggccagtctggccaacatggtgaaaccccatctctactaaaaatacaaaaaattagccaggtgtggtagcgggtgcctgtaatcccagctactcgagaggctgaggcaggaaagtcacttgaaccccgggaggtggagattgcagtgagccaagactgcaccattgcactccagcctgggcaacaagagcaaaactccgtctcaaaaaaaaaaaaaaaagaaaagaaaaaaatttaaacagaataaaataaaataaattcaaaaaataaaattgagtcttgatttccagtgtgcccaatgactgtcatgttggcagtacccatttctataatttgtgtatttactatgtttattttatttttaaaattatttattatttatttattttttttttgagacagagtctcactctgttgcccaggctggagtgcagtggcgcgatttcagctcactgcaagctctgcctcctgggttcacgccattctcctgcctcagcctccagagtagctgggactacaggcacccgccaccacgcccggctaattttttgtatttttagtagagatggggtttcaccgtgttagccaggatggtctcgatctgctgacctcgtgatccgcctgccttggcctcccaaagtcctgggattacaggcgtgagccactgcgcctgacctatttactatgtttatagtttataatctgtacccctaacccccacacaagaatgtgatttccacaaggataggtgttccttttttttttcagaggcaagatctcgctctgttacccagacttcagtgcagtggtgcggtcatctctcactgcagaaggacagtcacttttacccatcctcagtgcctagaaccgtgcctggcatacactaggcactcaataaatgcttgttgcgctaatgaatgaaatgggaaagccaataagagtttgatccttcccggcctcacccagggcatggacatctctgaaccacaagccgcggggatccgtgggccagccatccccgctcccatccttccccatcacactccatctattggcccagtatcctcactcctcctgccttcccaccccaggagctagaggcccaccttgaggctgaggagggtgcgcggcagaagctgcagctggagaaggtgacgacagaggcaaaaatgaagaaatttgaagaggacctgctgctcctggaagaccagaattccaagctgagcaaggttgggggcctgagggcagctgggaaagtggggatggggtgcattggtgggttaatgaatggtgaacttcacgccatgggggttaccacactgcggttctcaggtgtgcaccggtgggggtgggatgggtctatagccccaagggaatgggaaggagagggaggtgtagggggaggaaggtcagagaagggtgaaaaggagcagaaacatagatgagaacaacaccagaagctgcagatcaggtaagggctgctcctggcccaactcctcctgactgccccccatcccactccacccctcaggagcggaagctgctggaagatcgtctggccgagttctcatcccaggcagctgaggaggaggagaaggtcaagagcctcaataagctacggctcaaatatgaggccacaatcgcagacatggagggtgagctcccgcccagccagtaggggtctgtgtgtgctctaatgggggacctcaggcaagccccatgtgctacagggcctcagtggctgtgtctgctaaatgggataggaaggaaggctcagggcagattgagtgtcctcccagctcttgagttcttaatgcatctctaaatccaactctctttctctccttggtgtcttgggttgtcctcctttcttcccatctgactgtcccactgtctgtctgtttcagacatgtttttgtctccctgtcccttcctgttgacttagaatcagaaacagaagggaaggggcacagggaggaggcagggctgtagacacagggcagagagagtcagagggtggaggcatgggctgttggtggggatgaggaggagaggacagtgcgtctaggacaacattgtgggaagagtccctgagatagatggggaaggtgggaggaggagaaggcgttaagggaggtgctgagcttagccttatatgtgactggggacctgtggtctctgtgagagcggctgagtgtgcaggcctggagtcctcatgcacggcccccacccctgcctccagaccgcctacggaaggaggagaagggtcgccaggagctggagaagctgaagcggaggctggatggggagagctcagagctgcaggagcagatggtggagcagcaacagcgggcagaggagctgcgggcccagctgggccggaaggaggaggagctgcaggctgccctggccaggtgcagggtggggtgggcttggtggggtaagcagcatgggtgcacggccagccagcgtggggtgcccaagtcagaagctcctgggtacaaaccccagtggagccactcaccagccacagacaggccacatcccctccgagcctcagtgtccccttctgtcaaatgaagatagcaagagttccaggcccactaggttaagggaaaagtgaaacaagactctatgtgtctggtaacttgcataacagtgcacaatgggaacaagaaaatgctatttctaggccaagtacgatggctcacacctgtaatcccagtactttgggaggccaaggcaggtggatcacttgaggtcaggagtttgaaaccagcctggctaacatggcaaaaccctgtctctactaaaaatacaaaagttagctgggtgtggtggcgggcgcctgtaatcccagctactcaggagacttaagcacgagaattgcttgaacccaggaggcagaggttgcagtgagccgagatcacaccactgcactctagcctgggcaacagagcaagactatgtctcaaaaaaaaaaaaaaaaaaaaaaaaaagagctatttcttcctcttccctgcttggcctccccacaccaaacagcccagaatcagctgagatttgccaagtggcctatgttaggaatcataataattatatttacactcgttcacagtaattgagctcctactgtatgccaaatgtggtgcttagtgtttcaaatgctttttatgcactgtgcttcatgcaatctaagacccacttgattacaagtacagctccatttcggagatgttaaaatgtgaaaaactgtgcatcttagagttgatggaacatggggggtgtgtgtgtgtgtgtgtgtgtgtgtgtgtggttaagaacacgtctttgttttgttttgaaacggagtcttgccctgtttcccaggctggagtgcaatggtgtgatttcggctcactgcaacctctgcctcccaggttcaagcaattcttgtacttcagcctcccaagtagctgggattacaggtgcccgccaacaagctaattttcgtatttttagtagagacgggctttcaccatgttgcccaggctggtctggaactcccaacctcaggtgatccattcgctgaggttaggattataggcgtgaggcactgcacccggccgtgaacacacatctttgagtctgacttctgggttggaatcctggcttctcccctttctagtcatgtgacctcatgcaaatcacatcacctctctagcctcagttttttcatctataaaatggggtaattgtagacagtactcctaaggttagtgtgagggttaaagaagaaagtgctcctcagacacttcgcataccctgagccctcaataaatgccggatgtttctgttactactttattactcttgttaatttttttcttttttactgaggtgaaattcacataaaagtaaccattttttaaatgtacaattcagtagattttgcccattcacaatgctgtgtaaccatcacctctatctagttctagaacattttctcttttattgagctggagtcttgccctgtcgcccaggctggagtgcagtggcatgatcttgcctcactacatcctccgcctcttgggttcaagcaattctcctgcctcagcctcccgagtggctgggactacaggtgcccaccaccacacccagctaatttttgtatttttagcagagacggggtttcactatgttggccaggctggtctcaaactcctgacctcaggtgatccacctgccttggcctcccaaagtgctgggattacaggcatgagccactgtgctggcctccagaacttttttatcacccccaaaaggaaaccctgtatgtattaaccaatcacagccaggcacagtgactcacgccataatccagcactctgagagtaggaggcaggagggtcgcctgagcccaggaattcaagaccagcctgggcaatataatgagaccctgtctctacaaaaaacttttaaaaattagccaagcatggtggcatgtgcctgtagtctcagctacttagaggactgaggtgggaggatcctttgaacctgggaagtcgaggctgcagtgagctatgattgtgccactgcactctggtctaggtgacagaacgagaccctctctctcaaaaaaaaaaaaaaaaagaaagcagccactccccatccctccttctccccagcctggcagcctctgatccactttctgtctaaatagaatttgcctattctagatatttcatacaacatgtggccttttgtgctttagttatttttatcgccatctccccagcaaccctggtaaaggggagtgttcatcgtcatgtcctcccacaaatcaggaccctgcccttcttaagtcacttgttggagcagggggccaggagaggatactaagccaggcctgtgtggctcctgaaccattaacccccaggtcccagttggtgctgcccccagatccagcttctctttgcaatgacgctgtgtgaagggacaggaagccacatccctgtgagagctgtaaggagggactccgggccaacccagccactcacggacccggtaacctcggcaagtgctttctccacgctagacctcagtttcctcatttggcaggaacattaaatgaggtgatacaagtaaagcactggcatgaggcaggaacttactaagtgtctcctacgattactgttgctgtcattcccactttacagctaagaaaactgaggttcgaaatgagtcaggctgggcgaagtggctcactcctgcaatcccagcactttgtaaggccgaggtgggaggatgacttgaggccaggagttcgagaccagccctaggcaacataggcagaccttgtctctttggggaaaaaagattagccaggcatagtggaccgcacctgtggtctcagctacacgggatgctgtggtaggaggatcacttgagcccaggaatttgaggctgcagtgagccgtgactgcaccactgcactccagcatgggcagcagagcgagaccctgtctcagaaaacttaaattagtactgcagccaagtgcccagtggcagagagaggattctaacctgggactggccactcccaaagcccacatccagcctctcagtccccagaaatcattgcctcactctggcctgcccctgtatcaactccacggttcttgtcacccccagggcagaagacgagggtggggcccgggcccagctgctgaaatccctgcgggaggctcaagcagccctggccgaggcccaggaggacctggagtctgagcgtgtggccaggaccaaggcggagaagcagcgccgggacctgggcgaggagctggaggcgctgcggggcgagctggaggacacgctggactccaccaacgcacagcaggagctccggtgaggcccggtggcaggccgctgtcacagcctgtgcacatacagggctgggggaaggacttaggtacaaagtctctgtctatacagaggcttacttattgtacagttgttcatgaaccaccggctctaggtccggcctgggtcaagctggggacagagatgggtcagacccaggtgttacccttgggaacttccagtctcaggggaggcagattcaggcaaagacaatctcaacccagaacaaggggtgctttagcggagtaacacggggcactgtgggtgataagtgaagacccctaaaccaagtctatgggagatccaggaagactttcctgaggaagggccttttggaaaagggttttgaaaggtgaataggagttcacccttaaagccacactccttccacagcatcaccacccagatctcctgaggagcataacatgaggccctcatattttaaggaaacatgaaaaggagaaacaaccagctcccccaaagcccctgccttcctctgctctgaaattcccatcctctctcctttcccccaataaaggtccaagagggaacaggaggtgacggagctgaagaagactctggaggaggagactcgcatccacgaggcggcagtgcaggagctgaggcagcgccacggccaggccctgggggagctggcggagcagctggagcaggcccggagggtgggttggggcagggggacagggcaggggggccacggggagggcagggcaggacgcggggttggaggaggtaccgctggctggttctaggctagctcatctccctgggcccctttcctcacgcattcatgtgcatctttcattcagcaagcattaatggggtgtggactatgttccaggagcattgctggggaaccagccatgaacccaacaaccagcactgccttcccttgtggagctttccttttagtgagagaggcagagggtaaacaatataaacactttcagtttatattggggtgataagtgctatggggccataatgaacaggaaaaagggatcagaattctaaggcgggtgagtttttaagtagagaggctgtggaggtattctgcgagaaggtgacatcagggtaaaaaactgagggagtggccgggcatggtggctcttgcctgtaactttgggaggctgaggcaggcagatcacttgaggccaggagttcgagaccagcctgggcaacatggtgaaaccccatctctactaaaaatacaaaaactagctgggcgtggtggcacacacgcctatagtcccagctacttgagaggctgaggcaggagaatcacttgaacccaagaagcagaggttgaagtgagtcaagattgtaccattccactccagcctgggtgacagagcaagactctgtctcaaaaaacaaacaaacaaacaaaaatgggccagacgtggtggctcatggctgtaatcccagcactgtgggaggctgaggtgggtggatcacctgaggtcaggagttcaagaccagcctggccaacatggcaaaatcccatctctactaaaaacacaaaaaattagccgggcgtggtggtgggcgcctgtaatcctagctacttgggaggctgagacaggagaatcacttgaacctgggaggcggaggttgcagtgagcagagatcgtgcctttgcactccagcttgggcaacaagactgaagcactgtctcaaaaaaaaaaaaaaaattgggagtgaggggtgagctatttgttcactgggagaagtgtgttccaggcagagggaacagccagtgcaaaggccctgagatgggagtgtgcctggcctggtccaggaaaggcctcatagatctttgctcatctccttcccacaccagggcaaaggtgcatgggagaagacccggctggccctggaggccgaggtgtccgagctgcgggcagaactgagcagcctgcagactgcacgtcaggagggtgagcagcggaggcgccgcctggagttacagctgcaggaggtgcagggccgggctggtgatggggagagggcacgagcggaggctgctgagaagctgcagcgagcccaggtaagtggggtgggcagggcagaggtttctgctgtgtgaccttggtgacatgcctgccctctctgggcttctatttggtccatatcaaaccaattgtctcgtttggctcttccaacataatcatgtacaagtctgggcacagtggctcatgtctgtaattctagcacttgggaggccaaggcaggaggattgcttgagcccaggagttcgagaccagcctgggcaacatagtgagaccccatcttcagaaaaaaaaaaattttaattagccaggtatgctggcatgtgcctgtagtcccagctactcaggggactgaggaaggaggatcccttgagcctgggaggtcgaggctgcaatgagctgtgattgtgccactgcactctagcctgggcaacaaagtgagatcctgtctcaaaataataataataatacccagtactttgggaggccgaggcgggcagatcacctgaagtcagaagttcgagaccggcctcaccaacatggagaaaccctgtctctactaaaaaaaaaaaaaaaaaaacacaaaattagccgggcgtgatggcgcatgcctgtaatcccagctactcgagaggctgaggcaggagaatcacttgaacccgggaggcagaggttgtgatgagctgagaccgcgccattgcgttccagcctgggcagcgagagtgaaactccatctccaataataataataataattcactcatttaagatgtgcaattcaatggattttggtatattcacagagtggtatggccatcaccataatctaattttggaccattttcattatcccaaaaagaaaatcctataccctttagctatcatcccccacttctcccccaccccacccagggaaccactaatctcctttctgtctttactgatctcccattctggagatcttatataaatggaatcctactatatatgggtggcctttgtggctgccttcttttacttaacataacggtttcaagattcatctgtgttgcagctcgtagcataattccttttttattttttaatttttaaaacaccagctgggtgcagtggctcatgcctgtaatcccagcactttggcagcggaggcgggtgggtcacctgaggtcaggagttcaagaccagctgcctgaccaacatggtgaaacttcgtctctactaaaaatacaaaattagccgggtgtggtggcgcatgcctgtaatcctagctacttgggaggctaaggcaggagaatcacttgcacctgggaggcggaggttgcagtgagccgagattgcaccattgcgctctagcctgggcaacaagagtgaaactctgtctcaaaaaaaccccaaaaaacaacagcacgcaatagatccatatacctttctattgccgaataatgcccgttgtatggatattccacatttgtttatccattcgtttattgatggacattggggctgttcccgcctcttggcgatggtgagtaatgccactgagaacattccggtacgagtttctgcatagacctatgcgttcatttcttttgggtatgcacctaggagcgggattgttgggtcatgtgggaaccctatgtttaagcatctgtggatctgccagactgttttccacggcagctgtaacatttcacattcctgccagtgtggtagagagttgaggcagatggggtcactgggtggaagccacgattggagggcttcattcccgtcccttccctgcaggctgaactggagaatgtgtctggggcgctgaacgaggctgagtccaaaaccatccgtcttagcaaggagctgagcagcacagaagcccagctgcacgatgcccaggtgaccctgcctgcccttcggctccaccgtcaccctcccctccttgtcctcccagccacacctgacattgccgtctcctccatctacaggagctgctgcaggaggagaccagggcgaaattggccttggggtcccgggtgcgagccatggaggctgaggcagccgggctgcgtgagcagctggaggaggaggcagctgccagggaacgggcgggccgtgaactgcagactgcccaggcccaggtgagcagccctacgtaagaccttcagggaggcacagcccccctcactgctcctcctgggttccccagctcagggatggccatgctgcccaccttctcataggccagacccatgggtgcctttctcatctctgactcccccttaccccccacagcccatgcccagccctggctgtcctgacccctgactctcagcctcatcccttgtcccagctccagctcagccccagctccagtgccgtcctctcccatctagatcctcctcttggcctctgggcctccagcctctcccctaacagctcatcccctgcacagccccagaagcttctttctttacctggagctgaccctgtccctcctctgctcacagctctcccacgcctccccagtactcctagacaaagtccatgcctctcagtcaggcattgaggccctgcaatctctggtccttcctctgcctttagctgtattcatctctatctctactttcctattttatttgaaaaaaaccttttatttttccagacttagcattaggctcccctgtgggaagtttcctgacccgtcttctctttctcctctgtcccaactccagtcaccttgggctgggactgtctctgcccatgagtctccccaccagactgagagccccttcaaactagaatcccatcagagttagatccaggtctgtagcacagcctgatatagggcctgatgtatggtaggcgttgagaaatgcctattgaatgaatgagtgatggtacgtgcctgcagatatccttcaactggcagacttctatgcatacttcaagacccatctcaaatgctcctccttcaggaagtttctcctgaatgttctaaacagattctgggcacttcctgtggacctccatagctcccatactgctaccttaacccctatcaccctggctgtgactctgtgtctcccccagcagccgaggggctccccaggaaagactccaggtctgattcacctctgcatcttggagggagtaattttaattccctggaagaactagggctcatagtattcacaacttcacaccactcagaggcagaagagcccagcagaatgacccctttccctcttcaggcctcagtctcttcatcctggaaatggagcaccaccagcttacaccttggtcactcatggccgtgaccaccaaccaccctctctctcctcccctcagctttccgagtggcggcggcgccaggaggaggaggcaggggcactggaggcaggggaggaggcacggcgccgggcagcccgggaggccgaggccctgacccagcgcctggcagaaaagacagagaccgtggatcggctggagcggggccgccgccggctgcagcaggagctggacgacgccaccatggacctggagcagcagcggcagcttgtgagcaccctggagaagaagcagcgcaagtttgaccaggtggggcacctcagttcacccagccggggaatcagcaagtccatctacgcttcccatggtcgttgtgaggaaccagtaatccgtgctgtcacggctcaactaggcagttgtagtggaccaggaagcaagacccttctttgctctgggcctctgtaaaataggacatccctctgtcctgattcatgcctcttgccacagcataattcctcgtagcacccacttttactttcagagctgccctggtttttggatgacaaaatatacgaataccttcagtaccccagagattgcttatgagaattaaatcaaataactcatctcacttctgctgattcacggggtacctcaggcaagttgctttttccatctcagcttcagttcgcccatctggaaaatggcaataataccaagcatctggcagcctgaggatgaaataaaaatcacagaaccttagagagttcagatcaggcaatcctgaggttcagatcccaattcggcctcttgatggctgtgtggcttgggcaaattgctcaacctctctgtgctttattttattcatttagaaaatgcagtgtgaagctgggcactgtggctcatgcctgtaatcccagcactttgggaggccaaggcgggcggattgcctgagctcaggagttcacaaccagcatgggcaacacggtgaaaccccgtctctactaaaatacaaaaaaattagctgggcatggcggtgtgcgcctgtaatcctagctactcgggaggctgaggcaggagaatcacttgaactggaaaggcggaggttgcagtgagccaagatcgtgccactgcactccggcctgggtgatagagcaagactccatctcaaaaaaaaaataaaaaattaaaaaaaatttttttaaattgtcatttccctgtaggtggtgcagtatgtttttctagctgacttacgatttctctctttatgtttggttcttagtggtttgactgtgatatgcccagctgtgggttttttgtatttatcctgctttagattcactgtgcttcctgtagctgtgggttgatgtttttgatcaaatgtggaacatttcagccattatttcttcaaatatttttatctcccactctctctccttccccttcttcttggactccaaatacatatgatttgattgtaatactcttccacaggtcattgaagctttattatttttggcatcttctggaattttatataaattattttcacataaatctcttttgggatgggcttattttactcaaaataattttttttttttgagacagagtctcgctgtgtcaccaaggctagagtgcagtggcacgatctcagctcactgcaacctccacctctcaggttcaagcgattctcgtgcctcagcctcccaagtagctgggattacaggtgtgcaccaccatgcctggctaatttttgtgtttttaatagagacgaggtttcaccattttggcaaggctggtctcgaactcctggcttcaagtgatccacccacctcggcctcccgaagtgctgggattataggagtaagctaccgcacccagcctcaaaataattagtctgagatccatccatatttttgcatatcaataatgtattccatgtatcaataatgtatttttgctgctgaatattattcctgtggtatagatcagccacattttgatattcattaaccttttgatgaacatttgggtttttttccagtttttttctagttatggataaaaccttagtctttctcaaaggtggttttaattaacatttccctaatgaccagtgacgttgagcatcttttcatatgcttatttgccatccatatatcttatttgctgaagcttctgttcagatcttttgcctatttgttaattaatgttgtttgttttactattattgaattttgaaaattctttatgggccgggcacggtggctcatgcctggtaatcccagcactttgggaggccaaggcaggcagatcacctgaggttgggagtttgagaccagcctgaccaacatggagaaaccccgtctctactaaaaatacaaaattaggtaggcatggtggtgcatgcctgtaatcccagctacttgggaggctgaggcaggagaatcgcttgaatctgggaggcggaggttgtggtgagccgagatcatgccattgcactccagcctgggcaacaagagtgaaactctgtctcaaaaaaacaaaacaaaaaacaaaaaaaaaacaaaaaaaaagaaagaagttatttatgtattctaaatgcaagttctttatcagatatatgctttgcaaatatttttgtccagtctgtggcttttctttccattctgttagagtctttcaaagaacagaagtttttaattttgtccaatttatcaatttgttgttttatagattgtgcttttagtattgtatataagaaatttttgcctaactcaaggtcacaaaggttttatcctggtttttttcttgttttctttttgtttgtttgtttgttttgttttttgagacggagtcttgcactgttgcccgggctggagtgcagtggcatgatcttggcttactgcaacctctgcctcctggggtcaagcgattcctcctgtctcagcctaccaagtagctgggattacaggcacatgccgccacacccggctaatttttttatttttattttttttttattttttatttttagtaaagacagggtttcactatgttggccaggctagtctcaaactcctgaccttgtgatccacctgcctcggcctcccaaagcactgggattacaggcatgagccactgcacccggcctatcctgttttttttttctggaagtcttccagtttcaagtttacatttaggtctgtgatttattctgagttaatttttacatatgatgctatcatggctccatgttaatttttgtgaatataaatatccaagtattccaacactgctctccactgacttgtttttgcatatctattgaaagtcatttttcttcttcttcttctcctccttctttttcttcttcttcttctttttttttttttttttgcccaggctggagtgcagtggcgtgatcttggcttgctgcaacttctgcttcccgggttcaagcaattctcccacctcagcctcccgagtggcttggattacaggtgtgcgccaccacacctggctaatttttgtatttttagtagagatggggtttcaccatgttggccaggtggtcttgaactcctgacttcaggcgatctgcctgcctcagcctcccaatatgctggaattacaagcataagccactgcaccagccttttcttcttatttgaagttattttgcctcttctagttcctttgcatttccgtatgtattttagaatcagtttgtcaatttctaccccaaaacaaaaagccttccaatttggaactgtgttgaatctatacaacggttttggaagaactgacatcataacaatattgagttttctcaccgaggaagagggtatatacgtccattgaaataccttagaaatgttttttagttttcaatgtacatctttcacatctgctgccagatgtatttctaagtatttcatggttttatggctattttaagtgatgttgctttcatttccatttttgattgctagtatatagaaacaatagatttttgtatattgatcttgtatcctacaatcttggctaaactcacttactagtgctaatatagtttttatatatttcattggattttctacatagatgatcatgttttctgtgaacaaaggcagttttacttctttctttaccttttctttacccttctaggactccaaatgcttgtatgtatgactgcttggtacttttttcaggttgttaaagttccattaatttctgttacaatcttctttctttttctttctttgctctgtttggataatttatattgacctgctttcaagtttactgattctcctgatgtgtccagtctgctactaatttcatccagtgacttttttatttcagatatttcatttttcagttctggcatttctatgtggttctattttacagtttcaaatccctcctcaaataactgcctcttcacccattgtatctgtctcgttctgaaacttatcatgaagtccttgtgtgcacgttctaatatgtaggtcatctgtgggtctatttgtatggactgatttttctcttaactatgagttctgttctcttttcttttttgcatgttttataagtttatttgccaattactgtgtcttaaaaaaaaacagtaaaggttgaagtacatttaaaaatatatatatgtgtattttttctactgccactcttaagaggaaggaatgccctttcttctgttgaacatatagagttagggactgatcagtttgatccattcaagagttaagctggtttgggacacggttgcaactttaatccctctacctccctcttgtgtctctgcctttgtctgtctctttctctctctttctctgttcctggctgctccctcttcccgttcccttgtacactcctttcagctaatctatttccccctaccccatctccctcaaactggaagcttctggcagaggagaaggcagctgtacttcgggcagtggaggaacgtgagcgggccgaggcagagggccgggagcgtgaggctcgggccctgtcactgacacgggcactggaggaggagcaggaggcacgtgaggagctggagcggcagaaccgggccctgcgggctgagctggaggcactgctgagcagcaaggatgacgtcggcaagagcgtgagcagggcccccgctccccgggacacactgggtgaggggagacacgtacatgcatgtatgctttcacacatagaacatgaaaaacaaccagccatcaaagtcatatgttcatgcacaaagagaacaagagggctgggcatggtggctcactcctataatcccagcactccagcactttgggaggccaaggtgggcggatcacctgaggtcaggagctcaagaccagcctggccaatgtggtgaaaccctgtctctactaaaaatacaaaaattagccaggcatggtggcacatgcctgtaaccccagctacttgggaggctgaagcaggagaatcgcttgaattcaggagggagaggtttcagtgagccgagatcattccactgcactccagcctgggtgacagagcgagactgtctcaaaaaaaaaagagaacaagagggggactgttcagcaaacatttgcatccatatagacacacacagcgtgaagagaatctccaccaaacactgtgctaatgcacacgcatagaaagtaaggagagccattcaccagaggcaggtcttcatgtagacattcacagaacgtgaggagaatcttccatccagcacatgtgttcacacacagaatacaagagctgctcacaaagcacacatgctcacatttgtgtacacgggatgtaaggagaatcttctattacttgtttttgtttgttttttgttttgttttatttttgagatagggtcttgctctgttgcccaggctggagggcagtggtgcaatcatggcacattgcaacctcagtctcctaggctcaagcagtcctcctgcctcagtctcccgagtagcagagactacaggtgcattccaccatacctggctgttttttaaattttttgtggagatggggtcttgctgtgttgcccaggctggtcctgaactcctaggctcaaacaatcctcccacttcagcctccctaagcattgggattacaggcatgagccactgcaccttgctgagaattttccattaaatacacatattcatgtgcatatgtacacatacagcatgagaaaactactcaccacacatatgtatggatgctcagagagagaacacgaagagaatttactacaacacacagcctgagaaccactcccccgacatgactaggtgcatgcatacatacataacacacatacacacacacacacacacagtgtgaggactcccactttgcctgccaccaattccactgagcacacacagactctcccaccaagcctctgtcttcccttaactcgtgtatccctccagggcctgtagggtggtgccccaaggcttctcgcaggctcccctcacccagccagtgtcccagccttccgaatggtcaaaatgacccgccacatcctccactccatccttccttcattcatcctctgaatacatttatggatcacacccagggacacaggccaccctcactaatgatgggaggcactggcagaatttgttgagctcctgaatagatgctgtcttgacatccttatttctttattttcccaacaacgtgcttctaggagtccaatgggtgagggctttatcttctccacgcacttagacgttgatccgattttgcttttagccaggcctggagagaacccctctctccctgacacagacctggcctgcagccctagggataattgagctaaaacccagctcatacttgagccgttaaggtccgtcccttgggaaaaatgtcaggttatttgtagtgactccaaaggcccttgtgggaaacaggatgttgatgggagaaagtttgatcccttcaagtaaacaaaataaattggcaagtaccaaataggaagggaggctagagggcccattccacggaccgaaagtagatactgtcagtgaccagaattgtaatgaacatcatgtgggcagtggcgatccacagacataggccttgctctgtggaactcacagttcagtgcgggaggcgggtgttgcacaaaaagccacctaagcaaatgtcaaatgaccactgtgactagggctaggtaggagaggggccccagtgccaggagcatgggtagcagagaggccctgatgggttaagagaggcttccttgaggaggtgacagttaagtaaggagaggggtgaagggggagtctctgaaaattcataagcccagctctattttcacagcatttgggggtttaattcatacctccctgaaagatcagggaccctcccaaacagaaaacccaatagaagtagatagtgggtcggtgacaccctggggagtctggcaaacaccagcactgatgaccctggagctacgtgccttcaacccattcgcacagaattcccaaagatgaattcccagtgagtgagctcacagtgcaaaattacaaaactcagagggaataatccaccatgagtgagagtcagctgacctaacagacgcttgtattggactctgaagggcttcagataatagaattatgaagcatcagttattcatgaaatacattttggggtgatgctgaatgagacacctaggaaggagccgttcagcagattttgaatggatgaatgaacaaactaggatgggcacactgacttgccatctccccatcctccatcaaatcttcccctactctagctaggctcctaacctcctctgcctcagtgacccaggtacccagcagctactctccccaccaggtgcatgagctggaacgagcctgccgggtagcagaacaggcagccaatgatctgcgagcacaggtgacagaactggaggatgagctgacagcggccgaggatgccaagctgcgtctggaggtgactgtgcaggctctcaagactcagcatgagcgtgacctgcagggccgtgatgaggctggtgaagagaggcggaggcagctggccaagcaggtattgtcacacagaaggccacagggtgccagtccagctggggtatgccatggtgtgtacaggcagcaagaagggcagcaaggggtctccccgacccacccaccactctgtctcctccacccgccgaccactcagtatctccccaacccttccactgctcagtgtctccccacccacctgccactcggtgtctccccacctgcctgccactcagtatttctgccagtctctcgtgccagccaaaccatcttcctcccacaaaaccatcttcctattccccaacccattaacctgccatgacccattaacccacacacatatcctgttgacctgttgctgtacccaatcatacatcctccatccaccacacaaaccattcacccatccatctgccaccccatctattcaactaccctaaccacccacatacagcctctcccccaaccagcgttgtgtccaactactgctccatccacccagtgactcccttccaacccatctcctctccccaacccaacccctcccctatttacccaaccccagcccctcagcaccccctgctgactccacttagtcactgactcactgacctgctcatccgccctcccctccatccacatccttccccaatccagtcagtcatcgctccctcgcttccttgtttgttccattgctctctccctccctgcatcgttcattcattactcgttcagtccaggaacttcccatgtctcccctctactaggtggtgaggggcaggggcagctctgggtgtcagaaagaccccgctggagccatgtaggcaacagacttggggtggagggtgctagaagctggggaggcagggaagagaggtgaacaggtgacctaaggccaggggtctctgcagggttttgtctctgctagcccctttgacttagacatggctgagtgtccaagacttggccctgggggcactggggaaccatgggagggctatgagcaggatcagctctggagacgtgttggaatgggctggaggggagagatgagaggctagaaaggaggcttaggtgagatgggggactgagctggggcagtagggatagagaggagaccaagtaaagagagtcagggagtgagaggagcggggcttgcagcctgggcaggagctccagggcagacatccatgtccctagcacacagagggaggctgggcttcctgtgtctgacccggtccctcctgacctcctctccagctgagagatgcagaggtggagcgggatgaggagcggaagcagcgcactctggccgtggctgcccgcaagaagctggagggagagctggaggagctgaaggctcagatggcctctgccggccagggcaaggaggaggcggtgaagcagcttcgcaagatgcaggtaagagccggcgtgagctgcagggaggggaggctttggtgtcttcaagccccaaccatcactccagggtctaaggctagctcggacccctcgctctcaacccacaggcagcatccgcatgggtcagcacctttataaacatccatgccccagaggctggcttccttcttcttctattttacatttctttcatttaaaatgctgcacttttaagtcaaatttcctcatttttttgtttgtttctttgtttgttcagttggtttttttttttttgagacagtctcattctgtcacccaggctggagtgcagcgacgtgatctcagctcacagcaactctgcctcccaggttcaagcagttctcctgcctcagcctcctgagtagctgggattacaggcgtgcgccataatttttgtatttttagtagagacaaggttttgccatgttggccaggctggtctcgatctcttggcctcaagtgatccacccgcccccatggttttgtttttgaagtgaaaataccatatggttttttggccagacacagtggctcacacctgtaatcccaccactttgggaggccaagatgggcagatcacctgaggtcaggagttcaataccagcctggccaatatggtgaaaccctgtttctactaaaaatacaagaattagccaggcatggtggcacgcacctgtggtctcagctactcaggaggctgaggcaggagaattgcttgaatccgggaggcagtggttgcagtgagttgagatcccaccagtgcactccagcctgggtgacagagcgagactgtctcaaaaaagtaaagatagaaataaaataaataaatcaacagtaggcaaactgaggctcagagaggggcagtggctggctcacagtcacccagcaaggatatggccaagttgtaattcaaacccatgtctatctaacttgaagccaggctccatcaggcttccagctgccttctagttctcagccaggtcaacctcctcccttgaggaccagagtgggagaggctggctcagggtcacacagcaagtggctttatacacaggagcccaggtctgcagggttcggagagttccctgcttgttcacgggagctgaggagccccgtcggtctggcaagggggtggaggagttccctgtgctgtgtggccaggctgagcccatctacctattccgttccacccaggcccagatgaaggagctatggcgggaggtggaggagacacgcacctcccgggaggagatcttctcccagaatcgggaaagtgaaaagcgcctcaagggcctggaggctgaggtgctgcggctgcaggaggtgaggctggggtaggctgggccctgggacaggaagctgggaggtgggcaaggctaaccttgaggtccctggatgtgaagctggggaggtgggcggggctaaccacagggtccctggatgtgaagctggggaggtgggcggggctaaccacagggtccctggatgtgaagctggggaggtgggcggggctaaccacagggtcccagggtgtaaggctcgggaggtgggtgtgtcttaccatgtggcctgcaatgccagcctaagagcagggattttgtcttagggcactagggagccatggaaagatccagaacagaggatgggcagggtcagctctgtagcagttgaactggagtggggagattggagtcacaaaggctgtgggagtgggagtgggagaggggagagagagagagattgagaaagagagagagaaccctgagccagggccaaggggatgcagaggacggagaaggcagtcagaaggcaggagggagaaggctatggtgaggggggccggaggaggggaggagagcactgggggtctggcccggtgattgggggaccctggaggagaggcaggtttgagaggaggacctgtgtgcagtaaaaggtggagagggtgaggggcctgggggttgggctgcaagaggtgagcacaggtcaggggctcaggagacagatttaggagacatctgtaggttgcagctcattccagggttacccagggacagcatgagaaaaaagccaagagccttgaggtgtgagggacagagaaaggggtgagacccgtgcccagattgcttctcctcacacccaccggccacccctccatcatcacaggaactggccgcctcggaccgtgctcggcggcaggcccagcaggaccgggatgagatggcagatgaggtggccaatggtaaccttagcaagtaagtgccccaagggtctgaaggctgaggtactgcgtctgcaggaggtgaagctggggtaggctggaggtggctgggctctgggacaggaaactgggaggtgggcggggttaacctcggggcccctggggtgtgaggctggggagatgcgtggggctaaccacagggtcctgtagtgtgaggcaaggcaccctcctctgaccatcctgtcctttcatccccacgccttcctgtctccctagggcagccattctggaggagaagcgtcagctggaggggcgcctggggcagttggaggaagagctggaggaggagcagagcaactcggagctgctcaatgaccgctaccgcaagctgctcctgcaggtgagcgtgattgaccgcccccaccagcctcagtccccattgacctgggaccgtaaccttcagtcctcttattcaacaaatatagaaaggggatatttgagttgggttttgaaggttgaataggagttcttaaaagggttgaaaggcatgattcacttgtatttctgaggggtttcttcagggctaaatccaaagatgaattatgtggggaaacagacatgggccagcaagtgtgatcatggaagtctcctgggcccagtagagagagagaaaagactttctgcaggagtcataagaaaacatttggaaaaagagacatttggctgggggttttaaagcataagttggagttcagcagagggagaaaagcatgttttcctttgcatatttatttataaatattttctgaggattccggtggcccagatcctattccgggttatgctggggacctggagatggttaatactaagcctctgccctcaaacacgtcttagtctaaaggaggaaatagaccatcccaatacagagatacaagtgaaaatggaggaaacacgggcactgtgggaacctagaagggactaccaacctagcctggaggatagaggccatcagagaaggcttcctggtggaggtgatgccttgagagatcttaaaggaagtgtaagagtttgccaagaagacaacagagtgatgggatttccaaggacaaaccaatgtctgcattcttcattagtttttttctaattttttttttttttttttgaggtggagtctccctctgttgcccaagctggagtgcagtggtgctatctcggctcactgcaacctctgcctcccaggttcaagcgattctcctgattctccaattttctctacaaaatatttaaaaattagccaggtgcagtggtgcatgcctgtagtccaactacctgggaggctgaggagggaggatcgcttcagcctgggagattgaggctgcagtgagctatgattgtgtcactgcactccagcctgggtgactggatgacagagtgagaccctgtctcaaaaaaaaaaggtaataattatatgctcaacagttatgtgtagtaagactactttttaaatggagagaatggggaaaatatgcaaaatgttttaacctactttaattgatggtgatagtattagcactgtttttctgagacattgagtttataatgtgggataaagtaaatgatcaaagatgggatactatgtcatctactacgtccttgacatcagggtactcagcaccaaagaaccttgatatagttgtcctagagaagagattaagtttttttttttttttttttttaaaaacaggccaggtgtggccgggcgcggtggctcacgcctgtaatcccagaactttgggaggccgaggcgggcagatcacgaggtcaggagatcaagaccatcctggctaacacagtgaaaccccgtctctactaaaaatacaaaaaattagccgggcatggtggcatgtacctgtagtcccagctactcgggaggctgaggcaggagaatggcatgaacccgggaggcagagcttgcagtaagccgagatcgcaccactgcactccagcctgggcgacagagcaagactccatctcaaaacaaaaaacaaaaaaacaaaacaaaaaaaacaggccaggtatggtggctcatgcctgtaatctcagcactttgggaggccaaggtggaaggatcgcttgagcccaggtgtttgagaccagcctgggcaacacagtgagaccccatctctacaaaaaatatatgtgaaataaaaagagaaaagaaattacgtttagtggggcgcagtgggtcacgcctggaatcccagcacttttggtggattgcttttagcgtaggagctccagaccagcttggatgacatggcaaaactccatccctacacaaaattgaaaaattagctgggtgtggtggtgcacacctatagtcccagctacccaggaggctgagttgggaggatcacctgagcccagggaggtcgaagctgcagtgagccatgattgcaccactgcactccagcctgggcaacatagtgagaccctgtctcaaaaagaaaagtgataaattatgtttaaaaaatagtttaagccaggcgcagtggctcatgcctataatcctagcactttgggaggctgaggcgggtagatcatgaggtcaggagttcaagaccagcctggccaacatggtgaaaccccgtctctactaaaaatacaaaaactagccaggcgtgatggcgggcacctgtagtccagctactcgggaggctggggcagagaattgcttgaacccaggaggcggaggttgcagtgatctgagatcgtgccactacactccagcctgggtgacagagcgagactttgtctcaaaaaaaaaaaaaaagtttaaaaacaaaactaagcaaacccctgtagttctcaatttgacttcatcatattcacgtgaactggtgatgtattttatacagatccagtctctctgaccacccaaaaggcctagaaacagggaacccagtagcaatgagtatccctatatccacgttgtgatctggaaatgctgtttccctctaaaagaaactggggctggctgggcgcagtggctcacacctgtaatcctagctccttggaaggctaaggcaggaggattgcttgagcccaggagtttgagaccagcctgagcaacccagtaagaccccgtctctacaaaaaaaaaaattagccaggtgcgatggcgggcacgcctgcggccccagctactctgagggctgaggtaggaggattgcctggatccgggaagcagaggttgtagtgagccagaattgtgccactccactccagcctgggcaacagagtgagaccctgtctcaaaaaaaagaaaaagaaaagaagagaaatgaaactggagcttcttccgaagtggctgattccagatctggagcaggcaatgaacaagagtaacccagaacattttgcgatacccattagcaggaaagatagtatagttatgtcaagagcacgtagaagtcaacgtgaagagcctcgcgctggcccaaagtggggcaagttgagcttcaatgaggaaaataattgcaactgatttaatcccttgaaatctgtttaaattcaacagcaacgttttaaaaaaatattaattagttgctgtgttagttccctagggccaccataatgaattaccacaaacacagtagcttaaagcaacaggaatgtattctctctgtttttttttgtttgtttgtttgtttgagatggagtctcgctctgtcacccagactggagtgccgtggtgtgatcttggctcactgcaacctctgcctcccggattcaagtgattctcctgcctcagcctcccaagtagctgggactacaagcatgcaccaccatgcctggctaatatttgtatttttaatagggagggggtttcaccatgttggccaggctgctctcaaactcctgacctcgtgatccgcccgcctcggcctcccaaagtgctgggattacagacgtgagccaccgcgcccggccaggaatgtattctctcgtggtcctggaggccagaggtctgaaatcaaggtgtgggcagggttggttcctcttgttcatgcctctcccctggcttcccgtgggtgctggcagtccctgctgtttcttcatctgtagatgtgtcattgcaatctctgcctttaactttacaaggcattttcccatctttgtggctctgtctcatctcctctttttttttttttttttttttttgagacagagtctcgctcttgtcgcctaggctggagtgcaatgggctgatcttagctcactgcaaccttcacctcccgggttcaagcgattctcctgcctcaacctcccgagtagctggattacaggcgcccaccaccacatctggctaattttttttgtatttttagtagtgatggcatttcaccatgttggccaggctggtctcgaactcctgatgtcaggtgatccgctgcctcagcctcccaaattgctgggattacaggtgtgagccaccattgcctggccctcatctcctcttaaaaggacaccagccgtatcagatttgaggcccaccctaatccagtgtgacctcgcgttaatcaattacaactgcaaagatcctatttccaactaaggtcacattccgaggttctgagtggacatgaattttgcgtgggagtctattcaccccatgggtgcatggggagggcatgggggaggggcatggagcttccgtgccctcctgggagcgccaccctccaggtactgcacatgttcagcttccagaagctgcccaaaccctgtcctcttgggccttttatggagacgtcactggataggtgtgattaacaaccacgtagaaatgtgattggacaaaaagggtccgatctaaacccagcgaggcctgtctgttcagattcttcctggcttctctatgcagcattccttccccctctgaaatgagggtcctgtgatccacagtcaggttagagtttctgccttgtgcaggtgaaagagggggcaggaggaggttagagagagaggttctgtttactctaaaagggctatgcaaattatgatcaaggaaccatggacaaaacccaacacacacacaaacacacacacatacacacacacacacatgcacacatgaagtatatacgcaaagcaatatcacaggtacaaattcccttgaaaattcacaaataaggccaagcgcggtggctcacacctgtaatcccagcactctgggaggccgaggctggcaggagttcaagatcagcctgaccaatatggtgaacccctgtctctactaaaaatacaaaaattagccaggcgtggtggcgggtgcctgtagtcccagctactcagcagggtgaggcagaagaatagcttgaacccaggaggcagaggttacagtgagccgagatcgagccactgcactccagcctaggcaacagagcgagactccatctaaaaaaaaaaaaaagaaaagaaaaaagaaaattcacaaataagacagaaagatcgggtgcagtggctcatgcctgtaatcccagcactttgggaagctgaagcaggtagattgcttgagaccaagagttcaagaccagccaggacaacaaagtgagaccctgtccctaccaaaaacaacaacaacaacaaaactatcagggcatgatggtgtgcacctgtagttccagctagtcaggaggctgaggccggagaatcgcttgagcccaggagtttgatgctgcagtgagctatgattgtgccactgcactccagtttggacaagagtgagaccctgtctccagaaaacaaaaaacaaaaaagaaagaaagaaagaaagaataaagtccctggacacagctgccaatttccaggaaacacagaggagagacaaataaatgctgaattagaccgtaagtgtgtgatcagaaaaatccagacagagaggaactctacaaggctaacaacctacattcttcaacagataaattgtaagaaataggctgggggcagtggctcacatctgtgattccagcactttgggaggccgaggcgggcagatcacctgaggtcaggagtttgagaccagcctgcccaacatggagaaatcccatctctacaaaaaaatacaaaaatgagccggacgtggtggtgtgtgcctgtagtcccacatacttgggaggctgaggccggagaatcacttgatcctgggaggcagaggttgcagtgagctgagattgcaccactgcactccagccttggtgacagagcaagactccatctcaaaaaaaaaaaaaaaaaaaaaaaaattttaaaggaataaaagggatggaggagggaactgcaggttaaaagagacttaaaagacatatatctggccgggcgtgatggctcacgcctataatcctagcagtttgggagaccgaggtgggtggatcacttgaggtcaggagtttgagaccagcctggccaacatggtaaaaccccatctctactaaaaatacaaaaattagccaggtgtggtggtgcgtgcctgtaatcccagctactcaggaggctgaggcaagaaaatcgcttgaccccgggaggcagagattgcagtgagccgagatcgtgccactacactccagcctgggtgacagagtgagactgtgtctcaaaacaaacaaaaacaaacaaacaacaacaacaacaaacccacatacatctacttttttaaatgggtaggattcaactataggatctagggatgcatctgtgtgtaataaaactaaagacatacaaggaaatgaggacctgagaagtcaggataacatgatattttggggagaaggaagaggttttcattaggagtagtgcatgaaagggcttctggaagggcaaagttctctttcttgaccaaggtgctactgacagtgatgtctgccttttgttaactcatgatgcctgtgcgggatgacacccacacacatccatgttcagagacaggaagcagcagggtcatggggctgaaacggttctcatctccagctgctggaataatcaggaacactcccataatgttcttggttgagaattactgtgctaataaaactagcagaatatttattactgattttttttatttgattaatgtttggctctctgtatcaccattttatttcacaataaaaagtttgaggccgggcgtggtggctcacacctgtaatcccagcactttgggaggctgaggtgggtggatcacttgaggtcaggagttcgagaccagcctgaccaacatggagaaaccccatctctacaaaaaatacaaaaattagccagttgtggtggcaggcacctgtaattccagctactcaagaggctgaggcaggagaatcgcttgaacctgggaggcagaggttgcagtgagctgagatcgtgccactgcactccagcctgggcgacagagcaagacatggtttctaaataaataataaaataaaataaaattagcaggggtgatggtgtacgcctgtgatctcatctactcaggaggctgaagtgggaggatcacttaagcttgggagtttgaggctgcagtgagctgggatttcaccagctgggcaacggctgtgctccagcctgggcaacagaacaaaactgtctcaaaaaaagttttttaagttaaaaaaaaaaaaccccacaaaggagaatatgctaattacccagtcattgtgtccctgcgagggtaaaataaagtatgaatcagactgggtctgactcacttccatgtacccagcagaaggcctcgctcagagtacgagctgaataaataaacgggaactattattaggggtgtgtttacacattttccacgtagcagctactgtttattgaggccgtgtttctcaaaatgctcctgcatataacacctgagatgcccgttataagtgcagattcccagactccactttggtattgctgagtcagaatctctgaagggtgagacccagatgtctgcatttttttcccaagctcccccagatgatcctggtgcaaacaaaagtgtgataacccttagaatggactcattcacagtcagaagtagaatttatgacatttaaacaagtttgtgatggtctcgtggacttattaaagtaagcagaaaactatccaaaatgttaagacccagggctggcagtgctgtgggtgacaagtcaataaactattaataaaaatacaagctaacatctgttgagtatttagtatgtttcaggctctgtgctatgcgtgtgacaatcatcagtgcacttaattctcagaggtgcctggatttacctaccaccttccctctgagactccaccatgacatccttccttcccctcctgctacaggtagagtcactgaccacagagctgtcagctgagcgcagtttctcagccaaggcagagagcgggcggcagcagctggaacggcagatccaggagctacggggacgcctgggtgaggaggatgctggggcccgtgcccgccacaagatgaccattgctgcccttgagtctaagttggcccaggctgaggagcagctagagcaagagaccaggtaggtgagagcggaggccacaggagaaaggtgacctccacattctggttggtgagaggaaggaggctgtgttacaaacacgtggtttagaaacatccaaaagacatcatcatagtaatgactgctggcctggcatggtggctcacgcctgtaatcccagcactttgggaggcagaagcgggaggatcccttgaggccaggagttttcagaccagtctgggcaacatagcaagacctcatctctaaaaaaaaaaaaaaaaaaaaaaaagccaggtgtgttagcgtgtgcctgtagtcccagctgctcaagagcctgagataagaagatagcttaagcccaggagtttgaggctgcagtgagctgtgatcacaacactgcactccagcctgagtaacagtggaagaccttgtctctaaaaaaaaaaaaaacagccaggcacagtggctcacacctgtaatcccagcactttgggaggccaaggcgggcagatcatttgaaggcaggagtttgagaccagcctagccaacatggtgaaaccccatctctaccaaaaaacaccaaaattagctgggtgtggtggctcatgcctgtagtcccagttactggggaggctgaggcaggagtattgcttgaactcaggagatagaggttgcagtgagccgagattgcgccactgccctccagcctgggtgacagagccagactccatttaaaaaaaaaaaagaaagaaaaaaagaaaagaaaaagatgccaggcacggtggctcacgcctgtaatcccagcactttgggaggctgaggcgggcagatcacctgaggtcgggagttcgagaccagcctgaccaacatggagaaactgcgtctctactaaaaatacaaaaaattagccgggcgtggtggcacgtgcctgtaatcccagctactcgggaggctgaggcaggagaatcgcttgaacccaggaggcggaggttgtggtgagccaagatcacgccattgcactccagcttagcaacaagagtgaaactccgcctcaaaaagaaaaaaaaagaaaaagaaaaagaaaaaacaaacaaagtgtgtaaatatatgtaaatatttaaatgattgctgattttctgtatcatttaggatgctttgggctgcaagtaactgcagtctcactacgagtattatttacgtaataacgtgccagttagttatagctgaattacaaactactctgaaacttagtggcttaaaacaacaaccatttattattgcttatgagtctttggctagtaagttctgctcatttgggcttggtgggcttcactcatcatccgctcagttgagggtcagctagatggatttgctaatcttggctgggctttcattttttttttcttttttcttttcaagaacagcatgagtggtattggctgggcttgcataactcttaaggctttgcctaggacaactaagctaacttgtctctgctctatgtggcctctcatcctccaggaggctagcccaggattgttcatatgacagagtcaaggttctaagagcaagggaaagtgctaaagactccttgaggcctgcacttggaactggtactgtgtcacttctgccatatcctattaaccaaagcaagtcactcagcccgctcagattcaaaggaatggggaaatagatatgactgtttgataggagcaactgcaaagtcatattgccaagggtatggatacagaaaggggtgagaactgggaccatctgttgtatcagtctagcacaaagaggaatgtctttttttcaagtgataagaagtctagagctaggcagccaaaagatggtagggctctggatcaacatctgtgttgttttttagtcttttcctcatggtcataaaatggctgcaattgcaccaagaaccatacccacagacatccatgttcagagacaggaagcagcagtagtatggggctgaaagagtttccatctccagttgctggaatgaccaagaatgcccccataacattcctagttgagaactgctgtgctaataaaatgaacagaatatttattactaagcctaatacctttcactcttccaatacaatagattttcctattgctcagtactattcagcaacaataattacaacaatactaatagttcctatttattgaggatttactatatatcaggtgttggactacttgtatatacctgtatgataccacataatccctgtgagagaaagaccattgttatcctattttgcatgtagaaaaactgaggctgagatgggctataaatgtaggatacttgacttgctattcatcatctgcacattatctcatggggaggaatgttattatattatacatcaaatttatataaggttcccttttgtattcattcattcaacaaacaaatattaagagtgtactgttggggccaggcatggtggctcacgcctgtaatcccagcactttgggaggccaaggcgggcagatcacttgagatcaggaattcaagaccaacctagccaacctgatgaaaccccgtctctaccaaaaatacaaaaattagccgggagtagtaatggacacctgtaatcccagctactcaggaggctgaggtaggagaatcacttgaacctgggaagtggaggttgcagtgagccgagatcacaccactgcactctagcctgggcaacagagcaagactccgactccaaaaaaagaggagtgtactgtttaccttcccatgtgctggtcactgaaaaaattagacgtaccatggaagtatgtctaattacctccatggtatgtctaataccatgtctggtgggattccccaaggtgaaagactcatgagctggacatggcaatgaaggcctatgaactagaagggttgaagggacacagatgaagaagaagctggaataccctgagatgtagtggtttgggaagggtatctagaggaggaggcacttgagctggagctgacaagaatgggatttccagggcttagagtcccaagtcagttggcagctttgtgggaaagtctgggagacatcagggcatttggaggaggagtgtggttggttctgagagtctgggacccaggagagggatcagggagacagggaggtaaatgaggcttgaagcacacagagccttgaatactgggccacggaactctgttctgtgggcagtggggagccctgggggcaatggggagccatgggaaggctgtgggctggggagggacacggccagctctaggtatagaaagatctctctggggctaaggtgggaatggatcagaggagggagactggaagctgggaggtttggaaggagtctggaatgatggtccaagcagaacaagatgaggcctgagctggggctggggctgtgaagatgaacaagagaggatgaagaagagaaagcagggggcagaaggaatgaagcggaggctatgggtggtggcaggggaagaagacactgtttggagctaaggcctggtgactgagggaatattggctttttggaggaagatgctaaattcgttgtggaacttgatgagagtgaaaggcctcagggacaggcagaaggaaacggccccagaggtgcatgagacaagtggttctcagtccacagggtcacccaggggccccagggcttatgggaactgtagcttgaggtctatggggacccctgctccattatacaaatgaggaaactgaggttccgagggagtagatgagttgcttaaagtcaccctgcaccaggtgcagtggctcatgcctgtaatccccacactttgggaggctgaggcaggaggatcacttgaacccaggagttcaagaccagcctgggcaacatggcgagaccccatctctacaaaaataaaaattaaaaattagcccagcatgatggcacacacctgtagtcctagctactcgggacactgaggtgggaggatcgcttgagcccaggacattgaggctgcagtgagccatgatcacaccattgcactcctgtctgggcaacagagcaaggccctttctcagaagaataataaagtcaccctgggagcaaagaatgaccagatgattcttagctgaagaagtctcagccgggcgcagtggctcacgcctgtaatcccagcactttgggaggccgaggcgggcggatcatctgaggttgggagttcgagaccagcctgaccaacatggagaaaccctgtctctactaaaaatacaaaattagccaggtgtggtggcacatgcctgtaatcccagctgctcgggaggctgaggcaggaacaattgcttgaacccaggatgcagaggttgcggtgagctggagatcgtgcctttgcactccagcctgggcaacaagagtgaaactctgtctcaaaaaaaaagaagtctctctccttcatccttttccactgcttagtgccttcccactcgcccccagccctgtgccttcctctcagcacatctggggctgttgtatccagggtggctgtcaagcaatcccgattgctagaggtcccatcacatggacttcaccccagatgtgatggtccatgcaggagaggacaggtgtaagggcagaaagagtgttccctcccgctctgaagattcaagtctgctgaaataaactgacaataaatagattaacaaaataaaaggctacaaatatattaatgtgcatgaacacaggagccatgcaaaatataagactttttatacagggtcagatggttgaggcttaagtatcctctttataggggagagagacaaaaaggatgtattcaattgtgagagatagtaaatgattttcaggggaaaatgaatgggcccaaagagtaaactgtagtttgtaaatgatcctctttggaaactgaataggaccaaacatatacttattataactcacaacatcataggaaacaggtatgtgaggtgtcctagtagaagccaaggacatggatgccgaggagaaggcagcctgcatgtcagtgtttggcctcagtaaactgtgggaaccacttaggggttaggaaagagggaagaagccaatccaagaacaaggtgacagccactgcatgagtctatggggacaaaatcctaggttgagcccctctactgagactcctcctcatccctctcttcagagagcgcatcctctctggaaagctggtgcgcagagctgagaagcggcttaaagaggtggtgctccaggtggaggaggagcggagggtggctgaccagctccgggaccaggtaagcagctggcatcattagggagcagtggagagtgtgaccactggctgagaaattgcacaggctgtctccagaggcaatgagctcccatcacaagaagcaatgtgcaggtgctggactggaactgaatgcagataccatcttggcacttggcacatcagcagagggttggaatcagtgagtttgcaattcataaatgctggcatctagaaagggccctgtagggagctgaggaagccagggcaagggaagaagttaaaccctacccagaagctagaccaggactagcttctatgtaccaggcactgtgctaaagacataacatttactgtgtttaattcttatcagaatggtagaaggaaggtgctattatttaccctcttatttatgtgaggaaactgaggtacagaaaggtgaagtaacttgctcaaaattatttagctggtaagaggtggggtcagtattcaaacctcagcactctagccccagagtgtgtgttcttgattacttactgagcagttactgtgtcataagcaactgctttttaaaaaatacatatttgcatttcctcactagtcccatttcacagatgaagaaactgaaactttaagaggatatattttgcatcagagtcacagagatagagcctggatcagatcccaggtctgtctggacagagtccctctgcccttaaaagctcagctgtgctttattcgccattcattccacaaacaattattgagcacctgctatgtgccagacactgtggtaggcattagggatatggatgtgaacgaaacagaggaagtccctgccctcatggagctcacattttctgcataggatgagacgtaataaacctgtaaacaagcagataattacagattgtgacaagggctatgaagaaaaaaagtgaagagagaggaagacacagaggattggggaatcctcttcaggttgggagatcaggaagaactctttgagaaggtgacatttaaattgatacctgaagggtgaaaaagagccagtcagagggaacagcaagtataaaggccttgaagaatagaaatacgtttggtgagttcagaacaaaaagcagattagtatggtctagataaacatctgttgttattttagtcctggtctagcttcttggtagagtttaacttcttccctcactttggctgcctcagctccctacaagggcccttcctagatgccagaatttataaattgcgaagtcattgattccaaccctctgctgatgtgccaagtgccaggatggtatctgcactcacttccagtccagcacctgcacgttgcttcttgtgatgggagctcattgactccagaaaatgtgggataggaaggctgaacgataagaaatgaggtcagatcatgtatgttccctccctgaagagagaggtggtagggtctggggaggatctcagtgaagttggtctggacagtgggtttatgggaagagagaactggacaagaaaaagaccctgtggggcctggaatgccaggctgaggggctggaaccttgtcccgggggtactggggagccatgaaaggattgtgagcaggagggtctgggtcagctctgggtataggaagacctttctgaggccatgtaggagacaacctggaggggagagactggaggtcagggtagaggctggcatgagggatttaggagaaaagaacaaggcctaaacagagagcagaggatggggcagagagagtcagggggcagtagggatggggcagtagtgggctgttggagagggagggagtgatgacagtacctggagatataacccagtccccctgcttccatcaagctggagaagggaaaccttcgagtcaagcagctgaagcggcagctggaggaggccgaggaggaggcatcccgggctcaggccggccgccggaggctgcagcgtgagctggaagatgtcacagagtcggccgagtccatgaaccgtgaagtgaccacactgaggaaccggcttcggtatggtcatcccacgtacaggcctgacgggtggggagcaccctaactccataaaccccagggacgcgaggccgtgccaggggcaacaacagggggaaatgggatccacgggggtgtggggctgtgggagcagcggctgtgttgcgggagagccaaatccaggtaacttctttcttcccacacccatttctccctgtcatctctgtgccctcctttcccaccgtgcaccaccacctttctctcctttcctcctctctgtgtgtccttcatctctctctgccccccattgcttctgcccgtctccctccatttctcttgatctcatccctctcttcccccttattttgttctctctcttcctatctctctctctctccccctcatctctctctctcctccccctttctcctcccctcccctcccctcatttcatctctgtatcctggtctctcctccccacagacgcggccccctcaccttcaccacccgcacggtgcgccaggtcttccgactagaggagggcgtggcatccgacgaggaggcagaggaagcacagcctgggtctgggccatccccggagcctgaggggtccccaccagcccacccccagtgaccctaccctgtccccagatgcactaacagatggggcccagcccccttcctccctggaccccacgggcccctgtcccaggaaccccgccctctgacttcttgccctttggaaatggtgcagcactctggcatttatcacccccacctgggtcccctgcaacctcccatcaaaggatgacccctaaacacagaggagcggggcaggcagggaggcaatgactggagctaccttgcttgttgggggactgggtacagttggcaagctgtgtttccatcagctccctgtcctcctttcttccctcgttattgatctatagacattaggaagggagtgagacggctcctccaccatcctcagccagtgcaacccattccctctgcttctctctctctctctctctctccctccctctccttccctaccctctcaccatctttcttggcctctctgagggtctctctgtgcatctttttaggaatctcgctctcactctctacgtagccactctccttcccccatttctgcgtccacccctgaactcctgagcgacagaagccccaggcctccaccagccttgaacccttgcaaaggggcaggacaaggggacccctctcactcctgctgctgcccatgctctgccctcccttctggttgctctgagggttcggagcttccctctgggactaaaggagtgtcctttaccctcccagcctccaggctctggcagaaataaactccaacccgactggaccat

SEQ ID NO: 199 - DNA, 170346 bp, Homo sapiens
  source 1..170346: mol_type = genomic DNA
gtgcacgccgcagtgccggggactcggcggggcgccggccggcgggcggagaccgactcgggatctgtccgagcaggaagccagcctcagcccggccgctgtcgccgccctgtcctggtgcccgtccgcgtcgtcgccctcttcactggccctcatcacttctcaccgcgccctccagcttcacccgtacaggtagccccgccgccgcgcacctgccttcgctcccgcaccggtgagtgtcccagagacccactgcggggcgtcggcgccggggtctcgcgttccctggcccggccttgctcccgggcctcctcgagcagctccggggccgacgcttctgttcactgcccgaggacgcgggtgggagaagcaggtgatggatgggtgggccctgggcagcagtggggccggcggtggttctcgtttccaccgaaagacaatcagtctcctttcatgggttctcatcaccaaggtccctttgtgtttcttccctggctcccaggtagaagcagagcactcaggtgcctaactcggacttggacactccgtgatagttttattttctcttttgtaaacacgcttaaaattcagtgcagggggagcgcagtttgctctgagatgtgaagatcaaatgataccattaatagtctaatcatgtaggagaccagatcgagactttctaaagccttattcttagtctccaggtggtccagtaccttgagtatgttaatttacggatatgctactgaacaagaactttttttgttaatttccaaaaactccctaaaacgattaaaatgcttaaactctgggattttaattttaagtaggacacaatttgatggggttattgctagaacatccgtgtttaaaagtatttccatacagtttaaaaaattcattaccttttttttttttttttgagacggagccttggtctgtcgcccaggctggagtgcggtggtgcgatttcctctcactgcaccctccccctcgcgggttcaagcaattctctgccacagcctcccgagtagctgggattacaagcgcccaccaccacgcctggctaatttttttgtatttttagtagagacggggtttcaccatcttggccaggcaggtcttgaaatcctgacctcttgatccatccgcctcggtctcccaaagtgctgggattacaggcgtgagccactgcgcctggccaaatattctttacatcttacctggcataaagtgatgtggtggagggatgcttaaatcctgatttacaagtattagtgagaaatgaggagcactgccctaacttaatagacttaactgtacgggctaaataagcctcattttttttttttttttaatgctctggtggtatagatgcagtctatctaaataaagtcagaacttgagagttttaaaaattaacttttttttttttgagacagagcctcgctctgtcagctcactgcaacctccacctcccaggttcgaacgattgacctccctcagccgcccgagtggctgggactacagtaagggcgcgccactgcccagctaatttttgtatttttagcagagacggggattcgccatgttggccaggctggtctcgaactcctgacctcaggtgatccactcgcctcggcctcccaaagtgctaggattacaggcttgagcccccgcgcctggcctgaaaattaacattcttaagatttagctgaaacttatcttcacaccataaaacgtgaatcttgaacttggactggtagtggtcatggtacaaaggttggcggcaaaacagcatttctgtacaaattaactgaacttcctagatgtcttgggttgtggttttcaaactggagaatgtttagtgaaaaaattacctttgtgccttttttccttaattgtagaaaccgccacaaatgttacaaagtgggctatagccagagcttgaaaccatgctgccgttcaaaatagctcacagacttttatatatacagctcattttgagtattttacgttacgcaggaattgcatccactttggtaaacagaagtcattttagtcttatgtacatttgcccattatttttgtattttttgtgtgacatgctgtttatcattctctcatctttgtaagttacatttttgttttcagaaaccattgtaaatgtaacagaagtatgaatgacatttaaggaaagatcatgattaaaaactgtataatatataaaactatatatgatatacatatatattcttggttagtgcctagaaacatgagcaagaaaaatgttatgaacaattacaatatttaatgtaaattaatgcaattaaatattgcattaaaaacaaaagatcgtaaatcataaccagtagggattatctgaaatggatttttccctgtttatgtttacgtggtcaagttttaaaataacagtggccaggaaatctgagagaggctgaaggctctgttctcatcctgttgtgactttgcctggagtctgtggtgtatcatgtagcccattgtttagacaactgggctgtatctgggttccaaaatgtagctttctttagaaagttttaaagactttgaccatgtgaggcttgaacaaatgcaaacatccaaacattgaaaaaaacccattttaactttctgttgatagttgagactccatttttgacatgtaaaataccagttttaagaagagtttactaacctctgtgtagtttcatttttatatattaaaatatctaaaaatattgggaagtgttataacttaaataaatctcagagtttatttattcttttttttttttttctctgagatggagtcttgccctgtcatccaggctgtgcagtggcacgatcttgggtcactgcaacctccgtctcctgggttcaagtgattctcctgcctcagcctcctgagtagctgagattacaggtgcccgccaccacacctggccaattttttattattattagagatggggtttcaccatgttggccaggctggtctcaaactcctgagctcaagtgatttgcctgccttggcctcccaaagtgctgggattgcagtttcatagagtttaattatgatacccataatgagatatttcataataatttgtgaactggccctttactagtataagattgttgcacatttattaggcatcttccataattggacagatcacagattgaggggcttgatctacaaaataattttctaggctaatggtcttgtccttttacagatgagggagtctagtctcaaagaattaaatgcttgctccagaagggcaaagtctggattcacacctgagtcatttgaccacgaagcccctgttttttccaccagaacagtttgccttggtttcagttcacttggtggactgtttaaaccggcaaaactggtattatgtcaaagaatgtaattcaaggtttgacaaaagcatccaggagtagatatgataggccgtgaatgtagttctggaacaaatttagaatcctgtgtttgtgtcttcattctcaagttgacagccttgaacactgatgctgctgctttctcatttctcgtatagttctaggacattatatgtattgtgcatgtatgtatgctgttaaacatatgtatgtgtttaactttgataggtttgtgagaactagaattagattgtaatgttcctggttgggatagaactttaaaattttcctctaatgaaaaagataattatttatgcagtagctatcctttaaatattacataattaattctctaatcttgagaggggggactcgtttttagattatgattaaattgtcacttagaaactattagtacaaatcttttctatggtctgtggaatatcccttgagccgcaatagacataaatgacaacagtgagcaaataagcccattttttctggtaacaaactaggaatcatgcatttcagcagtaggatgtagttgggtaaatgagcagaagcaaggtaggaaggctgagttgggtggctaccattacggatttttttcattatttgctttgaactattaggaattgtgcatctcaaggatattcatattcaactgtaaatacaaaaccaccacctaatataaattagtaatattactaatataaattggtaatagatctgtgacacacacatcaagaagtagagttaaataagcttaagttctcttttggaggcattatatctatatgcatgtatctatgatctatatatgtgtgtgtgtgtgtatatatatatatatatatatatatgttttttggagacagagtctcattcatgccacatgcagtggcatgatctcggcttactgcaacctccatctcccaggctcaagtgacactcccacctcagtctccggagtagctgggaccacaggtgtatgtcaccatgcctggctaacttttttgtgtttctggtggagaggggttttgccatgttgcccaggctggtcttgaactcctgagctcagatagtgtgctgcctcgggctcccaaagtactgggattacaggcatgagctaccgtgccttgccggcattatataatgttcagaggaaccaggatcttttcatttaaaatggttctgattttatttgacaaatttgagtggactagaatctttaaatattttgcaacgtctttctagttactgttttcaaaaattagcttatttttcttattgattagtgtaagaatgacataatggtttgagaaatgaccataagtccaccaaaagttttccctgtgagtactgaagcataaaaagtaaaacctaaagaagaaatctggcatctttagaaatcttgctggtgctaaagagagaggaaataattttttatacagaaggcatgtctcaagtgaaaccaaaacaccaaagcacattccttcagtgtatattcacatggggtaaatatgatgctgagtaatgtgcacaaaggaaactcttgacaaaaacacagtcatcttttgagtatgttaggtcatttgttatttcatttgaaaataacctggctggggcgtggtggctcacacctgtaatcacagcattttgggaggccaaggtgggtggatcacctgaggtcaggagttcagaccagcctgggcaatgtggtgaaaccccatctctactaaaaatacaaaaattagctgggtgtggtggtgggtgcctgtaatcccagctacttgggaggccaaggcatgagaatcacttgaacctggcaggtggaagttgcagtgcactgagattgggccactgcagtccagcctggacgattgagtgagactccgtctcaaaaaaaaaaaaaaaaaaaaaaaaaaagtaagccgctgactaacctttacaaggtaatatattttctgtggcagaattttttgatttctgatctatgtggatgaacatctttttcaacagatatttactgagggcccactgtgttttagatatgacaagtgtgaactgattcctccctgtgctggcatatctttggatccaggaaataggaagagttgcagagatatgaaaaaataaatagaaaccatccatttgaaatccaaagacatatacgtcaaaagctaataacttatatttggatggcattttattgctttaaaatatttttgtatgcatttggtccttaaaacaacttgatgaagtagatttagtaaatttattccttttctacaggtaaggaaatggagactcaaaaaattaaaaatactggctgcatgtggtggctcatgccggtaatcccagcactttgggaggctgaggttgggaggatcactttagcccaggagtttgagaacagcctgggcaacatggtgaaaccctttcacaaaaaatattatacaaaaattagctgggtgtggtggtgcacgcctatagtgctagctgtgtaggaggctgaggttggaggatctcctgagcccaagaggtcaaggctgcagtgagctgtgattgcaccactgcactccagtctgggtgacagagcaagatcccgtctctaaataaataaatacattacttaaaattaagtaacttgttcaaggtcaatgtggctacttagaagcatcatctctgtgtagtcccaaagtagtaagtcctccactttccccctattgcttatgtatttaacctcacattatggcttcaagtcaggtggttcaggaagttctgaaaaattagggtcactaaaatggtgattattaaattgttacaggttattttttaatggaagatagaagatgagcatgatgcatcattatggaactactttaacattttaaatagattgctagactgaaattggtaattagcttttctagttggagaatttttaaagaacaattagttaaaaaaaggaaggagaaaaatgttctgggggaattttgaaaataacttttattactttgtgcattggtagtgatccgatagttacaactgtctttgtaaagactcactaaagaactgtgtgtgcgtctgtgttggttcctttatgtcttcatttatttaaaacgtactgtagtgtctaccacggaccaggcactattctaagttctagggatacagtgattaaattaagaccaagcccctgtactgacattttattgttgttttgaattaagttaattatagactcttcatactaggatgtaatcaacagggctgaccctaaagttgggaaataggcagttgtcaaaattgtgcaatttaaaggctactgcatgacttacttgctctggaatatttctgacctatctgtcgaagactcccagactattgggttatggcgctgttaccaacctgctttgataaatataagtatgttccatcatttatcacacttttagcaaagaaaactgagagaaaataaatgggaactagaattggacacggtgatgcttacctgtagtcctagctactcaggcggctgaggcaggaggaatgcttgagcccaggtgtttgaggccagcctaggcaacatagccagattctgtctcaaaaaaaaaaaacaacaagcaagcaaaaaacaaatgggactaggactgatatgttggtgttgtaagagaagaggttagcaaagtataattttaatagcagctattgttttttctttttttttgagacggagtctcgctctgtcacccaggctggagtgcagtggtgcaatcttggctcactgcaacttccgcctctcgggttcaagcgattcccctgcctcagcctcctgagtagccgggattacaggtgctcacgaccatgcctggctaatttttgtatttgtagtagaggtggggtttcaccatgttggccaggctggtctcgaacttctgacttcaggtgatctgcccgccttcgcctcccaaactgctgagattacaggcatgagccactgtgcctggccaatagcagctattgtttattgagcttttactaccatgtcagatattatgccaagtgagtatttttgtatacattagctcaatcactgtgtcacctcagtggtgctggtgttatgaccttcattttacagattaggaaactgaggggcagagatgttaaatttgctcaagcttatttggtggtgctggaatttgggtctctgctagtactaagcaggtagtagatactaatgtggaaagagtacttatgtgtgttgtgtgtgtatatatatatatatatacacatatatatacacaccatatatagtgtgtatatatgtgtatatatgtatacacacatatatagtgtgtatatatgtatacacacatatatagtgtgtatatatgtatacacacatatatagtgtgtatatatgtgtatatatgtatacacacatatatagtgtgtatatatatgtatacgcaatatgtattgtgtatatatgtgtatatatgtatatacaagagtacttatgtgtgttgtgtgtgtgtatgtatatacacacatatatacacacatatattgtgtatatatgtatatagacatatatacatatacatatatagacatacatacatatgtgtgtgtatatatgtatatagacatatacacaatatatgtgtgtgtatgtatacacacacatatacatatagaacatatatacatatacatatagaacatcagaagtctgtgtgtgtgtgtgtatatatatgtatacacatatatatacacacacacacatagagacagacttctgatgttctgctaggatgtgtgacacatcacagaggtgggcgaccttggtgtgggagtgatgggtgtggggagtcaggatagcttgttgggtgaggggtgggaattggggttggaaggagatgggagggtattacttgcctaactacttggtcgtcaggcttaatcctctctctgacagccctggggttccagagttgcgtttaagcacagtgctttcttgtccagctcctgggtaagaggataggcagacctgaggcaatcctggttttgtcactcattaacttggtcaaattatttcatttctctaggcttcagttttctcatctataaaatggaagtaacaatattacctacctggtgtggttcttatgaggattgaattagataataatacatgtaaaacacagatcacactggctagcacatagtgtacattcattattattgttgttactgtgtttttttttgtcatgtttaatgtggaattttcatcgaaaagcaagaagagcaatatattagtgatttggttggaatcttgaagttggctttttttttttttttttttttttgagatggagtctcgttctgttgcccaggctggagtgcagtagcgcgatcttggctcaccacaccttctgcctcccaggttcaagcaattctcctgcctcagcttcccgagtagctgggactacaggcacgtgccaccatgcccagccaatttttgtatttttagtagacacggggtttcactatgttggcaagcttcccttttgatttatgtgcaaactggaattagagaactactagcttaaactttttctttatcttttggttagggagggcttcaacaagattaacgacaatttgcttgggttaaccaggcagtatgtggtagagggaagtgaaatatgttaccagaatctcttcattgacttttttttaaagcttatttggggcttatagcattgtatggagaagacaatgcagtgttaaatttcgcacctaaattagattgtaatgactgtttcagctttttgtttgtttgtttgtttgagatggagtctcgctctgtcacccaggctggagtgcagtgttgccatctcagctcactgcaagctccgcctcctgggttcacgccattctcctgcctcagcctcccaagtagctgggactacaggctcccgccaccacgcccagctaatttttcttatttagtagagatggggtttcactgtgttagccaggatggtcttgctctcctgacctcgtgatctgcccgactcggcctcccagagtgttgggattacaggcgtgagccaccgcgcctggcctgtttcagctttttaactagcttcattcggaggtgattagttaatattagttaaaattgttaatttttaacgattatacaaatagtaaaaatgtataaatacatgtttgtatagatctttttttttttttgagatgtagtctcaccctgttgcccacgctggagtgcagtggcatgatctcagctcactgcaatctccccctcccaggttcaagcgattctaatgtctcagcctcctgagtagctgggatcacaggcatgtgccaccatgcccggctaatttttatatttttagtggagacggggtttcaccatgttggccaggctggtctcgaactcctgacctcagctgagccacccgcctcagtctcccaaagtgctgggattacaggagtgagccacagcgcccggccgtttctatagatccggtcatttctatagatcttaaaaactttcaaaaacttagatttctttagataatgtgctgttgaataatcagacttggcattgttagtcatatcaggcaaagccccaaaaggaaggagattttacccctggtggttcacatgaagaggctatttgcagaggttagagaacaaacaagtgtggtaaagcgctcagggattagaaacagtaagaaattcttagttctccagaaattaccagagcagaaagctggcattgtagaggagggctagagggagctgcggttttgaagcaggaggggcgtgaagggaggttccctgatctctcttccctcttcctccgagtctccaccggtgacttactttactagaacccagctggggagcccaggtgattttttttttttttaaagctcattctcccagtgcaagagcagagaaagaattgaggatgtgaaggagcaaatggagattaactaggacattatttagaacctttggggatttgtagcatttccttggtacattttaaaaaaaacttgtagcattgtgatacatctgcaaaatacttgggactaattgttttatacatgctttcagaaatagtttaatcactttctcatttaactgaacaattattttaggaaattttgatgatccgtataacccaacaagaaacataatctaggtctgttaacacaaagcacttttgttaatatactgttatactttgctgaggttttctgaaattttcttcactaggcagtcctggtttaatggaatacatgtttctttcattaaaaatctttagtgactaaattaaaaatattttggcaataagtctttcgcttttctggaatttatacttgtattcacctggaattttttttgacagcaagagcactagaacatagtgttgatatggtaatagttcatagaagcaagactattgggaaatagttgttcgtccttcccaagtccttttgaggacacattaaatttctgtataaatctgttgcagtttgctgttatcttgcagttgctgatattttgctaatgccaattttacctagttaatcttagttctggcaaaaagtttgtgctctttattttggatagattccttaggggttactaaagaaaaggatttctcttcttaaagagatggtatgaaggattctagggatataagtaatactccccccaaaacaattagattatgacttatattttctttcttctcttgaggattccagggaaaaagaagtacaagatcttactcagattaagaagcagctagagagggccttgttcatgacctccagaaaaggaaaagccgtattgtgcagggttgagcagatgaataaacatctggctgagagaatttagcatacaaataaagtatacctctggatataaatgttataactgagttaaaaaaaaaacaaatatgtttcccagcttgtcttttttagagagtatggtgaaaatgagaaacaggtttggaatcaactgaataacacctgtggttggaaaccaaccatttagacattttctctgtaagtaggcttttttttttttaaaggagtgattttcaaacttttgtgggatcttctaaaaacatattgtttatttggatttgacactgatggaatcagtatcccgcaggagatatttgaggctcttagtttttccatgttgtattctttgaatttccttgatttgaggattgagttattccagagagaacttttctcttcttccttgttattttttttctaaaattagatgaaccagctgtgttttggtttgtgggcatgatttgctgtctgttatccttttggtcttagtatctgggggaagaacaaagaacctgtgtgtgttttgaagaagaatgtattagtttctctgctcttcttgttcatcttggttgatctttaagatgagaagaacgaagaaaatactttatgtacttattattcttgtgtttgatatttcaaacaaaactgtggcttgtattggccactgagatgatggagaaaacaggtgaatgtaaagtgaaaaactagtcatcatgtattcaaatggctaattgaagaggtttatgttaaaggttttctttcaggtatgggaggagggaaaagaaggatggaaattgaatgagtttgaccatatgaccagctgtcacgacagatgttttagcaaccaggaaatatttatttcaatcagaatttaattttatattttatagggatgcattctactaataagccttttttttggaaggaaagtgaggataagttaggaatttataaaccaatttggtgattttagtaagtcattagtaaaaatggagatagcctggtggctgcatatactgatgctagtatgttagaaaatgggctgttagaacacacacacacacacacacacacacacacacacagacacattttttttttcctttttgccagatgtgcaactgtatacagagggctattatttattaaaggtgtgtttctggaactggcccagaatgtcatggactttagtcctgttttctaggattctgctatttggtatataacactgatataggttagtattttcagaacatgtggacaacagagtaggtcagcatgattgaacagtgaaaggtttatgtcagatgggttcggggtggcagtatattgtaatgatggattgaatgagtgatctaaaatcatcctagcacagtataattgtaacagttctttttttttttttttaagacagagtctcactctgtcgcccaggctggagtgcagtggcgtgatctcggctcactacaagccccgcctgccaggttcacgccattctcctgcctcagcctcctgagtagctggaactacaggcgtcagccaccacgcccagctaattttgtgtttgtatttttagtagagacagagtgtcaccatgttagccaggatggtctcgatatcctgacctcatgatccgcctgcctcggcctcccatagtgctgggattacaggcatgagccactgtgcccccggccataattataacaattcttgagggccaattatatgccgtcactttgagtgttttgcagttattttctcatttaattctcacgttgaccctatgaggtgactattcttattattctattttatagctgagagagctgaggtctaagtaacttgagaaggtgatagatgtagtaaggagtagagtcaaaagatgcttccaggtggtctggctctagagtctttgctccacttagaattctaagcttgctttttctgtgtgctcttttaaacactcagagctttgaaaatcaaagagttaatcttttctgtttttatctccctacacaaacagtagtaaaatggtgacattcgtgcatctatgccccactctcaagtccagggaagacagttctgtgatacccacttcccttctgagccagactcaccctcagatttctgctctgcacagggctccagcctccgctgccagtggatgagagaggggaggcctcctagacccaaatctaagccattgtctgcagctcttgtcttttaaacctcttaacaactacctgttttagttatatacctgttataattacatacttaatgtatgtgccttaagcaaatgtattcctgtaaagttttatgtaaataatgaatttaagtgtaatttaattttttttttgtagagataggggtcttactgtgttgcccaggctggtattgaactcctggtctcaagtgatcctcctgccttggcctcccaaaatgctgagattataggcatgagccactgcatctgacctgtaattttttttttttttttttgagacggagtctcactctgttgcccaggctggagtgcagtggcatgatctcggctcactgcaacctccaccgtccgagatcaagcgattctcctgccttagcctcctgagtagctgggattacaggcacctgccacgcctggttaattcttgtattttcttagtagagacggggtttcaccatcttggccaggctggtcttgaactcctgacctcatgatccacccaccttggcctcccaaagtgctgggattacaggcgtgagccactgtgcccggcataatttttttattattctgggaaagcttcctatttaaagggtcccagtgataatttcttttgtaaagagaagaatctttgtataaaacaaatgattgtttcctagattatattaataaaatacggatttttcacacattacttttgcataaacatagttctagctaaatacatatttgatataaacatgccaaaatgaaatttgatcttatattgtgcttcatattactaataaaaaaggattgaataatagttttttccttgaataaatgtcatttgttggatttgcactaaaatgtgcttttgtaggcttatctacagtaagaataatattcttttaggcagtaggttgaggttcaatatgtaacacaatagtatattattttgttataaaattcattaggtaaatgctagagttctacttaagtgccaaaatcagtattttatgattctgaaataaattatctgaaaataacaaagtttagagagataacttaaaaacttacagttgaaagacaaactagtctttgaaaaaaatatttttctgtaacaccaggtaaaatacttatttcctgtagttaatataatgctaatgaggtcttgatcccagattcattgtaatttgtgctgtgtccctaaacactcaacagtgactactctgtaactaattaatagatccagtggcctcatttagagcattattcttttccaacctcttcatctatttctttttttgttttttagagatagagtctcactctcatcctggctggactgcattcgtaccattatagatcatggcagcctcaaactcctgggctcaagtgatcctccacctcagcttcccaaagtgctgggattatggatgcgggccaccatgcctggtctctaaattcttactgtgtgattcaaaatcctttttgacctatcttgccccactttttcactatagcactcatcacacctgtgccattctccttcgctctagccccgttggcctcttccccaaacgtgtccccattctcctttctccttagtcttgttcaaacaaaccctttgtctggagtgcacttttctttagtcattcttacccatctttcactacctgcttgaattaaatctttgaaagtagccaccccaaatttactatttggaattacactggtattataatgtacatcaaaggttctgtgatgtatgtgtatcttctttcattcttgtctactctacctagattgtgaattactggagggtataaactgcctagcgaggggctttgtaaggttttttttgatcagtggatctcaggtctcaggactcttttacacacttaaaaattactgaagactgcgtattttgtttatgtggattatatctattgatattcactgtattagaaatttaaaaatgatttgatccaggccaggcactttgagaggctgaggcaggcagatcacttgaggccaggagttcaagacccgcctagccaacatggtaaaaccccgtctctactaaaaatacaaaaaattagccgggcgtggtggcaggcacctgtagtcccagctactcgggaggctgaggcaggagaatggcgtgaatccaggaggtggagcttgcagtgagccgagatcatgccactgcgctccagcctgggcgacagagctagactccgtctcaaacaaaaaaaaaaaagagagagagacttgaaggtcagatagctaaccactggcagaactgaaagttaattcataagtctcttagtttggagttcatttttcctgtcaatattgtgcagttaaaaaatttagaggtaatttcacatataaggctatgactaaaaaaaaaagcttttttttttttttttttttttttgagacagagtcttgctctgtcacccaggctggagtgcagtggtgcaatctcagctcactgcaacctccaccccctgggtccaagcgattctcgagcctcagcctcccaagtagctgggactacaggtgcacactaccacgcctggctaatttttgtatttttagtagagatggggtttcaccatgttgaccagactggtcttgaattcctgacctcaagtgatctgcctgcctcagcctcccaaagtgttgggattacaggcatgagccactgcatctggccaaaaataaacatttctttttgtgctataatataataaaattctgtagggaagaaatttctgaactcttacccagtgctctagaatcaagtttcatctatttgtttcacctcttaaaaaaaaaattaccagaagtgatggtatgtgcatctagtcccacctactcaggaggctgaggtgggaggattgcttgaactcaggagtttgaggctgcagtgaactatgatcatgccactgcactgatacagcaagaacttcaaaaaaaagaaaaggctaggctcagtgatttatgccagtaatgcaacactttgggaggttgaggtgggaggatcatttgagcccaggagtttaagaccagtctggacaacatagcaaaacctctctactaagaataaaaaaaaggttagctgggcgtggtaggtgtgtgcctgtagttccagctattttggaggctgaagtgggaggattgcttgagcctgggagtttgagatggcagtgtgatataattgcaccactgaacttcagcctgggcaacagagtgagactccgtctcaaagaaaaaagcaggctgggcatggtggctcacacctgtaatcccagcacttttgaaggccgaggcgggcagatcacttgaggccaggagttcgagactatcctggccaacatggcgaaaccccgtctctactaagaatacaaaagttagctgggcggggtggcgggtgcctgtaatcccagctacgtgggaggctgaggcaggagaatcgcttgaacccaggaggtggaggttgcagtgagcagagaccacaccattgtgctccagcgtgggtaaaagaactagactctgtctcaaaaaaaagaaaaaaagaaaaaaactagtagacagtgtaacctacacatatgtgtgtgtgtgtatattttatatatatacatatacagatatatacacttaaaaattaatacagtattctaacataaaggaaagttattaaattattaattatagtaattacattaatatattgtttatttcagtttgtgaaggtgcaggcagtcctttactacaaggcagaataaagtagtcagatgctactaacatctacatgtagaataatcatgaatgcagcagctgtaaattagactaatatgcaagtattgtaattggtgactcaaatatctttattagcattgctctataatgtgatttttccagcatgatgaacaccttttggtaaagttccaaataaaggacagtcttctttcaatttatgtgttattgtatgctttttagtcagtgtgtgttaaagcaatgcaaaaatattttaaatatatgtacacatatattggattagattctgggcttacctatgttctcctctgaatttgctgttcattttaccttctatacatcattagtggcatcacaataatttgaaaatttgaaataaaaagttcttggcccatacccacaggagctggatcagtttgtagcatcctcacagacatttgtgctggctgcagtatttttatttttttgtgtcatcttcctcaattcattctttttttttttttgagatggagtcttgctctgtcgcccaggctggagtgcagtggcacaatcttggctcactgccacctctgcctcccaggttcaagtgattctcatgcctcagccacctgagtagatgagattacaggcgtgcaccaccacgcccagctaatattttgtatttttagtagagacgagttttaccatgttgactaggctggtctcgaactcctggcctcaagtgatctgcccatcttggcctcccagagtgttgggattacagccgtgagccactatgcctggccctcaatttattcttgagtgttgcattcctgtctttaagtgagacactgaagcttttacattctgaataataatacatataaataaataataagaatgaatataaaattaatgtttcatttaaagtgatgtaaatgagaaactataatagttataaatagtatatggttcataaatacacatgatttacaaattcctttttttttttttttttttgaggcagagtctcactgttgctcaggctggagtgtggtggcatgatctcagctcattgcagtctctgtcttccgggcttaagcgatcctcccaccccagcctctgagtaactgagactacaggtgcgcaccaccacacccggctaatttttgtatttttgtagtcaggcttttgccatgttgctcaggctggtctcttaacttctgagctcaagccatctgcttgccttggcctcccaaagtgctgggacttcaggtgtgagccattgcccctggccacaaattctattcttaagcaattaaattggtggaaatttcttgcatttaaaaaaaatgaatttactacagaaattatattttgcctcccaaaacactttcaccatttttaaaaataatgaaataaggtttgttgcccaggttggtcttaactccgggtatcaagtgattctcctgcctcagcctcctaagtagctgggattacatgttggaagagctgcccagtgtgtctgcaataataaaaaagaaactgaaacattttaccagtttgcatttgcccaggagctatggtgatcttctttgagtccttccaattttagtatatgtgctgccaaagtgagcacctctcagtgtttttatgggtgtatctattgcagaatgcataaataacttttttacctgtagttttagaatatttggatgttaataatctgatctattttgcacctgaatttaaatacaagattttaaaaaatttcacaaaagagttttcctccaagtgtaaataattcattttattttattttattttattttattttattttattttattttattttattttattttattttattttatgagatggagtcttgctctatcacccaggctggagtgcagtggtgtgatctcggctcactgcaacctccgcttcctgggctcatgtgattctcctgcctcagcctcccgagtagctgggactacaggcgcctgccactatggctggctaattttttgtatttttagtagagatggggtttcaccatgttggccaggttggtctcaaactcctgaccttaagtgatccaccagcctctgactcccaaagtgctgggattaccggtatgagccactgtgcctggccaataattcattttaataccttcaagggatagtgagtttgggaataagcaaagggagtagcaaattattgctgtaaaatatatgaactatatatgaactattttgccatagagaatgtattagtctggtttttgtgttgctgtaaaggaatgcctgagactgagtaatttataaagaaaagaggtttaattggcacagggttctgtaggatgtagaagcatggtaccagcatctgcttctggtgagggcctcaggaagcttactgtcatagtgaaaggcaaagggagagaggttgttgtcacatggtgagagtggcagcaagagaaaaaggagggaagtgccacactcttttaaacaaccagatttcttgtgaactcagagcgagcactcactcatttgtgggggtggcaccaagccattcatgagggatctgcctgcatgcctgaaacacctcccatcaggtcccatctctaacatcggaggccacatttcagcatgagatttggagggagcaaatgtccaaaccatatctttccaccaaatctcatgttcttttcacatcgtaaaatacaatcatcccttcccaaaagtccctcaaagtcttaactcattccagcaagaccaaagtcctaagtctcatctgagactcatctccttccacccatgagcctgtaaaatcaaaacaagttatttacttccaagatacagtgagggtacaggctttgggtaagcattcccattccagaagggaggaattggctaaaagaaaggggttacaggtccctgaaacccaacagggcagtcattaaatcttaaagctttaaaataatcccctttgactctgtgttccacatccagggcacactggtgcaagtcgtgggctcccaaggtctcgggcagctccactccctctgctgctctcaagaatagaattgagtaggctgggcgtggtggctcatgcctgtaatcccagcactttgggaggccgaggtgggtggatcacgaggtcaggagatcgagaccatcctggctaacacggtgaaacccgtctctactaaaaatacgaaaaattagctgggcatggtggcacatgcctgtaatcccagctacttgggaggctgaggcaggagaattgcttgaacctgggaggcagaggtttcagtgagctgagatcgtgccattgcactctggcctgggctacacggtgagactctgtctcaaaggaaaaaaaaaaagaatagagttgagtgcctgtggcttttccaggttcaggatgcaaactgctagtggttctgtcattctcacttctggagggcagtggcccccttctcacagctccagtaggtggtgccctggtggggactctgtgggggctcagaccccacatttcccttcctcactaccctagtagatttctctgttagggcttctcttgcttcgtcttcttgcttctgctctcaccatgtaacaccacccactctccctttgcgttgcactatgattgtaagcttcatgaggccctttccagaagcagatgctgcagccctgcttatacagcctgcaggactgtgaagcaattgaaactcttttcttaaaagttatcctgtgtcaggtattccttcatagcaaggtaaaaacagaccaacacagagagattgttataaagatacaaagagaaattccgtaatgagatacctagttgaaaacagccagaagtaatgttctcatgttgtttattatatatagtatttgttgctctgtatgtggtattcaaacttctaaactaacctcctttaggtttgtttgtttgttttgagacagagtctcactctgttgcccaggctggagtgcagtggcatgatcttggcttattgcaacctccgcctcccgggttgaagcgattcttttgcctcagcctcctgagtagccgggattacaagcttgcaccaccatgcctggctaattttcgtatttttagtagacatggggcttcgccatgttaaatagtctggtcttgaactcccgacctcaggtgatccaccagccatggcctcccaaagtgctgggattacaggtgtgagccagtgcccttggcctcatttagttttataggcattttccaatgaccattgtttgtgtaattgaaagccagatgtcttttaactgatttatctttcctgattatttgatgtcacattggcaatttagttgaatcttgatggataacagtataaatattttgatgttgttgacgaggatagtattgatagcttaccccaagacacatgtgtaagctataagataacagcacttttttttttctttttttttttttcccccctgagatggtctcactttgttgcttaggctggagtgcagtgatgcaaacacagttcattgcagcctcgacctcctgggctcaagtgatcctcccgcctcagcccccaagtagctgggactagaggctcatgccaccgcgcctggctaatttttgtattttttgtagagacagggtttcatcatgttgtccaggcttgtctcaaactcctaagctcaagtgatctggccgccttggcctcccaaagtgctggaactacaggcgccagccactgcatccagcccagaaattttcttaataaaaaggattcttcaaagggttttttttagtggcctccactaaattgtgtgtatagctcccaggagtttaattaataaacaaaaggaaaagagtgaatatgtattttaactcaaggtacatttatctgtagttgttcctcatcaaaactgcagtaactgtatttagatattagatgctaaatgtatttctctctaaatagagtttagagagaaaaaatcagctacacaaagatagatcctaaacaattaagaatcctcccaaattttaaaagacagtatgatgaaatctttcccttactcctgtttgcagtataaatgagattgaggttgactttctgaataattatttacaggaaaacaatagaattcacatttgatactgtgagaagtcaaataatagaattctagggttgagatacctgtgctacagcttaaaccattaagtcccatatcttggagggtggcatttgtcagtactttttcaaagatccccaggtagttccaatctgcagttcaattacttatcttttttaaaaattaaatctttgtaagtaaaactttcttgtcaggtgttgaggaaactcttggtaaccagaatgttttaaaaatttagtttttgtgtactaatttttaaaatgtatggtatcttgtggaggagttaaaaaagtagaacactctctgggatagagacttaagaattatttaaaattattaaaatggtacacttgatacaaaatttgaaagtagaaattaattctgttgaaactaatactgttgagtctacttttctgtttctggcctaccgtatctaaaccactctaaacaggtcactcacttgttttatccttattttaatgagcttctgagatgaagtttctgtaacctctttttgtctcctgtttgtcacaaagattcttcatgtcttacctaaattgctttgtttacattctatgttcggagatgtaggtaggccatttgatcattgatgtgagtatacacactcatacactatcccccacccccgtcgcacagtttaaagccttctcattcgcatagataattttgtaagtctgaatagcctaatttagataaactttcttcgtagttcaattagaaaactctccattttgagtgcttggttaggttttaatataaaggaaacattttacattaggaatcattgttttactaaccttactgacaaaaagaaatagtgatgaggaaatgactaaaaccagttcagacagtattgagcatccagatactacaagggttgagaacagacgggactaagaacacatgtggagaagtcagctctgaaaagagttttggatcaccttcaggtataggtggatgaagttaccgatgtgttttcagttggagaggcagagtgttgaggaattttatacctattgtgttgtatttttctgtcaggtaggcattaagtcatcttgattttctgtaggatggagataatattggacccttcaatgaagtgctaaagttttgagatagtatttgaactgtgttggtgatctttataattttagtaaatatacttattattaaagcatattgttcaattatcttgttcaaataattggatttttaagtgtatttacttgactttttaggaaatgtttaaattgattctgtgaggtaggaaagtgactataggtttatctatatgtgtttctgatagtcaaaaaaagatgaagtaattgtcataattgtgacatagaatccattagaagtgaaataatatagttggtgcaaatactatgctagtgataaacatgagtggtgagaatgaaacagattcttcccaatttgaactttcatattctggtaggcaggctgtttacatgtgaggatatttttaacacttgattgaatttctccaaattttatataaaataatgagtatccaattatgatcagtagtaaataaaaagtggaatgtttgacttaacactcaactctgcagctgaaccattgtggagaaactaaggttcggaatgacagccacacaagttagagaagattttaggaaactggaattgattaccttgaaagaaataagactaatgaggtgattcagacatgtttcaaatgcagaaggtagtgatcatgtatcaatcagtattttttggtgaaaacagtagaaggcttgatcttcagctgcattcagagggattttagactagtttgttagtttattcattgagagttgtttgcctgctatgtagaggcacaatgccaggattgagagatggatttgtgagcagtacagacacagtcccaccatcatcaagcttatgttgcagtagggagatggacattaaacaaccttttatcatatggttatgcttcagtggagaagttctgtgggtgctatgaaaccatattagagaggaaagatgtgagaaagagcagtgtaagatggtggcaaaacattaggatgggtgacggaatacctctgtgaactaatcaggcctctttaaaaattcacccttcccaaactacaaaatcaacttatttgttcattgtggaaaatccacaaaaccaaaatgaagtgaataagaatctttgatatttctattacatagagataatcactagttttttagaaggccttaaaaattaaatgcattttcatctttataaggtgactgggaaatttcatttctagacctggaatttatggttgttgtttctctgactaatgctgctgtatcaagaagagtaattatcataatgatactactgtaacaccttgctatagccccacttaataattgcttgatgaattatgtaaatgaatgttcattcatagtccaaagcaaatagttttttgagatgttaaatataacaggtaatataaatgcttttttacataataaaatgtaatgaacttatttttacataataaaatggtatatatttttctaggtgaatgtaatttaacagcatgatagttaacatttttgtaccaaataggattaatgatttttattaattatagccctgtataaatttaaataattgatagacccataatccagtagtttgaataaagttatctttacttttgacatgttcttttcatgcatttctgtctttctaccactaaattgctgatattcatttactttccattggatcttttttgctaccattagagaatgaatgcaatttaatgttttatgtgaccatttagacctttaaatattgaaatacattaaagcaacatgggtgtttttacttttcatgtaacaattgtcttcttacctttaaaaaagtagcttcttaaataatagttaaaattttatggtatatttgttagagattttccttaaagaggaaaatcaaggaattgaagtcttccccttagctttaattttaatcccttccccccacttttatgaagtggtgcttaaaactgggggagtttattgagaaattattattattattattactatttttttttttgacggagtctcactctgtcacccaggctggagtgcaatggcacgatcttggctcactgcaacctcttgtctcccaggttcaagcgattctcctgcctcagcctcccgagtagctgggattgcaggcacatgccaccacacctggctaatttttgtatgtttagtagagatggggtttcaccatgttggctagggtggtgttgaactcctgacctcaggtgatctgcccgcctcagcctcccaaagtgttgggatttcaggtgtgagccaccacgtccggtgagaaattattttatgtatacaagattatcctttgatattatcatttatacattgtaaagaaggtgccgtttttgcagtgccagtagtcccaatagtacagtgagttctctccattaagtataatcctcccgggatttgggatttgtggttgccatgttgccactggtaaggttagagtcttcataatagccgagctgagcaaattcttccatagcaggcacagaagaaattgtgcaggtcacctctgggtcaagaacttatacagaagataatgctgccttggcttctggcactggggggttgggctggcccttgtctctggatgcttcaaatgagatgcattggcaactgtccaaattggaaataaacttctcaggttccaggcctcccttggctctgaggcctgtgtacgggagacagcagcatctggggtggatgcctgctttaccaaagatcagtctccaaccttgagggctgtgctgcttatctgttgacagttggggagcagattgccaaatacaggtcaggaggtgtatatgacctataaaagggtcttctccttttccagttaggctgctcagggcttcagctttattcagttgttcaattttattttgttattgtttaacaattctgatgtctagttaaagtttagtaatgcattggtttgagggaatatggtctgagtcacaaatccatagagctactattatgcagggatggaaagtggctttttaatggagttgaccaatctgttcctaatatgagtaattagtgatatttacaaggtagcttgaatcctgataggcagagcacactggtgtttttcgttttgttttcatggaatgtgtagcgtatcatttctttaagattttatcctactcatcttttaatactccattcaaaatggagttcctgtgtcctggtccttgtccttcactgctcccccgagcaccatttctaggactactttatgtcagtactataaatattgctgtacattgtggtgtacttgtctttctccttttgtaagttgtaaacgcttgattttattcttgtgtcttcagggcctagtacttttccctgttagaatagatgctccataaatgtctattcaataaataattttatcctgtgcactgtgaatatattgtcactttttaaatattgttttctccaaatataaattctaggccatcctatcaacataaaatttctcagaggtggtaagattgggctagtcaaggacttaatgagcaagggaacttataatactattttttaaaaaagaatattagcagcaatggttagaaagggttaaagccccataaatctttttgaataacatctgtttacattgtgttcattttaagttaatcagctaaaaagtgaatgcatccttttgccaaccagaaatcaaaataatacagcggttggcattcccctaggccaccacctggttgctcttccctatttagaaactaagcactactatcattttggtgtgtatatgtctgtcttttactattacttacatttttagtcttgtagaaacgtgcagtgtgtgtgtgtgtgtgtgtgtgtgtgtgtatgtgttttggtagagatggggtagtgctgtgtttcccaggctggtctcaaattcctggcctcaagcaatgctcccactttggcctcccaaagtgctgaaactataggtctgagccactgtgcctggccttgtatgtgttttttgtttatttgtttgtttttttaacatgaaagatcttgtactccataaaatgttttacaattctatttttttatgtaacaatagctcatgttggaagataaagattcaccttactttaaaaaattattgcatgactctctgtccagatacagcatagtttacgaaaccatttttttaatcgataggtattcagatggtttgtggtttttcctctcttaacagtgctttagcagatatccttggtgtgtactaagaaatactggttcagaggatttaccagtttatagtctcaaagtgagaacaactcaatgtggcaggtttttaattttcataactgtgatggatgagaaaagtatctcattgttaaatgtattaatatctttcttaagggtacatatcagaatttacgcttgtgtcttcagggcctagtactcccaagctcaagtgataaagatggatcactttatcaagtgataaaaatatggtttcctggcataattatttacacaaatgtggctggctgtttgaaacacagactttgggtttaaaagatttttttaaaaagttgagtttgtgatttctttctctttttttctttttcttttctttcttttttttttgaaacagggtctcactgtgtcacctgggctacagtgcagtggcgcaatttcagttcactgcaactttgacttcctgggctcagatgatcctggcacctcagtctccccagtagctgggactacaggtatgcgccaccacacccagctaatttatatatatatatttttttttgtggagacaaggtttcgctgtgttgcccaggctggtctcaaacttttgggctcaatctgtctgccccctgtggcctcccaaagtgctagaattacaggcataaaccactgcacccagccaagtttgtgattttatatgaagaaacacttattccctgcccccaattcattttagtttagcttataatacaaagaaaaaagtattctttgttcttcagtttccagaatgaaattatttgaaggccaagaccgtgggagacagtttcaaacttgaaaaaacagtttaatacagcatagaatcaagacaccatattatattctgatttagagaaatggatattttgattgttaattacttataatggccaaggtataagacaccttacaaatattgtacaatatggtatttttttttaatttaaaaattgaaacagagtcttgctgtattgcccaagctgatcttaaactcctgggcttgagtgatcatcctgttacaccctcctgagtagctggattacagacgtacatcatcacacccaatgaatatagtatattgtcttctatattttatggtttcttaagaattttgcagtaagtcaacagttttgtttaattgctttatggtattttgtttatatatatgtcttgtattggcttagtgaatataagtaaaataaatagttctaaaaaatttctggccgggcacagtggctcacgcctgtaatcccagcactttgggaggccgaggcaggcggatcatgaggtcaggagattgagaccatcctggctaacatggtgaaaccccgtctctactaaaaaatacaaaaaaaattagccgggcgtgatggcgggcgcctgtagtcccagctactcaggcggctgaggcgggagaatggcttgaacccgggaggcggagcttgcattgagcccagttagtgccgctgcactccagcctgggtgacagagcgagactccgtctcaaaaaaaaaaaaaaattttttttctgcctttttctaatttcccgaagagaaaaaaaggcattgaaagtgaaccagaatataagctaattattctcctaattacttctgttgccatttgagtttgtttgctaatgaaattcttttttttctttttttaaatacttaaaaaaaaaatggaggccagctgcagtggctcacgcctgtaatcccagtattttgagaggctgagacaggaggatcctttgagcccaggagttcagaccagtctgggcaacataaatcctatctctacaaaaaaacaaataaaaaaatcagctgggtatggtggtgcatgcctgtagtcctagctgcttgggaggccgaaatgggaagattgcttaagcccaggaggttgaggctgcagtgaaccgtgatcccgccagtgcattctaggctggatgacagagtgagactttgtctcaaaaaaaaaaaaaaaaaaaaaaaaaagagatagggtttggctacattgttcagtctggtctccagctcatgacctcaagtgatccttccatcttggcctcccaaagtgctgggattacaggcacatgccactgtgcctggtgtaaattcttaataaaaaacgaggccgggtgcagtgtctcacacctataatcctagcactttgggacgccgaggtggtcagattacctgaggtcaggagtttgagaacagcctggccaacatggtgaaacccagtctccattaaaaatgcaaaaattagccaggcgtggtggcaagtgcctgtggtcccaactacttgggcggctgaggcaggagaattgcttgaacccaggaggtggaagttgtagtgagccaagattgtgccactgcactccagcctgggtgacagagtgagattccatctgaaaaaaaaaaaattcttaataaaaactgttgttttaaaaaaatgcattttgagacagcatatctgttttaattgactgagttgtctttcatttttgatactttattgtaatatgtcattttcactttaggaactatatattgtgttcattaaccttagtgttttctttttttaaattctttttctatggctgtttaaaaagaaaagtagaaagaaaaaggttttatgctttagtcatttcatgtggtaattattacagatctctcatttctcccttgcctgctattcgtttagtttacagtgctaaatgacttacctttttcttaaccagtttgttgctgtagcttgttacacttttcattcttgctgttatcccatctctagattcaagtttcctttttcttctttcccttttaagcctgtttttatgtgtccttattttcttgccctatatcttactgctgtatgtactgtctcttaagctgaaaacaaattctctctgtctggccaaggattctggattctgactgtcttcatggacctctttgaaatctacttgttgcaaaataattgggtaatgggggctggaggtctaggaaaaaaaattgggtagtggcaaagatcattgttaaatcagcacactttaaatatgtgatgtggccaggcgcagtggctcatgcctgtaatcccagcattttgggaggctgaggggggcggatcatctgaggtcaggagttcaagaccggcctcgccaacatggcaaaaccctgtctctactaaaaaatacaaaaattagctgggtgtggtggtgcacacctgtaatcccagctacttgggaggctgaggcagaagaatcactgtaacccaggaggcggagattgcagtgagtcgagattgtgccacagcactccagcctgggtgacagagcgagactctatctcaaaaataaataaaataaaataaataaatatgtgatgtgaaaatgttacttgatattaatttttttgttctttatagagacaacataaggtatatgctggatttgaagttttgtgaagataaactaatactgatatacatctgttcctccagaaactttaatcttctctgaaactttgttacaggttttaactgaacatagagctatgtttagccatttgggttgaagagggcatttactactcatcccttcaatcaacaaatatttaataattccctctatatgatatactatgttagatactggctgcttatgaataagcagtatgtaatcctggaccttaaactctaaggagagattaaactttttttttttctttttttttgagatagagtcttgctctgtcacccaggctagagtgcagtggcttgatctcggctcactgcaacctccgcctcccaggttcaagtgattctcctgccccagcctcccgagtagagtagctgggactataggtgcacaccaccacacctggctaatttttgtatttttagtagacacagggtttcaccatgttggccaggtcggtctcaaactcctgacctcaagtgatccgcccacctcagcctcccaaagtgctgggattacaggcataagccaccgtgcccagccgagattaaaatttaataacaaaattgggccttgggcatctaaaaggtcagtaaaattgattattttgagaataaagtagaaaacaaagcagagagagactaacactatgtaaagttaaaagtaggttcatagaaaggggtacctaatcctgagaagggttagagtgaatgacttcggggaggaggagagatttgcttaatttttgaagcagagagtagaaatgcaatacaggaagaataggggagaggtctttctggcaggagtacaaattgtgtgcatggaatggtgactcttcagtggcctttgtgcacagcagatatgctacgtatagaggatacccttggagaatttgacccattctgtaacagtgagagggatattttttgagttcctccatctccagcatggagttgacacgttgatctctgctggggataactcagctttccaggttttcaaggttgcatgtgtttcctccagtgtcatttggagaaactgtttctgttcaagataagataagacaaagggggctccgtgggtggctcatgcctgtaatcccagcacattgggaggctgaggcaggtggatcacgaggtcaggagttcagagaccagcctggctaatatggtgaaaccctgtctctactaaaaatagaaaaattagccgggtgtggtaggtacctgtagtcccagttattcgggcggctgaggcaggagaatcacttgaacctgggaggtggagcttgcagtgagccgagatcgcgccactgtactccagcctgagcgactgagcaagactccatctcaaaaaaaaaaaaaaaaaaaaaaaaaagataaaggaatggggggagtggcgtgtcacctaaaccacgtgtggacagatgaggactggtgctggagttcagagtgaaactaattattctgagtaaccttactctaaatattatagtgaggtgagtcatataaagtatgggcaggaaattgagatgactttgggatgggttgctcagttctctggcttaatgaaaatttcaaaaaacatattttcctttgcattttgaatctgactttgtgctggggattttgtttgaatttaatgatagaccaaaatgcaattactgtacacattaccttaatgtgtgtcagtttaaaatagttttatattgtcatagattttgtggatttatcttggtttcttataccaagataaattcttaccttacactgtcttttactgtctcttacccttattatattcaagattcttattgctgctgcttccacataattttttaattctttttttttggaaggggcaggacagcatgaaagtattttttttgtcattctttatagctggttaaaaggaaaaatggaaagaaaaaggtttatacttgagtcatttcatatggtgattattacggatctctaatttcttccttgcctgctattcatttagttttcagtgctgaatgtcttaccattctcttaaccagtttgttgctctgcttgttacacttttcattcttgctctgttatcccatctctagattcaagtttcctttctcttctttctcttttccctttttagcctgtgtttatgtgtccttgttttcttgccctttatctattattgctgtgcatactatctcttaagctgaaaacaaattctctctgtctggccaaggattctgagtgtctttgtggatggacctctctgaaatttacttgttgcaaatttagtttttcacaaaagaacaagtgatagtccttgataatcctcagttagctagttagcttttttttttttttttttttgagaagacagggtcttgctttgtcacccaggctggagtgcagtggcatgatcgcagctcactgcagccttgatctcctaggctcaagtgatcctaccacctcagtctctggagtagctgggattacaggcatgcgccaccatgcccagctaatttttaatttttttttgtagagatggggtcttgctatgttgcccaagctggtcttgaactcctgggctcaagcgatcctcttcccttgccctcccaaaattctgggattacaggtattagccactgagcctggcctcccagatagatttttagtctttcctcagagtgcctctagttttctcctaaagttttagtttttctatcctttgggaaatagcctataggcacaaggtcttgttttgattttgaatgggaaatattgcctgggtcacatggttgggttcactgaaccggtaacccaacttgtggaaattaggacgtcgaagtagacttgttaagtggtgctttcagcatttctccctttttctcttccggtattttgatgatggctcacagggtagaggtctttattttaataatgacatattttccagaagggatagtttccatctctgagatgacatttgatatcttcttttttttttttttttgccatttaaaatatcccacttacctcagtaatgttgacacataccataattagtaagggcctcgggctgtgtctaaaaggtcaataacattgattattttgacaataaagtcaaggttcctttattaatgcctaggatccacctatcattttgatgatcatttagtgtttgcaggcattatgaaagagttggaaatttatcatctagaccacaacataattacatgacctttatttgtgaattttttaaggtgaggggagcaaaaaggctgtgtattaggaagaggtcagatttctgccttatggttgatgggatgaggaaagaagtttgagtatagttcttgtttatcagagtttgtcttaagtgggatcatggtggagggacttttttatttttatttattatttatttatttatgagacagagtcttgctctgttgcccaggctggagtgcggtggcgccatctccgctccctacaacctgtgcttcccgggttcaagttattctcctgcctcagcctcccgagtagctgggatcacaggcgcatgccaccatgcccggctaattttttgtatttttagtagagacggggtttcaccgtgttagccaggatggtctccatctcctgacatcgtgatccgcccgacttgggctcccaaagtgctgggattacaggtgtgagccaccgtgcccagccatgactttttatatgagtagccagagagatcctgaatgggggagactttatttgagggacttggaattgggagggaagtttgaaaaaaaaaataggattggacacagagaatggaagtgaagttgaaagccagaattaggagtgtaatagaatcaggctggggaaagccagctttccataggatatggcagtatggagaagagcaaagtgaaagggaagtttgcccggcgcggtggctcatgcctgtaatcccagcactttgggaggccgaggtgggcagatcactaggtcaggagatcgagaccatcctggctaacatggtgaaaccccgtctctactaaaaatacaaaaacaaaattagctgggtgtggtggcgggcgcctgtagtcccagttacttgggaggctgaggcaggagaatggcgtgaacccgggaggcggagcttgcagcgagccgaggtcgcaccactgcactccagcctgggcaacagagtgagactccgtctcaaaaaaaaaaaaaaaaaaaaaaaaaaagagggtggagctgaggaataaagtatcagctgaagattgcggggtgtagctttagtttgaaactttgttatagagaaactaaaagtgatttgtggtttaatttgttaatccttggaattggtggggggcagtgtaataatgtaaggagttactttataattccttatgcttttagtattcagtgcacactttcatttgttctccaaatatggatttatatagtgtttttaattaagtaaatgtaaattatcattttttcatctagtcatttattcaagggatattttattgagcatcaactgtatgccaggctcttacaactcaggaaaagggagagagagggatgtatattaattgctgtctgttctattgctgggcaaacagaggaatgaatttagtataatgtacaagttacattggttttatatgtagcttttcccaggctaatctttggaagcacagagtagcaagctttctcctatttaaaaagaaagtcataagaatagctggaaattatcctgaaatgtattcttttggaggaagtagtatagtgtagtaattaagaacacaagttcttaatttgtcaaatttatacatcttttcctttgtgattaatgttgttttggatcctagttttttgttttgttttgttttttggtcttttcttttcttttttttttttttttgagactgggtattactgtgttgtccacaccagactgcagtggctattcacaggcgtgactgcagcctcgaaatcctgggctcaagcgatcgtcccgtggagctaggaatataggcacgtgctaccactgcctggcttttgcgttctgttaatttttttttttcctattgtaagatcatgaaggtaatcttctatacaaacttatagaagctttattgtttgcttttcacatatagatgtatgacccacctatgtataatttttgtatatgatgtgcagtaggactcaaattttattttttacccccaagtggatatccagttgtccccgtggcatttattgaaaagttcatctttccccattatctgcattgcttacttctgttgtaaattaaatcaagtaaatatttatatatttatttttaaaattaaaacaatttttttttgagatggagtcttgctctgttgcccaggctggagtgcagtggtgcgatcctggctcactgcaacctctgcctcccaggttcaagtgattctcctgcctcagcctcctgagtagctgggattacaggcacctgccaccacgcccagctaaattttttttgtgtgtgtgttttttagtagagacagggtttcaccatgttggccaggctggtctcaaactcctgacttaggtgatctgcccgccttggcttcccaaagtgctgggattacaagtgtgaactactgtgcccagcctatatatttatatatatataaatctttgctctttttccttggtctgtctgttcatgcactattaccacactgttttattgtggctttatagtaaatcttttcttcctgtctaggtcttcttgaagaatgtcttggctattcttggcctttgcatttctgcatacgttttagaataagcttgtcaagttcctggaagaaaatctgttgaaattttaattgggattgcattcaacctagagatcatgttggagagaactgacattttcagtagcattgagtcttctcacctaaggtcatagtgtgttgcttactttatttaggtctttgttaatttaataatgttttatagtttctttgtagtattcctatatattttttcttttcatttttattttgctcttaatttcatatttccagaagggctgcaagggctgtactgtacagtgaattcctgcataccctttacccagatttctcagatgaacaccttaccacattttctttatcattttctctttctctgtacatatacatacatatacacacgtcttgcacaactttttttctgaactttttgactgtaagttgacatgctgtccctttacccctaaacacttcagtgtgtatttcttgatagcagaatcattatctcatctgaccataggtaacagttatcactactatactttaaaatctgcagactgttttcggagttcacatgtctgaagcatgtcattcatagcaaagataagtcccagattctgcgctgcattcacttgttagtgctttagtctcacgtcatctggaatagttatttacctttctttgtgtttcacgaccttaaaatttttgaggagttcaggccatttattttgtaaagatgcctatgcaatgacatagcactacacacccactagaaaggctaaaattttttacacttatactactaaatgctagcaaggatgtcgaacaatgggaactctcatatgttgcttaccatactgctgggaatcctactcccaggtatttatccaagagcaatgtctacacaaagactcacatgtgaatatttgtagcagctttattaatagttaccccaaattggaaacaattccagtatccatcagcaaatcaacagataagcaaataaccccatgcagtgaaaaactactcagcagtaaatagaacccaactactgacagccacaacaacatgcatgaatctcacaagcattatgctaagtgaaagacaccagaactcaggaatacatgattccatatatatgaaattctagaacaggcaaaagtaatctccataataacagaaatcagataagtggtggccaggagctaagaaaggcaaatgaaattgactacaaagggggcatgagggaactttttgggggaatggaactattccatatatatatatatatgggggaatggaactattctctctctctctctctctctctctctctctctctctctctctctctctctctctatatatatatatatatatatatatatatatgtatttttttttttttttgagacagtcttgctctgttgcccaggctggagtgcagtggcacaatcatggctcactgcagccttaacctcctgggatcaagtgatcctcccacttcagcttcccaagtagctgggactacaggtatgcaccaccatacccagctaatttttatgtcttttgtagagataggagtctcactatgttgcccaggattgtattgaactcctgggctcaagtaattctcctaccttggcctcccaaacttgtgggattacagtttgagccaccatgcccggcctattctgtatcttgaactgtactcctaagaagttgaattttactatatgtaaattatacctcaacaaatgtgactttaaaaaaatcattagaatttggcacattaacagtgcaaaagtttccagcctgggcaacatggtgaaaaaacacaaaagattagctaggtgtggtggtgggtgcttgtggtcccagctacttggaaggctgaggcataagaatcacttgaacctgggaggcggaagttgcagtgagccaagatcgtgccactgcactccagcctgggcaactgagcaagactcatctcaaaataaacaaaaagtcattccagaaccacgttctagcatcatctttccctgagcttcttctgcctcagcccaatctcctcccaccagtctttctcacctttattcccactgtgtcccccacacactcttccagcagatcctgaaaaaaacgatattgcttgtatttacttatgttctccccactaaactgaagcaccctgatggtggggatatccgattcatgtaatgtaataccagctaatttttgtatttttggtagagaaggtgtttcaccatgttggccaggctggtcttgaactctggacctcaagtggtcctcctgccttggactcccaaaatgttaagattacaggcatgaaccactgcctccggtccagaatgattttgtcagaagaagccatttgagctaaagcgtagagatgggataaacctggaatacttggaggaacttggagcagttgagaaggctggagagtgtggacctgaggaaggaggtgggagaagggaattaaggaattaaggtggaattaaggaattgaggaaagaaataagcgtttgtcatgctattaaacaaattttttgaaaagcaaaggcaacatgatattccttcatatgcaatgtaacttcttcacaaaacccaaaaatgaacattattcagtatgctgcaagtaggttttactgatgaaatgaaggaagatgctgagaggtctctagactcacttgctatttagatgtctagtttcaggttaccaacctcaaagtactttctgcctttcaaatttagatcttcaattcattacagtaccaggtttcattgaatctaaaatatcatgaattctaaggtacacaattaatattttatatactgctaagaaagaaaaaagtcactgccaattaagtaatgacacatcatcaaatgctaaatacatctcaattttaaacgtgttaatgtgtgaaaaagtgcctattggagatacatggtctttcatttaatcctcataacaggtttcatgtacatattattcactgtatgtcatagcttttcatggtaattcgtattgagtaatcaaacctgtggttgttcactcttcgaatgctgaattataccgtattataatttagttaattaccttttattgttaaatatttatttccaagtttttttctttgttttgtttttcacctgcccctccctctccacctctttttttttgttaactgccgcttcggagaatataagcttttttaaaattaatttttatttataattgacacataattgtacatatttatggggtacaatgtgatgtttcagtgcttgtatatgtagtataatgatcaaagtatatttactgctttaaacgtgtcatttctttgtggtaacaacattcaaagtctcttttagctatcttgaaataaacactacattactatttgctgtattcaccctactgtgtaacaacaccagaatttattcttcctaactataactttgtacccattgaacaacctctcctggtcctccccctgtcctccaccctctttcattggtaagcactattctactctctacttttatgaaatcaatttttttagattccgtgtatgagtgagttcttacagtgtttgtctttctgtgcctggcttattttacttaatatattatcttctaggtccatctgtgttcctgcaaatgacaggatttcattcttttttgtggcggaatactatttacctgtagatgggcatttaggttgattctgagtcttgtataaataaacttttgattgttttcttaaggatagatgcctggaagtgaaaatactgggtcaaaaagtctaaactttcttatgactcttgatgtatatgcatatagtcatgttgcttttcaaaactactataccaatttaaattgtttacaatacttaaatgtgtaaattccatcttcattagcagagtatcacaataaatttgttttctaattctgtaggcagaaatagtatctctctcctttttttttttttttctttttgagatggagtcttgctctgtcacccaggctggagtgcagtggcacgatctcggctcactcactgcaacctccgcctcgtgggttcaagcaattctcttgcctctgcctcctgagtagctaggattacaggtgtgtgccatcacccctggcttatttttaaatttttagtagagatgtttcaccatgttggccaggctggttttgaactcctgacctcgagtgatccgcctgcctcggcctcccaatgtgtttggattacaggcgtaagccacttgcgcctggccagaaatagtatctcatttttcggaccatgtcaaaagaatgataacatctcattttagtatatattttttggattactgattagattgaacatttgatcacattaatttttgtaggagataattggtgtataagtttctggcattttcttgtgataataagtaaattataaatgaagaacagatgtaattatgcagatgtcatgacatttttaattgtgagatttattttttccctcatagtaatataatagctgtatatagagatattttttgagatggaatcttgctgtgtggcccagactggagtgcagtgggtcaatgtcggctcactgcaagctccgcctcccgagttcatgccattctcctgcctcaacctcccgagtagctggactacaggcgcctgccaccacgcctggctagttttttgtatttttagtagagatgggggtttcaccgtgttagccaggatggtcttgatctcctgacctcgtgatccacccaccttggcctcccaaagtgctgggattaaaggtgtgagccaccgtgcccggcctaatagctgtatttttaattgtaaagaataattgatgcagttagaaagttttggaatcctgtgaatttctaattttgatctgttgctcagttgttgatttttaaggtgagatttaatgttttaaagaattatgacttcaatatgtataatgtttgttgtctttttaatgctgggataaaattttaatgatttctaaccagtgtaaggctgtgaaacttgattatctgaaaattattaaaattataatagtatatcctaaaaatgtaataatatgtgctattccaagtggttaaaaaaatcgagacttaaatgataaaacaaagattctgctatattccttttgtcttaagtttattccattagtaaaaagtactcgatcaaggagactttgacttttttcaactgatgttaagaatgaaaaaagatatcttgattttatgtcataaggatgtgtttgaatacttgtgaagcagaagcatttggcatgaacagtttaaaattgttactatttatttgtgaacgttttaaaattgtttaacttgaacaatttaaaattggttacttctgagctacactaatcctagctattttaaactggctttcagcaatatatattacagtgcatacttgaatcatttttttggaacagaaaattggatgttaagtaatatttattaaaacgcagaatttttctgtggcaaaatatttctacagtgggctctgatagaaacagattttttaaagaaagtagaggggttggcacagttcagttgacagccagttgatggacaaagaggagccttgtcctagtgctctgttatgtggctatggatgagtcacttaaatttcctgcctgtttttgtttttggaaatgaaaacaataacactggttatggattgttcatattataaaaacagttaaattctgatgttctgccgaaaaattggttcatcagtcggttataattactgttgctacttggttctaagtttttaagttttagattaagatggatttcatggcttgatccagtccagcacattttaaatgatttcactttatagatattaattagttaccctggatgatgagaaggggttatcagtatcttgttaacaaaagaagctgttaaattattctcaagaatataaggtggactgtatacttattttttacaaagggaaaaaaggggaatttgtgccatggaaactaaagatcccatttatttttgtcattatgccaaaaaataacaacagtgttttctctctggcttatttagagtggtagagcttctttgacgtttcctatttctacctctgcttgtatcgagctgtagaactcttcatttagaatataacattttcaaatattgaaaaattacttttttttttgtgggattgccactaggtggtgggtataatatgtgaggaatgatcagcagtaataatagttctgatagtttcgggtacctatatttttacattgttgtgctttttcattattgtgtatatttgaacatttctgtgaaacttagtttcttttcataattattttgtttattttctttagagacaggatctcgctctgttgcccaggccaatgtgtggtggtgtgatcatagctcactgcagccttgaactcctgggctcaggtgattcacctgtcttagcctctcaaatggttgggattacaggtatacaccaccatacccagctaaattttttttttttaatttttttgtagagacaagatctcgtcatgttgaccaggcttgtcttgaactcctggccccaagtgatcctcccacctcagtctcccaaagtgttgggattatatgcacgagtcactgtgcataatgattttaaaatttcagagatctcaaaagatgttactgtaccctgggattagtcctgtttccccttagggaaaatatttccaattttataatgaaagttagaatacaagtcagtgacaacataatccacttacctgaaatgcattttacagcaaacttttaaagattaagttacaattcttatataagacaattatattactaaggattgaggcttaaaaaatgattaaaatgggctgagtgtggtggctcacgcttgtaatcccagcactttaggaggccaaggcgggtggatcacctgaggtcaggagttgagatcagcctggccaacatggtgaaaccttgtttctactaaaaatacaaaaattagccagacatggtggcgggcgcctgtaatcccagctacttgggaggctgaggcaggagaattgcttgaatccgggaggcagaggttgctgtgagccaagatcgtaccactaccctccagcctgggcgacagacactttctcaaaaaaaaagaaaaaaaaattaaaatgagaaatgtaaaattgtcagattaataaactttattaaacattcccaaggcaatgatgaaaataattaacagtgaattattctataaagatgtgtttccttgttaaacattggacttcttgataaacatggagaatgtctacgtacatttatatcttctttctcttctgaaacatcattagaatgatagtataggaattaaaaaaaattacatagttgggaacatccctaccaaaaagttagatgtgcccagttactctagaatgaagtcataggtctccatgtacttacatcgagctgctggttagctacttagtgactttctaaatatgaatggaaaacaagttgagaaaagcctttccatgagaaagaaaaaagcaatagaaggagaaaagcagccagaagtaatcagagacaatggagggaaagtaaaaatgtgactgtagaaataaaattttctgtggaagggttagaaagtcaagtggaggacattcccaagacggtggaataaagggataaatatataggtaatagaagagaaaagaggcaagagtaagagtggcaatcttatagaaggagaacattaaattatagacctcagaaggcaagaactgaataggaagacatctaaaaaatagaaagaatatcagaacattcctcattgtatgatttgtgcttccagactaaacatgttcttaatgtatgtagcacaatgaattcaagcaacacagagccatattatcatggaagtttagggcacccaggattaaggcaagatccttcaagctttcaagtaataggggtgaaataaaaaggggtacgaataatcaggaacctaaaaggcatagcagttctggatgctaaaatatatgttctcaaaatcttgaagaaaaatgactttcaacccagaactcaattatatgtgtgtgttcaatcagtaatttaagtatgaaggtagaacaaagaccctattgagcatgaaaggactcaaatacgtacctaggagcgagcagtgaagggaagccccagaataatagctggcagtagtttcagagagcagccaaacaagggaaggaggggtgggaggcactgttgttggttatataagcaaaaaaaataaaaaaaataaaaaaaaaaataaaatgtgctcttttatcacctaataagaaaattaatataaaatgcgtctttgtgaatcactgttaatattgaatggaccttgtgagaagattgtaattaatactacttcattgtgaacaactaaactgaagaaaaaaaggcttaagccttcaatgcaaagaaattcatccttcatgaagaattctcagtagttctaatggattctattccaggatggtaattcttgtgaagtgagaccaaattgtagctgagttgaattttaattgttgaataatcactgtgtaattaattccagagaatgactgagattatgaaatagtaactgagtacttgaactactctgaaactttagatttatctgaccttaatgcctacggacttaaagttgttagtgtaaagactcgagaatgaattttggtgtaggcggaaggcagcagctttaaaagaaatcatcctatgttggtggttaggagtcaaggcaaaatgcctgcagcaccgtagaggagagggtttttattgtgagatctactttaaaaaaaaccaaaagtttgcttacttttaactccggggaaactgaagctttttaacccataaataacattcctttgagatattgccatgctttatgagctgggaaggtgtatggagctttggatcatataatcagtatgatcgattatttttgtttatgaaaagttaactgtttgagtaactttttaagtgccttgacaaaaccattatggttttatcaggttttatagaggatctcagtaatgcataaattgtgtctgtctcaagtctttgtctgaaaattaaaaaatccaggcatactattccactgggagacattcccattataatgtttgatttattggctacttagcagaattttatagaaatctactttaaaagaaacctgactcccacctaaactttgccaactgtttggataaactttgtatttttatccatgttttgagaatctgttatattactgtatttctttaattttactaatccggcacatttgtgcaaaatgttaaattggagggcaagtgatgaatagatctgatttgagggtatttacattccaacagattggaacagtcagaaaaatctagttgctgagtaatagcattattaaaagatgattgctctactgaatttgctttttaatgggtttatgacacaaagtcccataagatctatggatactcaacaatctgtatacataaagaattaaatctctcataggtatgaagttttcttttaattttatttgaaatacccagtcagttattaaattacttaattccttgtttatgaattcactaattatttgctattatctggtgccctgcttttggtgcttttttcccacatcatattagattattgcctaccattctgttctaccagagacctttctaatatggtcagtgacctttctaatatgcatatctaattaggtgaccctcagttgtctgtagaatagagttaaggctgtttacaccttggcatagatctgcctttatctgtcaggctttgtcttccaccatacttttttcccccttcttcctctcagtacaccctccagtcttactaagtaacatttatgtccagtatttcagcttttaatttcacatctttgagtttttttttgaaaattataatttcaccttttattttagatacaggggtacatgtacaggtttgttacatgggtatactgtgtgctactgaggtttagggtatagatgatttcatcactcaggtggtgaggacagtacccaataggtagttttttagccctttccccctccttctctgccccctctagtagtccccaatgtctatgactcccatcttttttttttttttttttaattgagacgaagtctcactatattgcccatgctggtcttgaactcctgaactcaagcagtcctcttgccttggcctctcagagtgctggaattacaggcatgagccaccacacctggcattggctcccatctttatgtccatgtgtactcagtgtttagttcccacttgtaagtgtgaacatattgtatttggttttctgttcctgtgttaatttcacttgggataatggcctccagctgcctccatgttgctgcaaagggcattatttcattctttttaatggctgcatagtattccatggtgtatgtgtactatattttctttatccagtccattgtttatggacaccgaggttgattccatgtctgttgtgaatagtgctgtgatgaacatacaagggcatgtgtcttttctttttctgtgtgtgtatttatttatttatttaattttatttttttgagacagagtcttgctctgtcacccaggctggagagcggtggcacaatgtcggctcacttcaacctccacttcctggggtcaagcgcttctcctgcgtcagcctcctgagtagccgggattacaggcatgcaccaccatgcttggctaatttcatttgtatttttagtagagacggggtttcttcatgttggtcaggctgatctcgaactcccgacctcaagtgatccacccgccttggcctcccagagtgctgggattacaggcgtgagccactgcgtccagtgtgtgtatttatttttaagcaggcatattatgttcaaagaatgcatgtgtctttttggtagaacgatttattttcctttgggtatatacccagtcatgtaattgctgggtcagatggtagctctgttatatgtatttttttttagtttttatttttttttgagactaagtctcactctgttgcccaggttggagtgcagtggcatgatcttggctcagtgcaacctccaccttctgggctcaagccattctcctgccttagatacccgagtagctgggattacaggtgcctgccaccacgcctgtctaatttttggatttttagtagggacgaggtttcaccatgttagccaggctggtctcaaactcctgacctcaagtgatctgcctgcctcagctttccaaaatgctgggattataggtgtgagccactgtacctggctggtaactctgttttaagtttagaaatctccaaactgctttccatagtggttgaattaatttacattccaaccaacagtatataagcattctcttttctctgcaggcttgccagcctctgttgtttttttactttttattaaaagccatttaattaggtcccacttgtcagtttttgtttttgttgcagttgcttttggggacggagccaaaaattcttagccaaggccagtgtcaagaaaggtatttcctaggttttcttctagatttttatagtttgaggtcttatatttgaatctttataatccatcttgagttgatttttatatatggtgaaaggtaggggtccagtttcattcttctgcatatggctagccagttatcccagcaccatttattgaatagagagtccttttcctattgcttgtttttgttgactttgtcaaaaatcagatggttgtaggtgtggggctttatttctctgttctctattctgtcccattggtctgtctgtttttgtaccaataccatgctgttttggttactgtagccttccgtatagtttgaagtcgggtagtgtgaatatactgtgatctaataggcttttattcctgggatgtaagggtggttcaacatatgcaaatcaataaatgtgattcaccacattgacaaaattaaaagcaaaaatcattggatcatctcaatagaggcagaaaaagctttctgtaaaatccagcatcccttcataataaaaaccttcaacagactaggcatcaaaggaacataactgaaaataatgagttgtctatgataaacccatagccaacattggactgaacaggcaaaagctgaaactattctccttgagaacaggagcaagacaagaatgcttactcacaccactcttattctggaagtcctagccagagcagtcaggcaagagaataaataaaaggtattcaaataggaaaaaagaagtcaaactgtctatctttgctgatgatacattctatatgtggaaaaccctgaagtttctcccaaagactccaagaactgataaatgacttcagtaatgtttcaggacacaaaataaatgtgcaaaaataagtagtatttctaaacagcagtgacgttcaagctgaaagtcaaatcaagaacacaatcccgtttacaacagccacatagacaaaacgaaatacttaaaaatatagctaaccaaggaggtgaaagacctctacaaggagaaccacaaaacacttctgaaagaaatcagaaaaccaggcgcggtggctcatgtctgtaatcccagcactttgggaggccaaggcgggtggatcaccggaggtcaggagttccgagaccagcctggccaacatggtgaaaccccatctctactaaaaatacaaaaactagccaggtgtggtggcaggcccctgtaatcccagctactagggaggctgaggcaggagaattgcttgaacccaggaggtggaggttgcagtgattcgcgatcttgccattgccttccaccccggacgacaagagcaaaactctgtctaaaaaaaaaaaaaaaaagtattttactttggtccttgatttatgtgacacacctaggttaaggaagaacaaacatgtttgtaggcaagagagtctcatttttgtaattcatcatcaacttttgaaatgttaaaattaatatttaaaaagtattagctctagcgagtcaataaggcaagcaaatatatagacttgtttgtaaagcaagaaaatatttactttctttttttccctttgaatttacttactacaaggtagggtttgtgtgtagcctagagtttgaaccttcatttcaaggaatgaaatgaaacaagatggctcttgtttcttgatttttgcctgttttttgagcctaagttagtgttctcaaatggggaaaagatgagaaggagagggtaggtgtagactaactttacccatgttacagtgctttgggatagaagcatagcactgcttctctgagtatttcctgcttccccccaggcatttgagtacctgggatattatcactttagttattccccttcccccaataattaattccaattcttttaatggcagtggtggtaactttaagactttaggagtttctaggatcttatttctatgtgtggtttagttttttatttagaaagaatgtgcttttcttttttgtttaggatgaaaaatactaattttttttctggtgctatgcctgacacatattgggaattcaataaatgtttgtagaatgcatttgtaataatttcacttcatggttcaacccccctccagactctactctccccaaacagtcccgtaataagagtgagcccttactttcacgaaagaaaattcaaaattggtatgcggctgaacaaaggtaagtgagtcaacataatcactcagaagcaccatacagtgtgtttcccaacacaattaagaggagacaggacctgggagctgccgagaagtacagaggcttccatctcaagggccttcagttacaagtggatgtccttaatgtattttcagtatttcacaaagcctgatggagggtttatatttgctatgattaagctgaagtaggctaaggtgtcagatttcttactggagtaatacccagcctgggtgacagagtgagaccctgtctcaaaaaaagaaaaagaaattgtcatttaataagaagaggatcactatgaacgaaacaaatttaaacggggagctaggaggtcagtttaggatatgaaaagtttgagatggctgttgatttcctaagtagtgatattgaataggctatgtgctctagatgtctggagttaggagagaggtataagttggagatagaaaatggggcattactatttttttgagacagggtctcactccattacccaggctggagtgcagtggcacaatcttgactcactacaatctccatcccccaggttcaagcagttctcgtgtgtcagccacctgaatagccggaattacaggtgcatgccaccacacccggctaatttttgtatttttagtagagatgggatttccccatgttggccaggctggtcttgaactcctgagctcaagttatccacctgcctctgccttctgaagtgctggcattacaggtgtgtgagccaccgtgcctggccacatggggcgttattagcatattaataacattgatgccatgattagccatatggataatgtttaaagccgtaagactagatgtattactttgttttcacactttataaagaacttccctgagactgggtcatttataaaggaaagaggtttaattgactcacagttttgtatggctggggaggtgtcaggaaatttacaatcatggcagaaagtgaaggggaagcaagcaccttcttcacaaggtgcttcacagaaaagaggagggagaaagagaagagcggggagaggagggaaagagagggacgagaggagaggaggaggagggaggagaggagaggaggggtggttgttcttgcatggcttaagaaggaataggatctggtgggtgagtagcgactggttttagataggagtaagaataatttggacttagtaacagaatgaaaggaagactgtatgggcacagatgcagcttgatatgtagaggtggtggtgagagcttaatttttttttttatgagaaaacttgcatttgcattttcagagatagtttagtagaatactgtcttcaaagcatgttgtggagtggagttgaaagttaaagtggcccttggaaatctgaaaaaataatttgagggctgggcacagtggctcatgcctgtaatcccagcactttgggaggccaaggcgggtggatcacctgaggtcatgacctcaagaccagcctggccaacctggtgaaaccccgtctctactaaaaatacaaaaattagctgggtgtggtggcaggcgcctgtaatcccagctactcaggaggctgaggcaggagaatcacttgaacctggaaggtggaggttgcagtgagctgagatcacgccattgtactccagcctgggcgacagagcaagacttcatctcaaaaaaaaaaaaatgtgattctcatcttatagaatatctgaatatacttattgcataatttgtatgtcaattaagaaagaataatatattttataattgattcaagaaatgaaaaatttcagtgaaaatttccaattcttttgattgtctctctgattctcagggagtcatttaaatgcaatactaagcggaagacaaaattaactccctgtaaaaagcatgtttaccttttaaaaatatttctttggctgggcatggtggctcgtgcctgtaatcccagcattttgggaggccgaggtaggcggatcatctgaggtcaggagtttcagtccagcctggccaacatggtgaaatcctgtctctactaaaaatacaaaaattagctgggcgtggtagcgcgtgcctgtaatcccagctacttgggaggctgaatcaggagaattgcttgaacccgggaggtgaaggttgcagtgacccgagactgcgccactggactctagtctgggtgacagagcgagactcagtatcaaaaaaaaaaatttttttttttttttttttaatgagactgagtctcgctctgtcacccaggctggagtgtagtggcatgatcatgactcactagcctcaacatcccaggctgaagtgatccttccacttcagcctcccaccacgccagctgggaccacaggcatgcaccacttcacccagctagtttttgtattttttgtagagacagggatctcactttgttgcccaggctggtcttgaactcttgggctcaagcaatctctccagcttggcctctcaaagttctgggattacaggcatgagccactgcacctggtggaaaaatctcttaaacctagcacaaattacagaactaggtaacttctgggtgtatcattggataataaacaagattagtcacagcatatggaatatttaaatcacctgggatgaatatcttgctattatattctgatactttaatatctgtgaaagaaattttgactaggtaaactgggatgtttagtctcttaaaaatacagggctttttctgaaaaagtctactttttgtccatattattgtaataacgattgcatatattatatgaattatgtctaaatccaaatctgtcttgtgatggtaatttacgcaggtgtttatatttgaaatatagtttatgatttcttctctgaaaatctgtaagaaaatcatataatcagttctcacaattcagattgtattgtatttatagtaattttcctggtatcagttccaaatcacgtattttaaaatatttcatagtaagcttattaatgacatacttgcttttttttttatcccctttttttgttagcacatcaatcttaactataccagttaagttagtggtggtgttcactgttttaagaatcaagtgatagcagacttagctttaagcattgattgctacattggagtttcctaggttatacttggaagtcactttgtgaaaaggtcatacatcaggaccagggccataatcaactagactttcagaaggggtgtcatagctggaatggacatttgtcttattttgagaaacagttgatctgcgtattttgtcatcagtatctcagcctaaagcagtgcctggtacttagcaggtgctcagtaaatattcattgaaaaaaaaatcaaaattacttcttaattaaattgtggtagttaatttttagatattgttaatgttcagatattttcttctttgtcccgagtttggacttagtgatgggtcttttctttccattgttaataaaagtttattgctgataaaaccaagatattcacaataagttcagtacttatgttcaattaatactatatcatagcaataaaaaacccaaattttgtacaactagctgaagattaacttggatatattttctagggaggctttttctttttgttttttgtttttgatttgtgacacaggatcttgctctgtcacccaggctggagtacagtggcacgatcatggctcactgcagccttggccacctgagctgaagctattcttccgcctcagcctcttaagtagctgtgactgcaggtgtgtactgacatgcctgactaatgttcatgcttttggtggagacaaggtcccactatgttgcccagagtggctttgaactcttggactcaagtaatcctcctgccttgggccttttcaaggtaatttactgactaaagggaaccctgctgaaatgtttttgagaatgattcaattcctgaactttggttcgggaaccgaaatgcttgataaaagattgtgctaggtgcacacaaaacttactagccacagccaactgttaaccttgtgccccattttctcacagtatctggataccagggaagctaatagccttaggatacactgatagaggtgagaggagttgccggtttaaaacttgtatgccaaaggtgcacataacattgttttgagcagcaaggccagggcttggccagatgaaagagtaatctttttaaaggcaaacttgatagatctaccccaccccttcatactcccctccactggaatttaagatccctgagggcagggattttgccaattctgtttactcttctattctaactgattgttttcctattagctagaaggctccctgaggccagataccttgtctctttttgctcacctttatacccccaacacctggcagtatgtggtacatggtaggtggctaaataaataatagttaacagaataaatgactccgtaaggcagtcttggaaggattctgtttgccatatgctttctcctttttggtgtcttattctagcacttacagccaaaacccaaattacttttagttggtacttaatgtctaataccctaacatatatatacacatatatatgcgcatatatatatacacacacacacatatatatacatatatacacacatatataatatatacacatatatacatatatacacatatgtacacatatatacacatatatacacacacatatatatatacacacacacatatatatatatatatatattttttttttttttttttttgagacagagtctcactctgtcaacccaggctggagtgcagtggcatgatcttagctcactgcaacctctgcctcgttggttcaagtgattctcgtgcctcagcctcccaagtagctgggattacaggtgcagctagaatgcctggctaatttttgtatttttaggagcaatggggtttcaccgtgttagccaggctggtctcgaactcctgcctcggcctcccaaagtgttgggattacaggtgcgagccacagtgcccggccttaacctaactatatttctaaaagggtaacttttgaaaataatggtgacatggcaggcaacagctcatgttttgtgatatgaatctgcctattctgcctgtagtatttaatacatagatgttattggagttatcattggagatgcagataaaagagaatatagtggtgtatgtttttgttactcttgcctgcaataagtttgctccccagggagcctcctggtgatatacttttaaccttttgacacagaagaaatgaaaaattagtgtagtagctttgaaaagccacgattgccttctgtggattacatggtgcttctgtggattacttctacacattactatagtgtttgcattaaaaatacattatcaattgtcaattaagtactaaaagtaagataattttcagttgatgatggggaattatctctcttagaataactaagaatttccaagatttaaaatttccttaaccccaataattcttattatttttttcttttagtatttgtgcaaagtatatgtagttagaaagttagaatgtgtttaagacttctagtacaatagcactgggaattgagactgtcttaaaaatttcccttatagtgagtgagtatctttttaagtactcttcatatgcaaacatgtttagttagaatgaatattgaccacatggattttctgaaagatttttctgggaacagatattaacatatctgaaagaattttgtcatctttggtggggtgaataaatcagacttcattaatgaaggataatttgtatttaaatatttaggattccaaaaacaattaaatgaagacattaaaaaaagaggtttattctagtgaaaaccttgcactagatacaaagtaatacttaatttaagcctgggcaacatggcaaaacctcttctctactaaaaatacaaaaaaattagctggatgtggtggcacatgcttgtagttcccagccatttgtgaggctgaggcatgagaattgcttgaacctgggaggcagaggttgcagtgagctgagatcatgccactgcactccagcctgggcaacagagcaagactctgtctcaaaaaaaaaaaaaaaattaatagaagggggaagtgagtgtccatggcttcttccaggcagaagtacatcattatcacatagaataagacatgttcagattgttgggaacaagcgccccaaaatctggccataaactggcaccaaaactggccataaacaaaatctctgcagcactgtgacatgttcatgatggccataacgcccatgctggaaggttgtgggtttactggaatgagggcaaggaacacctggcccgcccagggcggaaaactgcttaaagacattcttaagccacaaacaatagcatgagtgagctgtgccttaaggacatgttcctgctgcagataactagccagacccacccctttatttaggcccatcctatacttttagttaatctaatgtctgtagaaacaatgctaatgactggcttgctgttaataaatacgtgggtaaatgtctgttcggggctctcagctctgaaggctgtgagacccttgatttcccacttcacacctctatatttctgtgtgtgtgtgtgtctttaattcctctagtgccactgggttagggtctcctgacagagctggtctcagcacagataaaaaactgaactgggccacagtcatttgggcagtgactgtctttgatgacagtgctcagcgtggctgtctcttggatcatattgttccaatctggactgggagtttgcctctgtatagagttctaggttagaattaattttcctccagaattttaaaaacattgttttatttacttactgctttgagtgttgttgaagccattgtgattaatgatccttagaaggacctgttcttttttcttcttttctcactaatctctctggaaatatgtagcacattttatttatttctggtgttctgaaatttgacagtggtgtctctgtgtgtctgttttctagtacactgttgaggactccatggaaattttgactagactctagaaaatcatgtcttttggttctggtatattttctttggatatttcaaagccttcttcctctctctttggggagtgggcatgtggagggatttttttttcctggtattttgatgctggattatttttactagtctcatattcacattttattttcctttttatcttttccccctattttctattgttacaggaaaggggtcctgatccagaccccaagagagagggttcttggatctcacacaagaaagaatttcagacgagtccataaagtgaaaggaagtttatttagaaagtaaaggaataaagaatagctcctccacagacagagcagccccaaaggctgctggctgcccatttttatgtttatttcttgattatactaccagagatctctcttgttgccatcttggttttgatgggttttagccagcttctttactgcagcccgttttatcagcagggtctttatgacctgtgtcttctgctgacctcctctctcatcctgtgacttagaatgccttaaatgtctacaaaccagtaggttttagccttattttacccacctcctattcaagatggagttgctctggttcacatgcctctgacgctcttccattttatcttaactctgaaaggttgcctcgtctttatcttctatagcttctagtgaatatttcatttctattattatgttgttaaagaaaaattattctaacacttgttaaaacagcaaggaatactttattcaaggactcttgtggtaggggtggtattagtctgctagaagtgtagactgctcaggctgccgtaataaaataccacaaacgtttgtattctgacacagaaatttagttttttcacagttttgtaacctggatatctgacgtcagtgtgtcaccgtggttgggttctgataagagcacttttcctggcttatagatggcagccttttctctgtgtgttcccttggcctttccatggtgcatgtactcggacagagatctatttctctctcttcctcttattatatggccaccaatcctatctgattagaaccctacccttctgacctcatttaatcttaattacctcctgaaagccctgtctccaaatacagagacattgagggttaaggcttaaacatatgaatttggggggaacaaaattcagtccatagcagtactttcagttcatatgaaggggtattgcagtaggtgggagagatgggcctcaactcctgaatatggcagagacagctggggattgtgaacccagaatatctaagacaggtctcaaccaatttagaaagtttattttgaaaccaatttagaaaggttaaggatgcacctgtgactcagccacaggaggttctgaggacatgtacccaaggtggtcagggcacaacttggttttatatgttttaggtagacatgagacatcaattaatttctgtaagatgtacattagtttcatctggaaaggtgggtaaactcaaggcagggggaggggacttccaaatcataggtagataagagacaaactattgcattcttttgagtctctgattagcctttcacagaatacacaatttacaggtgagaggagggtagaggaaataatcttatgccctagtctggcttagtgaaacaatatggcagaagaagcaatgagatatgcgtttgtctcacatgagcctcagcgagatgactgagttctggctgtccttcatccacaaggaatttccatgtgggcaaattgtgagggaggcatgtaactttttaaaaaatgtttgtagctatcttgtttaggaataaaatgggaggcaggcctgcctgacatagtccccagcttgactttttccttggcttagtgatgttggggttccgagatttttttcctttcacaggatttacagccaaggaacagagcgagtggatcagtggatggaaaattattcatggagacatcaagggcatggaaagtcttgccatactgacttaacaggatttttgctgaaggcaggtcaaggacttagagtgttaatggaaaaagcaaactgtaaaatatttaaagaggtttattcagagccaatatgaacgactatggcccgatgaacagtctcaagaagtcctgagaaagtgtgtgtgaggtggttgggttataatttggttttatacattttaggaaggcaggaattacaggcgaagacataatacgtggaaggtatatattgattctgtctctgcctgaaaactgggaaatctcgaagtgggggggtggtggaatggggagcttatgggtcataggtggattcaaagattttctgattggccgttgaaagagttaagctttgtctaaagactggaagtcagtagaaagaaatgctcgaggtaagataagggggatgtcagcccggcgtgctggctgaggcttgtaatcccagcactttgggaggccgagccaggtggatcacttgaggtcaggagttcaagaccagtctggctaacatgatgaaaccttgtctctgctaaaaaaaaaaaaaaaacaaaaaaaaaagcaaaaattagctgggcgttgtggcaggtgcctgtagtcctagctcctgtagaggctgaggcaggagaattgcttgaaccctggaggcggaggtttcagtgagcccagattgccccattgccctccagcttgggcaacaaagtgagactctgtctcaaaaaaaaaaaaaaaaaaagatccatagatgttgaggttcttgttatgtagagaagcttcataggtagcaggctacagagagaatgatggtaaatgtctcttttcagaccttaaaagatgtcagacttaggtaatctcgcccagatccatcctggaaatgcctggctgcattaattactatgaaattctctacagatgcaaatttcctccacaaaagacagctttgcagggccatttcaaaatatgtcaaagaaatatattgtggagtaaaatatttgattctcttcagggtctgatatctggcatgtgatgctgtaccagagtcaggttgaaatgtgtcttattgctgcaaagaatctgttttgtcagtcttatgatctctattttaatgttattatttgtcagttgtgcctaaattccaaaagggaggggggtataatgaggcatgtctgacctcccttcctgtcttggctgggaattcagtttttcaagttcctctgggtttcccccatccaagagggatccccattcagttggttaggggcttaggattttatttttggtttatgacatgaaaggtgggggatgggaactggatcaagtatcaggggtcggggagtctatctaaattgatttagcaggattcttgctaaaactgggctgtgcaggcctgtcaagagatagaacggagttaaggccaaggttgaggcctagcctagttgaggagaggcctcagaggagcctaattaaagttggttggtcaaggagagagtcttggccaggtgcagtggcttatgcctgtaatcccggttactcagaaggctgaggtgggaggattgcctgagcccaggagttcgaggctgcagtgacctatgattgtgccattgcactccagcctgggtgaaaaagtgagaccctatctcctaagcagttttgttttttttttggcatacccataattgtttttggtgtttctcattccagagtcttctccagagaacaggttctagacttctcttggtgggggtggtggggattggggtaggggggcagtttttccatcaatatggagtttgtgtggttggtgtgaggaaatctctctcagaaaactttcacctagttttccttattttagatttcttttcacccttgttctggaaccttgtactgaatttcttgtatcttttgaggattctgtagtataatttgggttggttttcatattttcgaattcatgccttgaaattcagctctcttgtggttgctgttggttgcctctcaaccatttgctttccaaattagaaaatgcttctgttttctcctttttgcttctctccatcctcatgggctgatgtgtttgtaaagaatccctgtactgtagataaagggctttgatgaaggagcaatgttagctgtgtgtgtgcctttaaatttgttaccttaactgggaagtcatagttaacagttgaaaataggaaagtagttcgaagtttaatttgccattcttttttggactttgggagttttgctttgctgtgatttttcttttcttttttttcactgtcacaaattttacacacagtgatttcaggtaatttttcctaaatgatccctcctgtctattctgtaatttctgtttgtatttaaaattaccacaactattgtcttgaaactgactggtggcttcaaacaagggatatagtggggaaggaaaagagaaagggggaggggtatgcctagtatcttttgggtgccagtagaacagtgatctcagttttatgtcacttaatcctcacagcagttctgaaaggtaagtgatatcccaccatatggataaggacaaagataaaaatcgaagaggttaaataacttacttaagagcttgttagaaagtggtggagctgagtttcaagcctaggtttttttttctgttttttgttttttgtttttccagagacaaggtcttactctgtctcccaggctggagtgcagtggcacaatgatagcttactgcaactttgaactcctggattcaagtcatcctcctgcctcagcctcctgagtagccagaactacagggctatgccatcattcctggctaatgtttaaaatttttgatttttgtagaggtggagtcttgctgtgttgttcaggctggtcttgagctcctaggatcaagtgatcctcccacttcggcttctcaaagtgctttttttaaaaattaaattttttttgtgtgtgttgatacatagtaggtgtgtatattatggggtacatgagatattttgatacaggcgtacagtgtgccataatcacattggggtaaatgaagtacccagcaactcaaggatttattctttctttgtaccacaacgatccaagtatactattttagttatttttaaatgacagtaagttactattgactgtagtcaccctcttgtgctatcaagtactagattttattaattctaactatatttttgtacccattaaccatccctactccccaccccactaccttcccagcctcaggtatcattctactccctatcttcatgagttcaattgtttcagttttttttttagctcccacagatacgtgagaacatgtgaagttttcctttctttgtctgatgtgtttcatttaatgtaatgacctccagttccatccatgttgttgtaaatgacaggatctttctttttcatggctgaataatactccactgtatatatgcaccatgttgtctttatccattcttctgttcatgggcacttgggttgcttccagatcttggctactgagtatagtgctgcagtaaaaatgggagtgcagttatctcttcaatatactgattcctttctcttgagttcctagcagtgggattgctggatcatatggtcattatatttttagttttttaaggaacctgcaaactgttctccatagtagttatattaaatggttttacaattatagttttagaatattctgtgtacttactattaccagtgagttttgtaccttcagatgatttcttcttgttcattaagcccttttcttttggattgatgccacctgggaggcagggcctggaatcaagaaccttagaaatctatctgctgctgtattctgaagctgagctggcacccaagccacagatcaagttcttcccactcttttctcctctttcctcaagcaaagagtctctctgcatggccaccaccatcccaagcccatggcaagtacagcctggctactgccgatgttcactcaaggcccaagagttctccagtcagttcgtggtggatgctgccagtgctgaatctcctgctttagaacagtgggctcccctttggcccagggcacatccagaaatgccatccaagagtcaaggccggggatcagggaccccaggagcccgcttggtgctcgttaacccactctggctgagctggtacccaggctgccagacaaagtcccccttactcttccctttcctttccttattcagaggcagtctctccccatggccaccacagctgggaatgtgctgggtcatacctgaagccagcatagctctcagtctcacctgtgacccgtggtgagtattgcctggctaccactgctgactgttcaggccccaggggctctttagtcagcaggtgatgaattctgctgggactgggttcttccccccaaatcagtgagttatcttctgcctaggatgtgtttagaaatgcccaggagctagggcctggaatgggggcctcaggacctgccctgttctctattctactgggactgaattggttggtatccaggttgcaagacaaagtcccctttacccttccctcttcgcctctcaaacggagggaaggagtctttaatagagctgtgagttgcactcctggccgcccagctggtgttctcactaggtcacatgctccccaaacccggtggctctgagcctatcatagcaccaggacttgcccagaaaatgcagtccttgtggtctagactgcttttcaagtttatttaggaccccagaacaatttagcctgcagtggggcttgctgagatgaactatttgcctctggctagggcttctgtaaatgctctgtttgtgatctctccctcccacaagcctgtagattctctcaccataccaccattgctgctgccaaggggtggggagagagagggtggtgctgagagttgaagactggttttgctcccctctccagtgcctctttctttgatgtgatgttaaaaccagggactggttttaactggtacattgctcacctgattttttgttcttatgaagatgctttttttgggtggatagttgttcaatttggtgttcctgaaggggaagtgattgctggagccttctattaagccatcttgctctgtctccttaccctaaagtgttttgattacaagtgtgagccaccgttcctggctgagcgtaggatttgaagatatttcaggatgagcacagtggctcacgcctgtaatcccagcactttgtatggttgaggcaggttgattgcttgagcccaggagttcgagacctgcctgggcaacacagtgagaccctgtatataaaaaaataaaaattacaaaaattacctgcatgcacctgatggtcccagctacttgggaggctgaaataggagaatgtcttgaacgtgggaggtcaaggttgcagtgagccatgattgcatcactgtgccactgcactatggcctgggtgatagaaagacccagtctcaaaaaaaaaaaaaaaagatatttcaattcttctaagtctacacctgcttttactcttccaaaactgtgtgaacaattcattcatttaccagtgaatattgagttgcttactgtgtgctgggccttagggacacagagaggagtagtccaagtcctgatgaaacagaaatgaaatgattagatttaccttttggtaggattaccagtgatatgtgtgaagtggcacgagtagaagcaggcagctgagttaattacagaagtcctggtaaaagatgatgttcatttgaactaagacggtagaggagatgcagagaaggagttggatttgtgatccctattggaggtaaagctgacaacattaaggaagtgatatgaatttggaaggagctcaagggattggggatgatttcgggtttgatttgaaggagtgctgttagtgccttcactgatactaaggaagagcaagctggagtggtagaccatggcaataataacataataattatgttacacctattagatacattcatgaagaggtgtccagtagacaagtaaacatctgggaactcagtggaggtttcggctagagcaacaactttgagcatcactcatacataaatggtatttaaagccatgggactagatatgattagggaaagagtatagatgtatgtgtggtaatataagtctgaagtagtggtattgattcacttctatgaagactcttcatctaatttgtcaacttggaattgtacataaacctgatagcgtttgctggatagggaaagcaactcactttgtagccactgcatagacgacatcaaccaacaagcaagttgcaaacatgccaatagttagctgcttttgaatgaactgtatgccaaacgtccttgactttcatgaaactacacctgagagcatccacatgaggatccacatttgagaatgccacacaaaaggaggattatggcacatgaatcagcttttctttttaaatatagataagtagtgaaaaaataagtgcctgtcaagatgacatctgggatcatttaccagatgatccattgttacattttagtctcatagcatccaggctcattaaaacaaaatattttgcatgtcacggattgttttggctactctttagagacagatatgaatgttaaatctcagaatgctaagtatgaaagaaaccatacaggggtaatggaaaaattaggttagaattcaccttaggcaaaaactgtaaacaatccaaatattcatcaacagagcaataggtgaacaactgtggtatagtcattcattggactagtacgcactacaaggttaaatatgttgaaagcaaaaacagtttgttgaatgaaagaagacagacatgaaagaatacatactgtatgatgtcacttatatgaagttcaggaataggcagaaactaacagaacagtaggaatgcccatggggaatggttattgaccaaaaggagtcatgagacaactgttttgttttagaaacagggtcttgttctgtcacccagaatggattgcagtgatacagtcatagctcactgtagcctcaagcagtcctcctgcctcggcctctcaaagtgttggcattctaggcgtaagctaccactcatgaccttgattggagtgtttcataaatggctatatccatttgtccatattcgtcaacttgtatacttagatttgtacatttcactgtatgtcagttttacctcagtggaaaataagaaaacaacaaaaatggcatactgagtagttccgtgaggatgagcttcgggagcacatcagtccattctcagagagtgagggaaagtttcccagagataataatctctctttttatccttttacttccacagttgatttatttttttcaactcttagctacctccccacaataatatctattcctatgactatttaatttattgtgcaaatgcagaatactttagggagcaaaaaggagtgctggtataaattacactcaactggtaaaaactatcattgtttgcttctgttctagtcagagggttgtactctactgcagtcatacctgaaggaaggcagtagtagagcaggtgtacctgagggtggaacaacctctgcttggcctcatctaaaagtagataaagggggccgggcacggtggctcacgcctgtaatcccagcactttgggaggccgaggcaggcggatcacgaggtcaggagatcgagaccatcctggctaacacggtgaaatcccatctctactaaaaatacaaaaaattagctgggtgtggtggcagatgcctgtaatcccagctactcgggaggctgaggcaggagaatggcgtgatcctgggaggcggagcttgcagtgagccaggattgtgccaccgcactccagcctgggtgagagagtgagattccgtctcaaaaaaaaaaaaaaaaaagtagataaagggggcagagttcagcaagaggcaagggaggaggtggggattttatgtggcatgggcagatgtgtttgttagttgggacttacatgtgaacttttgaaaaagatacattatttgttttatatatatttcaaaactgattcatgttgctgtatttgttcctttgaaacaggtgacagtggatagtggaaacaggagatcgtggatcctccttcaaaaatggaggatggaaagcccgtttgggcgccacaccctacagatggatttcagatgggcaatattgtggatattggccccgacagcttaacaattgaacccttgaatcagaaaggcaaggtgagtttctcagaaagatgttgaaatatgatttctttcaaaaataggtgttttttttcacaagagtaaggtctgtcttcttaatgaggtagatatttgggaaagcatatttctggtaagtgagtctgttttctcctgacttctttgattaaatcagaggtatgtgccctagggaaaaaatggtgccctatgataaaatcagatggaaatttagtgagcctttcattctttgtttttttcacatccctttgatcatccagttcttagcctttcattcttaagaactagctgtatgataaaatctaaacaataatgacattttaatttcttgtgccacattactaaagttattagtgtgtctgtgatcgacatgtcacaaagtaaaaatatgaaaagtgaatgtggagatatcagattttgcttttttgccttagcttctattataaagtctttttttaaagttttttgttcacttaaaattattgctatcatttttgtaatagatgctttaattctgtacacatggtatttatttctttgcatgcttagacataaactagacagcattacaaaatgaaagtctgagggaaaagtgactaggagttgtgactcgtttacagagaaggcatcattgtaaatacctgtttcagtcttcatggagactgatacagtctgtttttgtggaacttcactccattctcagagagtgaggggaagttttccagaggaaataatctctttttattcttttggttccacaattggtttatttttcaactcttagctctcttagcacagtaatatcttattcccatgatagatgtccacaatttttagtttaataagtatgcctgttaaacagttcttctgactaaattaaattttgtaggtgtcatttctgtttactttagactgaaaatgttcatgaataatttatattctatgatacatggctaactaatgccatatgactaccatccttctgggaaccttagaaaaacaaggtggatctctcatgaggtcttttcacagagaaaactattctgttactgtaaacaacccagggactgaaatgcataatgtataatgtgccatgttagaggaggccagttaaagataccctcaggacaggaaagacaaagtgtttctggtttttcctcttattagcaggtacctatttgtacttaaaattcagtacatgtttaaaaaaaaaagctcagttactttacatatttgaaggcttttgatttttgtttaacatattttataagcacagtaaatcagaagaccaaaatgaaattgagagtgtatttcctaggtgtttatatatagttgttatgtatattttgttgtattcacaggtgacaaaacaattcagttcaattatagaagaaacttgatttaagtggatatactttttcatattttaaatattttaatatgctttacactcttattcaggtacatatgtagaaccaataaaaactgtttacattagggagtgatataaatttcatggatctgtagataattctgtgaactaaagtgtacgttttttccacaaagttttttttgaggattaacaagttctcagagattacctttaatcttaattttcctccctactttctgatcaggttcttaataaacatactgctgtaataaccagacagttaaaaagatccttaagagaagcaatcttttgcttagctcattcattgcctagagataatcagcttcaaaataattattaaggaattaagtacataaaggggtggactggtcatgcacacctttgtgcagtgtgtgcgcagtggaagtacagtggaagtgtagatgagggagtgaggaacatgtcttgatagcaatggcttttcaaggtttttgtttgtgacccatagtaaaatagatttcacattgcattagctatgtgtatttatgtgtgtgaatttataagaaataaattttacatttcaacaactgtgtgtgtagtgtttgtgtgtgtttacttataaatgaaacagttgatcaaaagaaacattcttagcacatgctatgcattttgataatttctaataacttttattcttttaaaaatgctgttttaggctagctgcagtggctcatgcctgtaatcctagaactttgggagtccaaggagggaggattgcttgagctcaggaatttgagactagcctgggcgacatagtgagacctcatctctacaaaaaatttaaaaaattagctgggtgtggtggtacatgcctgttttagctactctggtggctgaagtgcacttaagccagcaggtcaaggctgcagtgagctgtgattgtgccactgcactctagcctgggtgacagagtgagatcctgtctcaaaaaaaaagaaagctattttaatccactaaattggtttcatattctgtatttgcagcagtggtaagaagccgctctgaagccttgtaggctgaagccctaaatttatggcatagaagggtctgcattttcttttccctgtctgctttgctggtcttctgttgtgtcaaccaagtctccccttcatactcttactcttgtgtgcctctttctccttctcttctgcaagtattaagtccttaccataccccaggtgatgttatgtgctttgtgtcattgctaacattgctcctgcctggagtgccactatccatacctgctctttattttatttatttatttttgagttggagttttgctattgtcgcccaggctggagtgcagtggcataatcttggctcactgcaacctctgcctcccgggtttgggcgattctcctgcctcagcctcccgagtagctgggattacaggtgcccaccaccatgtctggctaatttgttgtatttttagtagagatggggtttcatcatgttggccaggtttttctcaaactcctgacctcaggtgatccacctgcctggggctcccaaagtacagggactacaggtgtgagccaccgcacctggccaatctccatatccttttgcttagaaactacttatttttcttttaagactctgattgaggtcaccttgtttatgaagtttttctacagatacccaatctctccctcccccccattcagtagaattgactgttgactactttttcctttgaggagtggtataaattcttagctttcctttactctttgttggagataattgtttactttgtctctccctccctactagactatgtaatcttctcaagtgcaggggctattttattctgtcattagagcttgatgctctgtatttgacttgtggtaggtgtttaatgctgagtgatcaagatatgtttttagcagaaaaaagcctccttcttctaagagaaaacaattaatgaaacattttaaggagagaggaagatggggtggtgataatttaaagaataaagaaggagggagagaaaacacctttcaggactccttactggccttttagcctgctcttaactttctcattccagcaactctttgtcattggcctcccctcatccccactcccctcatcatctaacttcttggaacctttttaatttgacatggctcctaccaggcagagctaaaccctgaagtctggggagcccgtaaccctcttgccatggctgtgaaagttgggcacatacatatatgacattagcagttatttctgaatgcattttcctatagaatcattattataaattgtggcttgttttatattaccattaatatacttaatgcacatgatgggttaattttgcttttgtggcctgtcctacaaacttctccacatttataacattaacaacatgtgtactgggttccaagtaattaacttccagagtttctatggcataacagttttctacattgggtgtgacttagaattgaggtagtcccagcagcgtggattttactcattatagttgtagctttacacacacacacacaaacacacacacacacacccctataaatattattttaaaataattgaaccatttttccctgcagttttctttgatacaattagaaacttcagccacaagagtaattgtcattgtttgagaagtactgtatcagcttataaataactgtgagaatggcatggattaaaatttaattctctttggatgtcatttgagatcatttgttctctcttatgagatgttatcttaattctgcagtgttactctagcatttaagtgataaaataaatataagtattcatggatacttgtaattttacagacgaaatattttttggtattttttatatttctgacagatttttgtacaggagtttgtgtcaaatatattttactgaaacaatagctattaatataaccctctggttatctgattgaatgttatttttttctgtcttttttttttgagatggaatttttttctgtcttttttttttgagatggaatttcactcttgtcttccagggtggagtgcaatggcatgatctcggctcactgcatcctccacctcctgggttcaagggattctcctgcctcagcctccccagtagctgggattacaggggtgctgcatcacgcctggctaatttttgtatttttagtagagacggagttctaccatgttggccaggctagtttcaaactcctgacctcggatgatccacccgcctcggcctcccaaagtgttgggattataggcatgagccactgtgcccggttactttttccttttttaaaacactgaaattgctgtatctaccacattaacattttatttaaaaaaatttgttaaatagcatatgtatgtaaatttaatattaatatacctctttttttgtccttctttaggtgttggagcctaggatacttacttactgatttttattgttgatttcatgtccacagtaatagtagataatatttttgagtaaagttattgttctgttttggggttaatgacttgttaaatagtattatctgtattatattttaataaagagcatattgttgccactattacagtgtatgcaaccaattaagcccttctattgttcttactatttaaaagccttgagtttaatgagcatttgttttgcttgttagacatttttggctctcataaaccaagtgtttcctgcagaagaggacagtaaaaaagatgtggaagataactgtaagtaccaagttaaaaattaactctccgcacagaaaaggagactgttcttttaaaaaaataaattagtggttatataactgatacactgtgcgggttcagaaacaatctagtcttttgacatgaatattcatgtgaatgaaggaactcgagtcctccatgttgtctcacatttgcattttggtgaaagagtcttgagtgttcttttggtgttatttgagttgcataaatgtggggaatggtaattactgtaaggcttgaactaaaagtctcttgttaacagttttgaaagttattgaaccttatttagagtcaggtggtttttattgtagtatatgtggttcagtaatttggaagttgagtcagtaggagtcatttaacatcaccgtttgaagcaaacatgcatttaaaaaaattctatataattactaattgaaaaattaatttcagaacaattatattaaaacacagcattaatttgacttataacatctttgcatgtttgatgaaaaaagctcttctcgatggaacaggccaatgtttattcttacatttttaagattaagcagtaatcatttcatattgggggcagcagtgttaacaattatgtacacttgtcatggatttcattaaaggtacttgacactaacaactctccatttaacaaaaaaaggtagtgttaacaattatgtacagttgtcaaggtacctaatactaaaaactctccatttgagaagaaaaggtaagagaaaggaatagatgtgttattattgattttctctggaattcacatttgagtaagactataaaacccccatatgtagaatggtggcagcatagactagtgggagtaatggggagccatggactgtaactgtagagttaggcaagcctaaattctgattctatgttgttaggaggctgtctgctcgtgggcatttcgtctctcttctgaaattctcatctgtagaatggaagtaatgtgtatgttgtatgattagagatgatataaagtgctttgcacagcatctaatgactcttaataaatggtagctgtttttattaggtgcaagagattgaggaaaaaaatgtagaattcccttcctttccaaaattgctggagagtttgtctgattaaataatacatttttgaatagcaatcagaataaaataataaggaatgagactgtaccatatctaaaatacaaatttttgtgctgttaaaacttgctagggtgtgcagaactgggaatcaatccttttcatttattaatgtgtatgtctctaaatgtgacaaatggttttgaatagtttttaatccatttcttaaattaatattttaaaacattctctctccatttgctttgtcttgctatgcttgtctaacttacaaatttttgcaacctcagtatttgctgcctctggcaggtggtttccttggtgatgccagatggcagcagtgttaatgtgtgggtgttaactattctcataagatagtagcccatccctactgaagacacttttctgaaaccacattattaacacaactttggttgttgagtttagaatgtagggtttccagctgcagtggttctgtcacttagtactttcatctgaggcatgccaccataccactgtcctctgctgaatgacacactgtaacacaaagctatagtggtagctttgtgttatacacttgcacacacacacacatgcacacacacacagggtctcacatgcatatttctaaaattcttttcttctttatattatggtaatgtgaagattaaatgattgatgcctgtagagagtgttctgaagtatgtgttgaaggttctactgaaacagaagtagtgccttaacagtgccttaacagtgtagcaacacttattacctacttttcggtctaaatttttttttttttttttgagacagtctcgctctgtcacccagactggagtgcagtggtgtgatctcagctcactgcaaccttcgcctcccgggttccagcaattcttctgcttcagccttctgagtagctgtgactacacgtgtgcaccaccatgtccagctaatttttgtatttttagtagagattgggttcactatgttggccaggttggtctcaaactcctgacctcagatgatctgcctgccttgggctcccaaagtgctgggattataggcgtaagccactgcaccgagctatagctctgagttttctatgtgaagggttttatatgtagaaattagtatgttaattttgctgtttgactgttgcttattgtcacaagaataggaaaattgggcgtgtgaagtcagtaattaaaaggaaaataatagcatttttccatgctgattttgagctaccatgactttcatggcacataatgttcttcgtgaattattgtctattagatgttgataataataaagtatagagtataaaattggaaagaaaccgggcgcagtggcccactcctgtaatcccagcactttgggaagctgagatgggtggatcacctgaggtcaggactttgagaccagcctggccaacatggtgaaaccctgtctctactaaaagtacaaaaattagttgagcatggtggtgggcgccggtaatcccaactacttgggaggccgaggcaggagactcccttgaacccaggaggcggagattgcagtgagccgagatcacgctgttgcactacagcctgggtgacaagagtgaagctctgtctctaaataataaataaataaaattggaaagaattctaaaagttgcctcagtctctttttctgtaatggaatgacttctacaacaacatatatttagaattgattgacttctgtgttgaagttgtttgtgggttctttttttcttttagtgagccagagctgtaatgattaaacaggatcttaaatgctcagataactctctagtcagatatctaaatttaataatgaagtcatacctaatcttcattagaaacttttgtatatgttatatatttatttattaaaacagtgtttataaagaaactaattgtttattcaaatattttgttatatgtcttatgttaaattgtttcaaaattttaatattcttttgggtatagttaaatctgttaataattaggcataaaaggtaaacagtttacataaagagttgcatgtaaatagccaagccaagtaatcctaggactgactactaggaaaggacaggaggaaggaattatttggtagagcaggaagttatttgtgaggcccttgtggacatacctaggtcatacctttagggagatgtaggcagttgggacttagcatttcacattctggcaagacagggttgcaaatattttcctctccctctctctttttctgtgtcttcttgaaaatggaatggcctgtgtggcatgatttcagaggaataccctcctgtccaaattcttattgtcatcagcagatacttcatcagttaggaatttatttggtttaataaacacacatccctgaaaaggtaggtggtgagtgtggaaggagtaaagataggagagcaagtagtaattcccatgtctgtgtaggcttatatgattagcgttcacaggggaagcgtactgtaggattacgagtttttacttagaggaagcagtgacaacatcatgcaaccaggtatttcagaggaaagtgagagagatggggagtggttcaacagagtgctttgggtaaagaaagaggaacgtgtagaccaggctccaggggacaaggatggaagattagggatatagaaaggtaggtgacctcatacccaaaccagatatattaatacctctgctgcctaaccctctctatatccttccttaattcaaaggaaagctgccattcagctgttaggagcctctacccacttcttactctcttttattctgccctaagtggcactagaaagcagtgaggtgactgaggcaggagaatcgcttgaacccaggaggtggaggttacagtgagctgagatcgtgccactgcactccagccttggcaacagagtgagattttgtctcaaaaaaagaaaaaaaaaagcagtgaggtgaaagtgaactggctgcattaaatgattatagatggatgggcagtctgtggaggtagttatggcaagaggctcttgtttgacaccattggttaggtgttgaatagtatgttagacatacatgcagtgtaggcacatgagcagtttcaatgagggatcaaacaaatgaatcaggcagcatcttgcccccaaggatctgatttagtagacaaaaccagatatgtaaaattatcataataacactggcagtgtgtggtaagaaccataaagaaattgcaaagatagtagttgtagtggtggtggtgagaatgggtaagtgtcatttgtagggtaacctttgtactgaccttaaagagtaggtaggtttttgacacctagaaatgtagaggatattctacatggaagccgatagatgaatgatacctgcatctaataaatagttcagtctgtctatgagttagtattaaggtgaattgtggaaaattatatgaaaaggtcatgaatgtaggtttattaagagctctgatcagacatgaatttggatgttgatagagacccagtgatgattttatggggagagagatttgatgagggctctactttagttaatgtgctgagaagtctggattagagaggagagagactgaggcaataggtaaataagaggctaccatgatcacaaaagaggtaatgagaactaaactggtattggagcagtagaaatggaaagaaaggagataggttgagagattcagattatgctttgagtacctgccatgagctggcactgtgctgtactttcttacatggcataaagatttggaaactggtttagaataaggagggagagagaagatgattttagtgttgactaaggtttacaatttcagtgacagagaaaatggtggtgctaataacagaaacaaggtggttgagaagaggagtggtttttgtctactctagcaaggcatagaaatggagctcaggagattgaaggacttggagaatagattgggagtcagttctgacacttcagtagagcagatgtcacacaaacaagatttatctgttcaaactctcccattaattagcttcatattctcagttaagacatacataatttctctaggagtcttcattatgtcagttgtgaaggactccctgaatgatttgatggtctgttcccattctaaaattttatcttttgtgttttatctgtgaaattctgagtatcagattggattggtgtcatcactttgttgtgtcagaagtatattaaaatcagagctatctattgtagtacttttttccctcttgaattgtgctttttaatcaaccttcattaatgagtactcactaggtttactcttttagttgaaaattcattacttaaaaatatcactgtaacacacatgtaaactgaatcgcttttaaatcagcttctagggtttacatcagccagggttttaaaaaagatggagttaaatgtaacctaacaattgatttttaggatgagtcaaagtgattcagattaagatagtattgctttattttatttgttttcttcaattctctaatgacatataaattttatgtcttaggttcactaatgtatttaaatgaagccacactgctccataatatcaaagttcgatatagtaaagacagaatttatgtaagtattttacctgtagtgtaagtttttgtggagataattatttcatgtggtactctttgattttgtcacgcttgaaattgtctaacagaaaatcatgcttgatctgagcctcttgaatagagtgtgaggttagtgaggacaaagatttttttctaatttacaactcgaactctaggagttaaagcatgcctggtacacagaaagcacttaatcagtatttgtgggatgaaataatgaattcagagtgtcgtttaatatcttttggacttaaaaatgtccagtttgagtatttttaaaagcactgtaatggtttttggttttgatttttgacttctggtatgtctgtagatatgtttgattcactttccacattgtttggaagacaatgtaaggcagcctataaggaatgtatattgaaattaaaaatttgaatgaggaaaaaaatgtaaatcagaataggaggtagtatctgaggaaatactaagaacacaggaatgctgaccatagagcctaaatagttgctgaatttcattagaccgtaggtactctaccttgaaagtccagaatattcaaaaatgaaagaaaatgctttcagtgtaaatagtcaaggtttacaccaaatcattcagatggatacttaacctagtatgttttaattataattattctttgggcatgcatgagactttattccagtatcacctaactgtgtagtcctttggtgactggagataaattaccccactgtagttctcctgttataaagatggggctgttcattatttttgaacgaagaaaacacatggcttctttgacacttactagatcaaatgacagtcttaatctattatatcactatcagtttgcctaattgtacttacttaattctgactaaattacatttagtctctgccatctgtccaagtagtgacagctgggagatagaacttatttattctattccaaaagagtatacttgccatcttctagttatatgtagttttaagacttttctccctgattttttcaaaatcaactaaataaagaacatatttaagtttaaatgtggctattcttgattagaaatatatttagaggcaaaatttactcaatcagctgactcatgttgagtatctaatatgtgctaaattccaaaattaaaagcaagcttaagttgctcattaaacatttaacccataaatgttctaggcaatggttaacatatattgtttggaagaaatctgggaccaaatggtcactacagagctaaatcaatccttggcattcagtgatagggatgggcccagaaggtgctacgagctgtattaaactccttagtagcagggtgaatacagtaggtaaggaatacaaatgactaaaacttagcggtaggagatttcataagtagagtcaacaggagaaggctgaatgagatagagctagagactcagatttctgtctgtggtgacttggtggtgatgccatgtccctgaggaagcacatggaaggataatattttctttgaggcagaggtaggtgggaagagataatcttgagtttggatatgccgaactaaaggtgcctatgggttggtaagatacaaatatttattaagaattggagaaatatgggtccctataaagatcagggaatactcagggaatatttaggactgatttgggagtcttagttatatagataattgaaattttttgtattttattttttctatgagctttgtttatctttaaatgaaaatagtaattggaatattttatgtttatgcttttcgtatttagacatatgtcgccaacattctgattgcagtgaatccatactttgacatacctaaaatatattcttcagaagcaataaagtcatatcaaggaaaatctcttgggacaagaccacctcatgtctttgcaattggtaagtgattttaaatgtattttaattcttgtctttctttatattgtacaaatttactcaatttttcttttggattaataaaagataccataaattgaatatatattttggagaaactgtatacctcttggatatatcaacattgttaggagcaagtattttacacagggtgaggaagaatacttttgtagtcaactaatggggcaggcttaccatacatcattatctgtgttaaatgcctgtgtcctctaagagatgtctgcccaggtgaaagcaggatataataaaagctgacctaatggtacttttagactttttaataccatcagctccatcttaaaattgtcctccttcacaattttgaggttctggccttcatctcttacccagctcatcccttatgagtgtgttacttgggctagatttcagctgtaagagcagacttctgggcatcatcttgcatcaggggtttataaaattaaaggattaaaagtagtatatgcttcataccactggagaatctatgtgggaagacagtagtgtctctttgcctttctcagcctcttttattttgaagtcctccagctctgagtcatagaggttggaggttttagatcagaatgagcaattacccctcttcccaccaaatgcggaggtgttagctaaccctttgcattcagacataaagcagctaaatgacatgtattggaactagttcgtagtgcatcctgtttctctttgggctttcccttcatgcttgtgttttggcctaaccagagttcacttccagatttggttgacctgtatgttgtctgctactaggtagagtgaatatggctgacataattactctaccagggcagcagcagatttacttttggcttgaagaagctatgacaggcatcgttgtgttgcagcctgcaaaacggtgccccatcccttagaacctgaatacgagcaaacatcactggagaaaagttacatgtttaaaatgtaaataaactagcttttatttttagctttttactgcgaaaaaacaagtgtttggaatgattctttaaaaatgtgtggaggatgggtgtggtggcttatgcctgtaatccaagcacttcggggagggcggatcgcttgagcctgggaagtcaagaccagcctgggcaaacatgcaaaatcttgtctctataaaaaaaatgaaaaaattagccgggcatgtgcttgcctatagtcccagctactctggaggcagtggtgggaagatcgcttgagctcaggagatcgaggctgcagtgaggtgaagtcatgccactatacttcaacctgggtgacagagagataccctgtctcaaaaaaaaaaaaaaagaaaaaagcgctgctgataaattggacaaagggatgtgtgcgctcttgtatatggtttgcattctccccttagagtaaaagccgtttctgaagtcttcttggcacatgtctgaggtgagaaatagttgtcttatagagccaaattgtgatgacctagttttgaattaaagttgtcttaatttgagactgctttaacagcattaaattgctttcaacttgtctgtgtagtcttaacatttaatacagtttatagcctaaattgttggagtctaatgaagatagttaaaaaatatatatgtaaacagaggcaaatctaggaaatttaaagctgttaattttgcctagttgtaaaatgttgacaaattgtaaatttaatagttgtattagaggaaaaaaccccacagatataatctaggaaatttaaagctgttaattttgcctaattgtaaaatgttgacaaattctaaatttaatagttgtattagagaaaaaaacccaagttgccattatgtatttttttttccagctgaatttttggttgctagatttcttaattggaagctcattaattcttgcttttcactggggacttcattagttatgcatagtgaccatttttttaatccctctgcagatcagctctggaattaggaagagatgagccacagcccataatatcaagacattctgtcagaaacttaagagttgtttatttggatttcatattacttaacttttaggataataagatagaacatttaaagtaaatacttttaaaatgatttgaacacttttgaatgactttattttaaaatttcattaacattgaatagacatttatgatttctttaagagtaagtggtcctaaagtgaactttctattattaactttatatttaatatattgctcatcattaatgtcttattttgaccctagctgataaagcttttcgagacatgaaggtgctcaagatgagtcagtctatcattgtatctggagaatcaggagccggcaaaacagaaaatacaaaatttgttctaaggtgagtattcagctaacttgaagtatttgagtaggttgatcttttttttccccccttgagatagggtcttactgtgtcacccagggtggaatgcagtgtcaccaccacagctcactgtagccttgacctcctgggctcaagccactgttccacctcattctcccgaatggctgggactataggcacatgccaccatgccctgctaatcttttactttttttgtagagatgaagtcttactgtgttgcctaggctggtttcgaatttctgggctgggcttgagcaaccctcctgccttggcctcccaaaatgctgggattataggcatgaaccaccatgcttggcaaccaggttgacttttttctggtaaaaaaatacttaagtaaaagttgtcaaccatttctaagtgtatagcatagtagcattaagtatattcacgttgttgtgcagccaatctgtaccatctccagaactttcatcttggaaaactaaaacttgacccatgcaacaacaactccatttatccactcacctagcaaccaccattctactttccagtttttctgtgaatttaactactttagctatttctcatgtaagtgaaattacacagtatttgtctttctgtgactggcctattttatttaactcaacttaagattcatccatgttgtagtatgtgtcagaatttccttccttttatttttattttttagtattttggatcccatccttcctttttaaggctgaatactattttattgtagatctgtggtacattttgtttatccatgcatttgtcaatggacatttaggttacttccacctcttggctattgtcaatagtgctgttatgaacatgggtgtgcaaatatttctttgagaatttgaaaaggttgacttttaatacctttgcatacttcatgacatagtttggaatggtgggctctatcctttttaagatacagacatcttatatggaagctagtctatagattactgaaagccagctctgacatgttattcacacgaggatcttggaggatactggtactggttagacaaagggtgatctagaaatattccttaagaatctcacatttacgttctgtctatatttctgttgttagcatggttaaaaccattttttaccttaagcttacgataatttgcctccttatttctatttccctatagtctgcctcctaatgtgttctctttgctgccattaaattaaactctctgcattgtgtttttttgtttgtttgtttgtttggtttggtttgtttttttttgaaaacagggtcttgctctgttgcccagtcacccaggctgtagggcagtggtgcaatcatagctcactgcatcctcgacctcctggggccaagtgatcctcctacctcagcctcccaagtaactgggacccacaggcatgtgccaccatcctggctaattttttatttttttgtagagacagggttatgctatgttgtccaggctggtgtccagctcctggactcaagtgatgctcccactttgacctcctaaagtgctgggattacaggcatgagccaccatgcctggccttacactttgtttagaattatagcattttaaaaatggaaggaatcataacactcattgtagtatagttcttttaatttacatacccatgaggttagatctagtggttgaactactgctaggagcagcatactcaccagtgttactcccacagaattatagttcttagttgattgctgcatagtggtactatgaaagtttgctattcattatgtaaatatgtatgctgttcagagttatttatgtaaaatcaattgaagagtttgttaacagctgttatatatatgtgtatatatacatacacacaattctggttaagtgaatgcttcccagtattcttggattctaagtgtttcaatttctttttctttctttcctgtatgtaatagtctatatgagtctatggttaatgtatgaaaatgaacaaaaagttaaggagttataaacttataatatgaacttacattttaaattaaggattgctctttattttgaaatgtgccaggcaaatagttatttctctgtgtttcatatttcagtgaaacaacatgaatagtgataacttcccagttgttcggaggcagattgcctcattttctgtagccaaagattgaattaataggctctcacaaaaggctttgacatctcctatagtttatgaatatgatatatttaaaatcaaatagttggataaaatcagaacattcccaaaacaatttaaaaaacaatgtcaattagatgttaaatgcaatacaaatagaatttatttttcatttttataatttcaacatttagattcaggccacacatgtgcaggtttgttatgagtatattttgtgacacagaggtttggggtgtgaatgatctcatcattgaggtaatgagcatagtaccaccaaatatatatatatatttttttgaaacggagtctcactctgtcgcccaggctggagtgcagtggtgcagttttggttcactgcaaccttggcctcccaggttcaagcgattctcctgccccagcctcctgagtagctgggatgacaggcgcatgccagcatgcctggctaattttttgtattttagtagagaaggggtttcaccatgttggccaggctggtctcgaactcctgacctcaggtaatccaccctccttggcctcccaaaatgctgggattacaggcatgagccaccacacctgaccccaaatagaattttaaataaatttaaaaagctatgacagaatagttgcatttaattacacatttgttataatgatgatctaggtttcagttttatatgtactagataattataaattattgtacaccatattattgtcatcaacattttttatcctatattttaaacagatacctgactgaatcctatggaacaggtcaagatattgatgacagaattgttgaaggtattgctaatttttcagttgttacgcgtgtactgaaattaatttacaagacttcttttagtggtctggaatgttcttctctcagagatgcaaaagactctcttatctcctactaatcattgctcatatatcatcttgttatttacctaatatcaattgtttctgcccccacccgcacctcatgaaaacactaagaaggcagggatttttgtttcatattccaaacccttagaatggtaactgatacagagcataaatatctgttgaatgaatgaaagaatacaggaatgtctttagcttccagtttgttttatggagcttgttttgtgtaaaggaaagaggaagaagggttatttggcattaggtgcttttttagagaagtcattttttaacgaaggccgtagtgtgtaaattgatttccttaagctatccatgcttgtataccttcttagaaagtcttcttgtacctcagtttggagactgctggcctagactaccattatgttgaatctcctgcatgatgccctcctgcatcatagactcctgttttgtctcttcacttagattcttacttctccttaatccagtctctgtatagaatttggaataatttctttttctttttcttttctttttttttttttgaggtggaatctcactctgtcacccaggctggagtgcagtggcttgatcttggctcactacaacctctgcctcctgggttcaggtgattctcctgcctcagcctcccgagtagctgggattacaggcgcccaccaccacatctggctaatttttgtatttttagtagagatggggtttcaccatgttggccaggctggtcttgaactcttgacctcaagtgatccacccgccttggcctcccagaatgttgggattataggggtgagccaccgcgcccagctggaataatttcttttgctttaaataatctgatggcttcatattgctctcaacatcatgccctagattcataacatcacccacagtgctctgtgtggtctggctcctgcctcttctgagctcacctggagtcatgtttcttctgactccttatgctttaatcacattgggctccttgtagttctttgagctgtcttaaacaggcttctctgaacactttttctccttctccctgtcttactttcccccactatgtactcagtaagcattttttaataataatggtggtaataacatatatgggatgtattaggcattatctcatttgtttaaaaatctgttatgtaatttaaatcttcacagaatgaattagaaactattttatccctactttaaagatgataatatttaaatatgctgaagctcatatagttcatcagttgtgaaattcggatataaagctaagcattttaactacatgccgtagtaaatgcatattttaacactctcttggcattttttgtttttaaattagagacagcatctcactatgttgcccaggctggtctcaacctcctgggctcaagcaatcctcctgcctcagccttgtaagtagctgggactctaggagtgcaatacacatgctcttgacatcttaaagaaaaatgttggttgaacaaaaacttattaggggccttgtatgttcatgcattttgctagatcatagcaaatgatatgtgcatttttcacaatgatgtaaaatctgcatgtagatcaatctaaatacaactctaataaacatttttaaagttgagcaccagtaaagtttttttttaatataaagaatttcctagtttcatttacagtttttatgtggtgttgtaacatacccagatatgtacttatcttgtaagtaatgctttattcacagtaaagtgccttactttagcgagggagtcgttcttaaaaactgaataaattaataaaaaagaacaaattatgggctacctcagtaaaagactaattagtattctgatttgctcacttgaggtgcacactcacttaataattggatatacacccagtttcttccccagtaatgtgctgtacagtatgtagtgtgttatagtggagacaagttggaaagtgttattccaagtgcttctatagcttcttttttttttttttttgagactgagtctcactctgtcgccgagtctggagtgcagtggtgtgatcttggctcactgtaacctctgtctcccgagttcaagtgatagcgctgcttcatcctaccgagtagctgggattataggggtgtgtgccaccacgcctggctgatttttgtatttttttagtagagtcggggtttcaccatgttgggcaggctggtcttgaactcctgacctcaggtgatctgcctgcctcagcctcccaaagtgttggtattacaggtgtgaaccactgcacccagctcaatagcctcttaatggagaatagtaaatgtaactagaagggtatagcgtcttttgatcccatccttaatagaagtttagttgctggttttggaatgagtatattattagtagcattaatatgattttctgttggagaggttcttatcctattttgggatattttacttgtattaaattcttcagcaaaaactagtagattatcagtaagggagttggggagacctgtaattgagtcctctttttgttaacacagccagttatgtggactttgaagagtgagttgaccatggtttttttttttttttcttcttgtttttttttgagttggagtctcactctttcacccatgctggcgtgcagtggcaagatctcggctcacctcaacctccatctcccgggttcaagtgattctcctgcctcaggctcctgagtagctgggattacaggtgcccaccaccatgcctggctaatttttgtatttttagtagagacggggtttcaccatgttggtcaggctgatctcaaactcctgaccccatgatccgcccacctcggcctcccaaagtgctgggattacaggtgtgagccaccgcgcctggctgaccatgttggcttcagtttttttatcccatctgaaacatgagggatatatgttaatatttcttttagttttaatgttttcttattttggcatgtgaaatggctggggaatgatctttaaaagagtttagagactagttaagcattctactctagatagaataggagaaatctgcttgaaaaggcttcataagaaatatgacttcatgtttattttttaatttattttattttatttatttatttttttgagatggagtatcgctgtctcccaggctggagtgcagtggcgcgatctcggctcgctgcaagctctgcctccggggttcacgccattctcctgcctcagcctcccatgtagctgggactacaggcacctgccaccacgcctggctaattttttatatttttagtagagacggggtttcaacgtgttagccaggatggtctcgatcttcagccctcgagatccgcctgcctcggcctcccagagtgctgggattacaggcatgagccaccaagcctggccagcttcatgtttattataggaagaacatgcttcataaaaaaaattttaacactgaacatcatgaagcactttaagtttgttgatggagaatatgtgtgtaagattaacactaatttggtatgtttgtaattgagatttagatgagtataagagtagaatctagtaactcttatccagtcatgatatgtgtataggtgattataaaataacagtgaaaatattatatttgttcactaggattttaaaacccattattctgagagccttaggtaattctgtaaactcttaatttgttaaatttcactggatatacatgtaaaaatgttaaatatggagactattaatatgtgaaatgttttagaaaagtaagtcaaataatacatctcttgcctatattttctcacaagaggtttgctgttttatctaagtactgttgtgggcctgatatactagataaaacagtaaaatttttagggaaaaaattttaaagtctagttataaattttgtaacatagtggcttaaaaatttagtctttcctataacatttatattttcttgttatatatttgagaaattttcctatctcatggacttgaatagtgcctgagcatagtgggtaatcaataaatatttgtggaatttggcattacatgtgaattccttcatgttaatttttttttttttttttttgagacagagccttgttcttgtcgcccaggctggagtgtaatggtgcgacctcggctcatcgcaacctccgcctcccgggttcaagtaattctcctgcctcagtctcccaaataactgggattacaggcatgcacctccacgcctggctaatttttgtattttttagtagagacggggtttcatcatcttggccaggttggtctcgaactcctgacctcgtgatccacctgcctcggcctcccaaagtgctgggattacaggcatgagccactgtgtcccgcccatgttaatattttttagaacatttttttctagacatatatattaacaaatggagatataccatgcatattttgtaatgttccgtcatgctaattttttgatggatttttttgtttctcaatagctaacccactcctagaagcctttggaaatgcgaagactgttcgcaacaataatagcagtcgatttgggaaatttgtagaaatacattttaatgaaaaggtaagtgagagtaagctttggaatgatatttttggggagtgtttgtgaaaatgcaagggtcagttggtgctgtatttgcacttaatggtaaatacctttaagtttcattgttactttagatggttgcaggaatatatgtgtccactatgaccatctaaaagctcctttcacaatctaaaacccagatgctgaatttgacttcagcattgagtattactgtatagctagtcatgtaagatattctagcacctgtgttgaggtacggtgcaaggtcaattgtgattcttaggaggctcaaaacttaacaggatttgggtagagacttaaatggggatgtttaaaatgaaggatgaccattataaatactctgtgcttacgtttagttatttgttttttcccctttatttggtgaatattataacctctttgatagacaaatggtattagaaaaggtaaataatttaacattggttaattatattttaagactttaaatgcaaaaatatattttctctgtgttttgttttttagagctcagttgttggaggatttgtttcacattatctcctagagaaatctaggatctgtgttcaaggcaaagaggaaagaaattatcatatcttttataggttgtgtgctggtgcttctgaagatattagagaaaaacttcatttgagttcaccagataattttcgggtaggtcagaagaaaagaaatttcatatagccaggtgcagtggctcatgcctgtaatcccaacactttgggaggctgaggcggatggattgcttgagcctgggagttcgagagcagcctgggcaatgtagcgagaccctgtctctaaaaaaaaaaaatacaaaaaattagctgagcatggtggcactcacctgtagttccagctactcgggaggctgaggtgggaggatcacctgagcccaggaggttgaggctgcagtgagccatgattgtgccactgcactccagcctgggtaacagagcgagaccctatctcaaagaaaaaaaaattttgtataatttttgaaaatataattgccatcaagcctaatacttattttagtgaattttgaaatctacttgttgtgtgtatgtaacttacattggatcaagtataacatgttagaatgaccactgtactgagaagatctctattaaggtgtactgctgagtttatagtataacactgtatgaggaggcacataatggaatagataaaaggatagatgttaaaccctacgtcaatttaaactcaattagaaattgataatagctctgtaatactagctttaaagttacctttgacttatctgtaaaaatgtttgaacactaaattaatattaataaaggacacatgattgaatttcttaatttacttcaacaacaaatatttattgcttgcccattgggtgccaggcattgggccaggattaaaaagataaataatacacagtccctgctcttgatcaacttagatgtggtgggaaacgcacacacacacacatgcacacacacacacacacacacctgagcattacaagcgagtagagtttctaggagcggtgactggggatggtttggttaacacaattttcagattctcaggttagaaaacagtgtacttgtatggagtatgggaatgtagtttatacaaaggaatgcaatgtgagtaaggaatgtcgtctgtatagagttccccagctgattctgatagtcttttttggtcagaaagcctccatttgagaatcataacacacataattactgctctgtggttgtgtgtgtgcgtgtgtgtttgcagacagcttttcttttacttcaatttcttttaatgtgtgtttgcaaattttaaaagtctgttgtcttaaaacactttataaatgtatctctttatatacttctaaaatgtccagtcttttctagagctctccaaattaattggaatttgaagctagttgcccacatttccatgaaagtaaaggaagcatttcttttttactatggtttttaaaaaaggaataaattactaggaattacatgaaatataataatgatgatacggttttgtcaatacttagctgacaataaagtgatgtgactgttctggccttaatctagcatttcttcctgcttggaggcttgggagtatagtatttttgggtttcagaatgtacagcctttcctggtacaatggcaggcatcctgaaagggcagctattgaaatatatctggtcagaggatttcctgtttctgcagtgtgaaccaggaggcctgatttcctttcttacaggagagtccttgtgatggtaagaggaagagtaggggaacagcgttgcatacatctgccatcttgaatattcctctcatatgcaggcacaacacacccactactatatccacttcccccaaataattctgccttaaagtcacttgaaagtgtgttagtgatttcatcaggtttttctgtagtttagccctctggttataattgagagatcaggttttaaaaacaaaggggaaacctgcagtaggttgaacacttgtaaaattgttgaatttttttggtcactactctatcaaaattagtatgtaaagaattgtggatgtatacctgtctgtaaacatttttattaaccacacatatactttaaaaagtaaaaggtttaaaaatgtttgcatttagacatttcaaatatttctgcacatgtttctggagccaattgctgtaatcatggatagatccttgaatgtaaagaaggcttggatagaaaaagaatagatggccgggatagtgttctagttacagaaaaactaaaaggacacgtttctatccaaggttgtaatattaggccccactgtccagaagcaaagtatttgacaaaacaattggagtgaggagacaaagtgcttggtagcaaagaacatatttattttggctctacatgtttaaactattattctgctaagtaaaagagctcttatttgaaacagtccattgaaaatgcttaccaacattgtccctgctcccttctcttttatttttttcccaaagattctagggtggaagaaaaaaaaaaaccatgtatatagttgtcttgtttttactgtattttagcatttaattataatggagaaggaaagatagaggcattgattgtctaaaatattaatttatccccaaatcattcaaatttttataaaattttttttggtatgtgtatgatgaggtgtatttaatttgggaattcatgccatggtacaataaaatcatagcaacctgatttaagagaagctgagatgtttaaaaaaacttgtccatcctgttctctgtgtacatcctttctgatcagatttgcccaattccatctaaatgtctttaggctgtgtgtaattttcagaaaaatgcagtacttttagtctaccgtatagcaaatatgttcattcactttttattagaaacagtttttaaatgaagcaagccttcaattgtgagactaataaatgggagcagtagattcttgttgataccagtagattttctttttttgaactactcctcttgttctatattttggaagcatttagcttttgaaagcctttggtaagtgaagtaaatcactgaaataagaaaactttaaattatttgatccataaagcataaagcaagtagtgtaatttatgtacagtcattgttagctttcaataaatgtgaaaagcatgttttaaaaaactgactctaaaaatcaaaaattaagaaaatcaaggatagaatttcttaacttctcagaatttaaaatattacttgaaaaattaaaccatactatcggttcttacttgagattctacatatttagtaggaaggtgattttcatgattttatacactatgtttagatttttgatactgaaaagatataaaattgttgccctttaaaagtagaaaacttttatgtcattgatttttaatcattttatttaatctatgctcagagattaggatttttaatattcctggttttattagtaggaagaaaatgcttataaaatatagaagtattgatttgaatggtgagattatacagtactcaagttgtgtttagaaattcttcatggttggcactatttggtaagttgtgttttctcctgtattatttccctgtggatcatatatgttaattatgtttaatttgttttgtcatagtatttaaaccgaggctgcactagatactttgctaacaaagaaactgacaaacagattttacagaaccgcaaaagtcctgaggtatagtagaccattgttcataaaatctttaacttaaaaaaaaactcatgctgaaagatgtgttataatttttattttagagcccaagtaagagttctaacttttaggcttatactttaaaaaattaaatattcatctaagtctctgtcacagtgtaatactttatacctcttgttgttatctagtgaagtgacaggttctggttcttctggttgggcatcactgcattgctctcctctcattctgttttcaagcatgaaggtattaaattgcctaagaatcattctcttctagcatttttgaaacttgctcttatattacccacttgagcttaagtatatgtcttttacaatttattgtctatttcaaggctgacgtgaggtttgatgtagacagtaaatagattaagcgttcttgggaagaaatgcttataggctaggcgtggtggctcacacctgtaatcccagcactttgggaggccaaggcgggaggatcgtttgaagccaggagtttgagaccagcctgggcaacatagtgaaaccccatctttacaaaaaataaaaaaaattcactgggtgaggtcgtgtatgcctatagttctagctacttgggaggctaaagtgggaggattgcttgaaccctggaggtggaggctgcagtgagccacgatcatgccattgtactccagcttgggcaacagaattaaaaacaaacaaaaaaaagctggtcaggtggagtgggtcacgcttgtaatcccagcactttgggaggctgaggcaggtggatcatttgagttcaggagtttgagaccagctcggccaacatgatgagaccctgtctctaccaaaaaattacaaaaattagccaggtgtcgtggtgtgtgcctgtaatcccagctacttgggaggctgaggcaggagaatcgcttgaacccaggagatagaggctgttgtaagtggagatcgcaccactgtactccagcctgggcgacagaacgagactctgtctcaaaaaaaaaaaaagcttatatattattgtagttctgtttaaaacatcatatttatgtaatatattatgaaaaatttatatattggtttcagtaaattatatttctaagaataattagatataattataccattaagtattatttttaacacattaagttcttaatgtaaaaatttacaacccttataaattttaatatgcagtgtttaataagtgatattaagttacacgtactcaaggggcttaagttatgaaatactaaagtaaggattaatgatagatactggttaatgttacttttattaattttattaaatatttaaattgagtaatcgaacaagtttttataatagtcagtttttaatgcttctacatttgtaagcccgatattttttactcttcttaaaatgaatgagatgatttatatttttagcatatttatataaaaggatagaaagcaaataaaatattccattatttaaaattctaagcagacaaccctacagttaatttttgtttaatttggcattttatatatcattatagatacagaatctgaattacaaactataaactttgctatagccatggttggtacttttaagaagcaacattaatatttattattgtatctttctttgtcttgataagactatgtttttctgagatatcaaaatatagtagctatattcctttcactaagataatggagacctttcctagtgggacatttcagcagttctgaaggggggaaaaagatataaatttgatcatttgccatggaaaaaaatggagtagagaggaaagaaaacgagtttactctccaaagagtagcatgtactctccaaagaagaaaattgccctcttattctagagtcagtatactctttcagaaatcttattcacattgagtgtgcgtttatatgtacagttaaataatggattaatatgtttaaattactttttatgtcttctttatcaggaggatgaggtgatcattttgactaattaaaccctttgcccaattccatctgaatgtctttaggttgtgtgtaatttttagaaaaatgcagtatttttagtctgccatacagcaaatatgttcattaacttttgattagaaacagtttttaaatgaagcaattctttgactgcaagactaaaaattctgcatgatgtgtgttttctgctgaacagttttggctgcatgtgattgtttcctttgcttcttttaagaataaaattgaattttattgtcttagatattttccagaaatgttacacattcataattgaacattttaaataattttgtggaaagacaattatagcttgagctgggaatcatttgtttactgggaggaaaaaatatccatctccaggaggcatctttaatgatcagttaatcatgatcctgttatttaatgtttaacttgtatattctcaagttctggaaaatttctagtacaatcttttcgtgtccagtaacttttatgtttctccttctagtttctgcagtcctgactttcttctttttttcttctgagttggtatagagtctaacaaatgagcacattagatgcaagttcttttaggagagaaaacaaattttcttctcattttttctgaaatgttttaagtcattgtgtaaattattagagtaagtataatgcttactaatatactttaccatatatatatatgcatataaaaaggtttaaaaaagaattctaaggcatgaaaattgtatcagcctgacccctatttactacaacttaatattggtgcagttggtggcagttaacctaaaggagtcatactgattgtcacatttaaattttttattgcaccttttaacttactttttctttttttaattaacaagaataatgtatatttatacagtacattggaatacaatgtaatgtttgatacatgtatacattgtggaataattaaatgaatatatttatcattacctcatttaaaaaaactgtaatgttgattcaagtattgatattccctcctttttcactcaatttttgtctttttctaatatgctaggattataagactttagagcgaaaattgtaatttaattgaaaaacatctaatttcattattttaattgaaatttttacggataagtgtagattcacatgtagtaaatagtgaaatagaacagagagatcctgtgtatacttttcatggtcatttagtttttgaatgttagaatagtaaagattttcccattgacagattttatttttgcatgttatatagtgcattaattgacctggtgtagtagttttagtgtacttaaataatgtaacgatcagttaattggtgtcttcttgttttgtagtaccttaaggcaggttctatgaaagatcctctgctagatgaccatggtgattttattagaatgtgcacggctatgaaaaaaattggtttggatgatgaagaaaagcttgatctcttccgggtagtagctggcgtcctgcaccttggaaatattgattttgaggaagctggcagcacttcaggtttgctttttatttttttaagaggaaaaaaattaaatagaatttctgttatttatttgtcatatgaaaattgtctctttatatgcagtttgcttaaaaactttaagaaatatctaaaatatactgagttaaatgttgaatctcccaaatgaagaatgtttcattatcagtcattctgagctctgttttgaacaaatcagtgatattgcttaggaataaacctctcatttttgaagtataaataactgactattttatcctgataaatttagggtaatttttagttaaattttccagttatattacacttttccaataggtgagaagattaattctctatcatctattaaggcatttttgaaaattttcaggatcattgggtgaattaattagggcaatttaatatataaaagcccatgtactttattaatgagaaatgaaaataaatgaaaattttaatcttatgcagattgaaaagagtatttaaatacatggcaaaagcaacttttcaactccagtgtttcagtctgtacatgaacagtaggactttgcataattctaaatttgatctacgaatacagggaatggcaaactatgaaccacagcccaaatttgacccactgcctgtttttgtaagtaaaattttattggaacaatgccacacccactcatttatgtgtggtctataccagcttttgtgctagtgtcagagttgagtagttgcaacagaggctatatgtcctgcaaagcctaaaatatttactatctggccctttagagaaaaagattgtcaacccctatattaagacattattgtacgatcttataccaaggatgagttaaggaaaacctacagcaccatttaatgtagtagtcaataatgggctttggtgttagatcccagaggctctctgagctttggtttcctcacttgcaagattaaataaaccatgagaaggacttttaaagtacagccagtacctagtgtaatgctaaaggttcttgccttagccatgccaaagaattggtgtggtggctgcctgcagtgagtgatggagacagggaccaagagaaaaaaaagccatagactttattgagcagagtgacagtacaaagctttcacagtgtggaaggggtcccgagtgggtagccagagttagattatgcagtttccttttaaactcttcaaggcgggaaatacgtgcagggggaagatgttaccagagcgagaaacaaaggcagtaaattattttgtgatgtgttttagattttgaggaaaaccggaattgcaacttaggttttatttactttatgaccttgcagcggcttggcaaaggagacgggaatttacgggactttacaaagtatgtttacaaggagttggaattaggagcatagataaggcccactggtcacagaaaaatgggcatttaacatttcttttagtttcaggggagggggaagggagagagggagagaggacatagggaagcttatggcaaaatttttgctgttatagctttcttggggaagaaaacacatgcacaaatcctggtgttaggaatattttaagcacatatctttaatattattcatccaggaccaaagtaagtcctgatacaggaaatgagtgagtttcacagcttcctgagcccctactcgacccaggaaggccagcgggcacctcctctcactagcaatagtgtgcatatagggaaagagcacaagaagacaggaaaaaaaagaagattaaaaaaagtgttatatgcaagactcttcttattctgcatttcatcataaacatcgtaattgtaatctgtatatcataaatataatgaggtaggggatattatctccattttacagaagtggaacctgtgttgaaatgatgcatgtggttattgatgaagttgtagatgtgagagctggttctgctcatgtctgactaacacagaggcttgtgataattgtcccttctttctcccaggccactgaaatttgtcatctatgaatgaacagactaaaacagatgtcttaatgattttcagatctaatgttctgtaatgctgtgaaatcaataatgtgagatgcaacataacatagtggatgggagcacgtgctcctgatccagatgctttaccacatactgtctgtatgaccttaggcagggaacttagccttttcgtgtcttagtttcctcactgtaaactgaagataatagtacctacctcatgttgtaaagaggaatacgcgagttaaatatttgtaaatgatttgagtacttgtgtctggcacatagtaatcattataagtgctttaaatgagtaagtacaattaaaatacagattgctcccaatttaaaatgaaaaaaaaaaattcaagcaaaattagatatgttcttaatgtgcattaaaattttttgtttttttttgaaggattggaaaatttgttttgaaaatgtaatgaatgttagcatacatttcatttgctctctagcattgttataccaaaggagcatatgtgggagattctaacacaaaaaaaagtctttacaataattaatacacactttagaaatgttgttagaagtgataaatggcatcttcacacctcttattattaccctgtggtagaagatgcagttgtatagagtattataagtgttgcatgatcaagttatttgaagagtatgaaatgcccaaaaggtaatgctatttgcgttatctcttatttttcttctctaacttccttctattgagggtaaagtgaacagaaatcagggaagattggaaagagacagggaatcaataagattaatatgtgattcaattaattattttaaaagctaagattttattatatttgtcttcatccttcctatgactcttcctatagatccaaatggtttctttctaattagaagtgatttcttttttccctagggagcttaatttggcatgtcttagcaatttgaaaaaatgttggttttggcaggatatggtggttcttgcgtgttatcccagcattttgggaggctgaggcgggagggttacttgagctcaggaattcaagaccagcctgggcgacatagtgagaccccataaaaaaaaaacaaaaaaacccccaaaacacacacacaaacgcacacacacacacaaaataaattagctgggcatggtggtgcatgcctgtagtcccagctacttggaaggctgaggtggaatgattgagccctggcggtcgaggctgcagtgagccatgatcgcaccactgcactccagcttgggagagtgagaccctgtctccaaaaaaatttggtatttttataattattctactggaaagattattctccaataagcacttataggactcttaactgtcataaagaagtttttgcatgatgaaaatgcagaaaactgcattgggactgcctatgtttttaaaattccacataacagataaaatgttattataagaaactttaaaaatgtttgaagaagttcttttttggaaagaagtgatatgaaaactttacatgatagtattttgccttttaagacttattaaaaatcctgttttttttttttatcttagccttacataatttttggaggtgtgtaagaaactttgcgatatagtaaaaaagaagaaatatttaaatgaattatttgatggtcaattttttgagagctatataattttaggcaatatgtatatgtatagaacctacacgagtaataagcacattttcatagaatgaaacattcaaaatattctcaaagtatctctcttttttctttttttttggtaggagctttattgagatctagttaatataccatacagttcactcaattgaagtgtatatttcagtggttttcagtattttcagagttgtgcaaccatcaccatagatttagaacattttcatcaccccacaaagaaaccctgtacccattagcagtcactcctcattgcccacttctctcaaccctaggtgaccactaatctacttcctgtctataaatttattctggacatttcatataaatggaatcatacaatatgtggtcttttgtgattggcttctttcacttagcataatgttttcaaggttaatccatgttatagcatttagcagtacttcattttatttttattgccgaataatatttcattgtatggatatactacattgtttatccatttgtcagtttctagacatttgggttgtttccatttttggctattatgaataatgctgctgagaacgtttgtgtacaaatttgtgtttggatgtgttttcatttcccttgagtaaataccttggagtggaactgctgaatcacatcatggtaaactctgaccttttgaggaactgtcagactttttcaaagcagcttttccactttacaaagctattcccatcagaagcgtatgagggtttcagtttctccatatcctcaccagtactatgtgtatgcttatagcaatcgtacagggtgtgacgtgttatctttttgtggtttttatttgcattttcctgatggctcaagatgctgagcatctttctgtgtgcttactgaccatttgtatatcttttttggagaagtgcctgttgagattctttgcccatttattaattgggttgtctttttattaccaagttgtaagagttttgaaaatatattctaagtacaagtcctttatcagatatataatttgcaaatcttttctcccattctgtatgttatctttttactcatttgatagtgttctttgaaactcaaatttttatttcagtgaagcctaatttatctgttttttcttttattgcttgtgattttggtattatatcaaagacatgaagatttactttgtgatcatgaaggtttatacctagtttttttctaacagtttaatagctttagctcttacatttaagtctttgattccattttgagttaatttttgtttatggttgaggaaggggtccagcttcattcttttgcatgtggacatccagttgttccagtacctttattgaagaagctgttctttcctcagtgaattgtcccaacatcttattattgtaaggtctcatttttcacatttttttctcatatatattctaagattggtatgttaagtagtttatgaatttgtcataaaattgtcatgattttcacacattctttgtagtttttaattaggtagtcttagaatatatcgtttattaatattaatctgaaaatatttgtaaaatgctattttttattataatgcaaataaatataaagaatagttaatcgttagtactttctctgtaccagacactattccaagcatttcacatacataacctcattaatctaaatagcaaccatgtaaggtaggtaaagtaattatcccagttttatggacgaagaaactgtgcacaaagagaataagtaacttattcaaggtcacatagctagtagttgtagagcctgatcagccctgagactaaagcactttctttctttatagtactttttaaagcagcccttataaatagaaatctgtagatatgatgtactaaggcaaaaatgacctgcctggccaccttctgctgcaatatatcttttcctcacatacccctgtgcaagcacacaaaaaataaaatggcacacgtgcaggctggatgtgccaatggcagatttctcaaaatgcccacatgggtcaagacctaactgcattgcttttttttttttttttttttttttttttttttgctattctctgctctgcagtgtaaagatattgaaaatgtcaaaaaggcttgcagatacccctaagggtaacagtaaataaggaaaagaggaagcatttgtactgatctctagcacagaaagtcaagctgttggaggaactggacaggggtatacatgtatattagtgtgtatatgaaacataaatgaattttgtgtttcgaattcagctcatcatgtatatgcagttattccaaaactggaaaaaatctaaaatctgaaacacttttggtcccaagcatttcagttaagggatactcagcctgtacaggtaatagtaaatgtctcttcactcccttcgaccccaagcaatatgagtacatgcttattacgtatatgcataaacacatccatagacagatatgtacatccaaattgatctatttaggtgccttacagcgtttgcactaaaattactccttgaaatttcttgaagtcatatgaattttaatgatgagatactctatttctctaaagagttaatatattgaaaaggattataatctatcagtgtagtttgcttatagggtcaaaaaaaatgaaacagtgacagtttaatattgatgtgcttaaaggattataccatggacttccccaagggaggatcttctgttgatcttagcagtacgggtgtttgacaaggatagtgaaaaagtgaggtagatttaaaagttacaaataagccttgcctattatatggttttttgtaagtgaagtataattctaagaaatgggtcttgaaaatctggtttatataatacttattaatttcaatgaaaatatatttctattaggtggttgtaatctgaagaataaatctgctcagtctttggaatattgtgctgaattactgggtttggaccaagatgatcttcgagtaagtttgaccacaagagtcatgctaacaacagcagggggcaccaaaggaacagttataaagtaagttccttaagtaattgcactgcaaaaattttgccttgcagtttgtcaaggaaaaacataagttacattctgtttaaaacctgagcttggtagatcaaaattctctacatctcagtgtagtaatccaccatataaataaatggagtttaacatagctcttaaagttgttccttgctgatatttggaattcataaggtaagagagaggtttacttttctacaactatgaaaatatgagctgatggtataaatcaatatatgacagttttaggcaacagatcattttactttaaaagtaatttttttatgccaataatgtgtactaaaacacatctattaagcagatctcacttcagcaaaatacttagcaaatgacactttccttatgtttaggattctttatttgggagaaattacaaatgacgagaaataagggcttaaccaagattttaaaaatcagtaaccaagaacttctagattgtacctggatgtttttatacttttgtctccatgtcctatattttatatatttttggttttggtactgtagaataaaattgacattcagccttgtcattctgaggcactgcaggatcttcatttgtggagggaagaagaccctttatctcttactaataagataggcagtgagctctagtgacatatttccgaaaaagttgcaacaaatttaaacaaagaattttttgaaaaagcttttagcctctcagaaaattggctatctcttattcttttgaaaattttagcaaggtatgcttagcctgattctttgctaagcaaattcaaaattgttcttgttataaagaaaaactctggaagaagtttgtagagtaccaccctacagcctacagttacttggttccttagagatatctctgcggcccaagggaaagcccataaatgtgcaggtgggtggttctcaggcattgcttcctccattttcccattttctccttgttccaaagcagttttttgttgttgtttccttttttcaatcaatgccattccagaatccaaagcagctcttttatgtactctatatatagcgtgtccacatgaaacttcaagaaagggttccattgcagaaaatataagtgagaaatcactgtttagagaggcttaagtatcaaatgtcaggctgatctgaatgacttataattctacttccaaatttgactttcttttttttttttttgtgctctcttggtaccccatgcttatctttatgatagtatttagcatggtgtttggaaattctcttctgtgccagtctctcttcatcagactatcattttcttgaggacaatggctctgtgtctgtacctgcaacatttaatactattataccatatagtcagttatattaaatagtagaatgggacagttcaaattttaagatgtaaacattttatcctaaacagtgtaaagaagttaccaaactttaaagttatcctgaattaaacactgtttcctttgcatttaaggaaaaccaaaagggaggttattcctttgaataattttgtatgtattcaggatgtaaattaaggtcaaaatgattttttaagcctaattttttttaccccaataatagacttttgatctaattttaggtaattccattagttttcttgtagcagttttctacttagccccatttatctgtgcctattctcacatgacctttggtaactctttattttgttcttctctgtgtgtatgtttaggtgcactctgtggcattttcacagtgcactattataaagaatttttactagcatagttttcttttatagggtacctctgaaagtggagcaagcaaacaatgctcgtgatgccctggcaaagacagtgtatagccatctttttgatcatgtggtaaacagagtaaatcagtgttttccttttgaaacatcatcctattttattggagtcctagatattgctggttttggtaagtagagtttcttttgtgagtatatatttgtttcatattttttcacacattagaatttgttcttaaatcttttctcctttgtaactcattttacttgatgtatgtgtaattatatgtccacactcacatttcataatatgacctagatagggagctgatactttaaagagaagaggaaagactcgtggggattagttttgatgatactaatgctaaaattaaaacattgattgaaactgctagagttaaggatatctctatactctaaaaggaatacaactgaataaaggtaaatccttgtgtgctactaataaagataatacattcactgattaaataacaaaaaaagataaatagagtcactaaaaccatttactaatttgtagagctggggataggttgacctaacttacaggccaacctcattactatgtttagaaattcattgctgttgctgtcagcaagtagctatattttccatcaaattaataagatatcaaggtaagtagttaaacaactgtagagctgttcaaccagaaatgaaatgggtcaccagcatgtgaatgctgctttgctctgagtgacaaaaatataaaaatcttgaaatgtaaatctaatgggttttgtattgggctttatcaatgtgggcattctttctgactgtgaaggagtagtgtcttctttgtggtttttgccaaagaaatgtatgagtgtttacatttggggagggatggagttttgcttttgatgtaatacgtattttaaactttataattctctaccttttgttcaaaggtagagaattattattattattaattttttttccttttctacaacagttttagcataacacatacaaaggattataaaattgtaaagccgagtgtatcttagacatcatgcaatataatctcttgattttagaaatgaattggtatccacagcatttttgataagtaattttacagattatgcagaaaaaaatcttctaaagcacttgtattttaagtaatttttgtgcttaatttagattgctttaatacctgtgctttaaaaaattgttggccgggtgcggtggctcatgcctgtaatcccaacattttgggaggctgaggccagcagatcacttgaggccaggagttcgagaccagcctgggtaacatggtgaaaccctgtctctactaaaaatacaaaaattagctgggtgtggtggcacatgtttgtaattccagctacttgggaggctcaggcatgagaatcacttgaacccgggggcggaggttgcagtgagccaagattgtagcactgcactccagcctgtgtgacagggatcctatctcaaaaataaataaataaatagttaacatgtggcttacattttatatcttttagtatacaacatttatctcatttgagaaacaccttatttgtcaactgaagcagggtatttttaatacttttaatgcctataaagttttgtcttgaaatgagaacatttgggaagtatagaacaaatatatataatatacaaatttaacctaattttaaattaagccattattacaattacattttatcctatgataaatttatatgaagttgatctcataatgactcttggttctggttttatattttcagagtactttgagcataacagttttgaacaattttgcatcaactattgcaatgaaaaacttcaacaattttttaatgaaaggattctgaaggaggtaattgccattataagtttaatttaagatctgcataaagctattttaaattttaaggaagagatatgctgcagttaccctgattggtgtggatggatggtgtataacggaaggtggctcagggaatctgggaagcccagcagaggccccggggctcaggcacgtcagaagtgttaatggttcagctgaagtttagggacccgataaaaacccttaataggggcttcctcagaagtgaacatctgtttttagtagtgacttttaatggacttgaagctctgtttctttttatgattttgttgtctctacttcttttttttttttgagatagagtctcattctgttgctcaggctggagtgcagtggtgtgatctcggctcactgcagcctccgtttcccgggttcaagcgattctcctgcctcagcctccccagtagctgggacaacaggcgtgggctaccatgcccaacaaatttttgtatttttagtagagacagggtttcacaattttggctaggctagtctcgaactcttggcctcaagtaatctgcctgcctcatcttcccaaagttctgggcttacaggcgtgagccaccgcgcctggcctgttgtctctacttctaccacaccaaacaaccttctacccgcatccctgcctttggcatctcccactcttttttttttttttttttgagacgaagtcttgctcaggctggaatgcagtggcgcgatctcggctcactgcaacctctgcctcccaggttcaagcgattctcctgcctcagcctcctgagtagctgggactacaggcacgcgccaccatggccggctaatttttatatttttagtagagatggggtttcaccatgttgaccaggctggtcttgaacttctgacctcaggtgatctgcctgcctcagcctctaacagtgctgggattacaggcgtgagccatcatgcccgactgtagctccccttcttcaggtctctctgcttctgcctactctgctgctggctcacctttccctgtctggcagcaaagccatcaagtcaggagatttgatgcatccattgtcctggagtgcctctgggcagtactttccttgtcatgccaccttttggactgtcagctgcttctactttatctgggctgaaatgtgcaatcattttatttcctatttccatcctttctatcttttcccacattttaattatgtttatgtttttgtgggcttcccagcacattctagcttttgtacattttacttacattctgtagttaaatgaattctggcataaacaaacaggtaaaacaagtacttaccagtaagataatttctctgaaaacgtttatccagtcacattagttctattaccatgtgaagttttaccttcatgcctctaatttaacataagctaatccttcccttctacaccaacctaccaaaaaactttatctagaaatattgtaaaaaggagactgtattttgatttatgttcacctttttaatatactttaaaataaatgtgaatttcaaattgagttgtgtttaagtggacagtgccttctagaatgtcagaaatcttttctagtatctcatgggaggaaatatttaaacactcaggaaacaatgttaaaacatatttacttaagttcattgcatagtttatccatctatgataaaatccctttaaaaattttaagaagacacaagacatatttgaggactcaaatttgatcatatattgttcttctaaattacacttattttccccaagtgatgtatcatatatattatatcactgtgttggtattagagcccatttgcagttaattgctatttccttacctttagtgcctgtctgcaagtgttcaaaaatctgttatgtttttggaaaaccatttaaggctataccagtttgtataaacctttgcattctaattagcaaatgttatgttcagaaacagtgcaaaattcactattgctcagtattgctgtatctatgattatgattatttcatttttaggaacaagaactctatcaaaaagaaggtttaggtgttaatgaagtgcattatgtggataatcaggactgtataggtatgtgttttttaactccacctttgaaaaatataggaagatgtagtgaatgtgtttagtgctttttctgtgctttttaattgacattacttgttatatgacttgaaactggtatttgagagaaggttacttctgtattactgcctggaagttattttttccaccaagacttcaaaggtatctttgttggaagttttctataatctcttctatttattttgaaggatgttttcctatttaaatagttagcatgtgaattggttaagggggaaacttaattgcctagtcagtaaagacatttattcacctgaggaagtccatagttaggccaggctccaggcaagtttgtcagggtttgccctgcttttctgtgattctcttgtttctgctgtattctgtgcattgacagcatcctctaactggttgcgagctggcttcatgtgtcacagccagataacactgcgcagcaagagaatagaggctctgctttcattttagtggtaaagaaacctttccctatagccgcacagccagttttcagtcttccatttctttcccaccccatctctaaaataaactgttgggcaaaccttgtttttaaaacagtttgataatcctgtcagtaactgatgtgctggatttgaaaaacatagtataataataatactactttacatcagtataaattttcaaagcactttcacatttcacttggtccactccacatttccttaacacacggaccctttctaacctctgagtctttgactgtgtggtttgatatggctggaactcttccccttccatttgtctttcagcccactttcacctcatgctacatctatcaaaatactcccatttgtagcttagttcagcatgcccctcctgccctaccactaattacccaagaagcatcattttctcactaatgtagttagaatctttctcttcctatgtcttatagctttgttccacttaatcattgttatatactgtattcaagcagtttacattttatagttagttttggacaggaaggaatttcaaacgaatggaaagagcgtaaaaatgtgttgttacagattttgtttgaaagcgtttacatcagtttctaaaagtattattaaaaagctatgcatgtagaagtttctgtagttttactttactttgaatatagctgtcatttcgaaaaggaggaatttccaattccttagcctcttctcctggtttacaaatggaatggttattatagtcatttgctttctttatgtagtagcttttctaaaacctatattaaatatatactgttacttttttataaacggccagatttgaaataaaaatccgtcagctctctataacttttgagagaacacatatagaatcacatgctatgttgtttctgatcagtccttgaaatctgtgattagtgaattgttcacatatctttaaaatgttatgtttttacactattgtgagtgttttcattttttgaaatagatttaattgaagccaaattagtgggaatactggatattttggatgaagaaaatcgccttccccagccaagtgatcaacactttacatctgcagttcaccaaaagcacaaggatcattttcgactcactgtgagttttgccattctgaaattgagactatggtgggacgagacattattaaaaaggtgcattagctattagatattactagataattagaataaaaattatggcgtgtatagagcaactatattatatccagcacagtatcttccttagatggatggatatttatatatgatttttatgtagtcaagagactttttctctgatgaaaagtacatttcacctgtctaatacgtacaatgtgcctgtagtctgagatactagggaagctgaggtgggaggacagcttgagcctgggagtcgaggctacagtgagttgttagcatgccactgcactccagcctggccaaaagagcaagatcctgtgtcaaaaaaataaaagtacaatgagaattacctgctgtcttcatggtctcccttctgagctaagtgggtatcagttgctttgttttgtgaccttaatcacattccaggagttggcactcggagtcgcaagcagccatctgtctgcttatttgtaagaccagcagttaaggttgtggcttagaactcttgactggtgcaggcaatacaaattagataatgatcagccaattcattttgaccctctttcctaaggagttttgagtggaaaatacactcagagagggaaattgaatctgaagcaatagagagattaggtagagtaaagagaaaagcagacagacagcagtagaaacaaatgagaggtgcactctaaaaggccagaagacctggtttctgttttcctttcttttttttttgagacagagtttcgctattgtcacccaggctggagtgcaatggtgcgatctcggctcactgcaacctccgcatcttggtttcaagtgattctcctacctcagcctcctgagtaactgggattataggcatgcaccaccacgcccggctaatttttgtatttttagtagagacggggtttcaccaggttggccaggagagtctcaatctcttgacctcatgatctccctgccttggcttcccaaagtgctgggattacaggtgtgagccaccgtgcccggctcagaagacctggtttctgaactgctgttaggtcgcagagctgtgcttgagtctttagagccattttccatgagggtggactgtgtggctattgagatgtttcctgtgttcacctcttctgaacctgtcttttcattcagccattgttacctgaggtaataaaagcacagctccatccttgtacccagaaagagcctggctagcacagacaatgtgctagccacacaaatggatgtcagtttcgaccacaaagatagttgctgcctcatctcatagacaacatcattaacaacaacaacaacaacaacaaacaggagagtgaaaaagaaaagccgtttagagttgcctagtggaattagggaactaataggcaaaattgcctctcaaacaaactgtatattattttgagattgtaacatagtataatgattattgctttgatgaatccagaaacttaagtgaatggtaacaagtagttttgtttctattcatcattaacaaaatcagtggtaaataggtgaattggatttacctgaaaagctcatgtaattgtgttaaccttcactagggactaaaatctcacatccacctgctccattgacttgcaattcttctgtatccctatatatttcttgtaatgtggaatctatttctgttacttcagtggagatagaaataaaacaatatgtatcctcaacaaaacttctgctaaaattgaagatatatatccaatcctattccttaatagctcgctggtctttgttatgaccagcctatggatgcatgattacctttaccaggagttggcacctagagtcataagcaggtgacttaccaggggcactaattgctagtcaacagaattgtcacgagtgtctcagaggcatgtgacttaaaagacagtaaactgaagcatcaagaatggaccttggctgcttttgtcaaccaagaacaagagtaaagcagtaaatcctattttatataggttattccttttgttgtattttttgaaaataaataaaataatcatttattgaacacttagatgtggcaggcactattctaatgtttttacttgaattatttaatcctgttagatgtgtatgctacagatgagacatacaaggagaggttaagtgacatgcctaatatggcatgtaaagaaatggtaggttgggagtcaggctaggcactttggctgcagagccggcactctgacttgtcctggtgtattgcctcccacagggaacagcctctctgttctgctacctctttaaccttgagcaagcctctaaggttcccaagtcagttttctcaattttatttttttgatttttctttttctttttttttttgtagagacagaattttgctgtgttgcccaggctagtcttgaactcctgagctcaagcaacccacccgcttcagcctcccaaagtgctggaattataggcatgagccaccgtgcctggccagtactaactgggcctgaccctgcttagcttttgagatcagatgagattaggcgcattgagagtggtatggcggtagactctcaattttaaatgatgtcttttttttttttttttttttttttttgagacagggtctggctctgttgccctggttggagtgcagtggttctttcttggctcactgcaacctctgcctcccgggctcaaaccatcctcccaccttagcctctcgagtagctgggactgcaggcctgctccaccatgcctggctaattttgcatattttttatagagatggggttttgccatgttgctcaggctggtctcaaactcctgaactcaagcattccgcctgcctcagcctcccgaagtgctaggattataggtgtgtgccaccacacctagcccaacatcacttttcttacccttaggttatttcaagggtcagatgtgatcttgtaagtgaaaacattttagaaactttatgatatacatgtgagatattatgattaaatggtacaacctaaaatgatttagttttcttgaaatagattcaggctccttgtgtaaatatgttaggctatattatttgaaacggtaggagagtccctttgctgatgtcaggtgtttctttgactggctgcacatggaaatgatttgatataaatggtatgggctttgggatgtttaaaagttctccaggttgatccttttgtagttcataagcctgatgattggattttcatgctcatgtgtgcgatcttcctccctcagccttgttaatgtgttggcacattactcatctgacgtgataaagatagattttaaaaagttatccaggtaattctaatagagcaccaaggttgagaaccactgctttagaaataggtggttaactctgtaaaatgccaactgggttttgcatgtgcttttaaaaaaaaatttttttattacaagcatgttcttttaaattgtgtttttttttgggtctctttctctccgtctctgtctctgtctctgtgtgtgtgtgtgtgtgtgtgtgtgtgtgtgtcttacacctattttctttcctaagagattataccaaatatttgctagattttattgatactttaaggcatactcaatacataaaagcagtataattgtgaaaagtgtgaaaatttcctgtataattttaagtgttttacatctcagttgttttgtaaagaatgattatgtaatatatttttgatcatttaataactcatatatgtattgtttttcagattcccagaaaatctaagctggcagttcataggaatatcagagacgacgaaggcttcattatcaggcattttgcgggggcagtgtgctatgaaacagtgagtataacttttacaaggagaaaaccatttcatgttgaagctgcactgtacagtatgatagcttctagtcacgtggttattaattatttcacgtggttatttaaattaagtaaaattacaagttcaattcctcagtacactagccacacttcaggtgcccagtgtccacactgactagtggtgacggcgttggacagtgcagatacagaacatttctgtcatcacagaaagttcctttggacagagccatgttaagtgatgttatcacaagatggacagaaacattcctgtttgatttatttttcagacccagtttgtggagaaaaataatgatgctttacatatgtctcttgaatccttaatatgtgaatccagagataagtttatacgggaattatttgaatcatccacaaataacaacaaagatactaaacaaaaagcaggaaaacttagcttcatcagcgtgggaaacaagtttaaggtatttgtgttatttaattttttttttactatatttaaaatgaaattattgttttatattctaaaatggataatgtagatcactgtcagaaatctcacagtgaagttcaagagcagaccctgcattgttgatatttgtatgtaaaatatcataatgtaggcctagtaattgaacatacagaaatgcttgtaattatctgaatgtgttcattcttggttcttaacatatctgattgcctctcctaatgttcttgcttctgcatactgtctggttgaccttcaaaccttctctttcccatgtgttttctgtttccttcctcattcagcggttttgttttagctggagtagtccagctcgggatggctagagaggactagttgagttgagagaggaaagcaggcacagccaggggcttcaggtaaatgatcgccttcatggactcctatttataaagtggctgccatgttaaaaagagcccatctgaagttaatgattcagtttgtaattcattttcaatgtgtttctctcacaatggcattttgggtgtgcatattacactaaaatttgattaaagcttttaataacttctgttaaagataagcacttaggtgtggcaaactcttcaaactgcttatttaacatggaagaatatttcatttgttttattaattttggatcaggaatttattcttcaaggtctgacatggaatggcacagggtttgtcttagaacactactaattggttctagttattgaggagtgtagaaaaaaaatgttaaaatttgtgaagttatgagtttaatgaatgacaaactatagtatgtagaacaaaaaatgtatacgagagaattaatttcttatatatttctacagagtattattgttatatttataataaaactctacatttgcctttcactatatgtactttaaatatttaaaataatgtaattaggaaaaagatttaagtgtctgaatgttatggtactgataatataagcctccccaaatttattttggattgaaatgggctctaaataactaaattgataaaatatttataagagctagtttttttttaagcttaaacataaatatagggaaaaacctcataatacatttttaggtaactgaataaaaagccttgaattttgttataagttatattcattattatgagtttctgattcagtgaacaatcttttttttatttgagtattcttctatttctgaatcgacatttgatagcagattggtttaaaaatagtatatttgcctatatgaaatggatgtcattcactattttcctactctaatattattgtagtattgctgataagagcatacttgaaattttagaaaatataaataaagacattcttacagtttttctttggattacataatcttttatgttgagccttgaaacttcttataattgcttatatttaatacaatgtatttttttacattaagccactgaaagtgatagctgaatgatactaataataaaatatttcacgtttttctctgagataccttgaaatgaaataggaatagattcctagttttaaatatagtagaatagctcattaaattaaaattgaagtatataaggcaataaacacaaaacaggctatcatttacagcaatacttcagttatccagcatccctggaaaccagaaattttctattggaaagtgcctttttcaggttattgaaacataaaccctttactgttagtgttttagaaaaagtcatcctttttgatggaaacataattctattataagaatatttgtatgttttcaaataaaaatacaaataaagcatgagttgcctgaggctttttactcttaagccttatggtccttggctgttctttgatagttgactttcttccctcttttctcagctgctaagagtttattttgatgcttctgttcttttgactttatctccattttttttttttttttttttttttttggagaatactgtgcttagtctgtggatgaaggagtctggactttgcgacagttattttctttccaaattagtcactttaatacttttcaggcatggtggttcagattgattacggttgtcagaactctgtcagtgagataagtgggatacaactgtatttctttaattcaatgacaaatccattccattttaataacttaagcttctcagtatatgtgatgtatactgtaatagtatcactcacaggagaatgaaatttggtgtcaggccgatgttggaatcatgactttgccattattagctccgtaacctcgggcaagttatttatttccttggattgtcatgttctatccttaattagattaaacataataactcctgtgaaaagctttgagcagtacctgacttatagatgacattcagtaaactatacttactaattatagctatgattaatacaatgttagtttaaaaattaacattagtcttttgtaagtagtttaataaatacctcagtataaaatccagatagaaaaattttacataattaacttattttgcagagtagtaaggcaaataaatgattttaatacactgaaccacaccacatcataatcaatgttataaaaacaagaaagcatagtaacttgtaatgttcattgtcaattttttttgagaaaattgtccaagcatttaaaaataactgaaatgtaaaatgttttaaaatgttaaagaggcagggtgcggtggctcatgcctgtaatcctagcactttgggaggctgaggcgtgtggatcacgaggtcaggagatcgagaccatcctggctaacatggtaaaaccctgtctctactaaaaatacaaaaaaatttgctgggcgtggtggtgggcgcctgtaatcccagctactcgggaggctgaggcaggagaatggcgtgaacccgggaggtggagcttgcagtgagcctagatcatgccactgcactctagcctgggcgacagagcaagactccgtctcaaaaaaagaaaaaaaaaaaagttacagaggatttctatagctaggcaggacaattttgtttacactaagtgttccataaaacaatcctaatatatactattagtgtatattttaaacatgtcttcattcctaatgtgtgtgacacaaactacagtttgccacattcaaagactgtgctattgatctcttattaaatgcatcctcactattttcatttacttccttcattgcctgtacattttttcctcattcattccatctgcaaatatgtgtgtatgtttttaatattgctaattttcagtcttttaattatacaacttctgtgtaagttattgttcttgcattacattagccattttgcatgatgctgtctgttaaagaatttgtgtaccaggaggttgttaaactggaatgtgttgtatttggatgttattgcatgttattttattccagtactggagagctaatattaactcatgacactgtgtactttggctttttgaaataataaactgatttcctttctttcacagacacagttaaatttgcttctggataaacttcgaagtactgtgagtatgcttaaaaagaaaacaggtttttatgggtcatctaaaactattattagtaattatgcaagtaggcatagtaaccctgtactaattaaaaatacattttaaactttattctcttattttaaaaaattagttttttttctgaagaaaggtcaaatatatatgtgaagtcagattattttataaatatatagaattcttgactatttaaaaattaagattatcttacagtttcaagaaagtgaaaataagtggtaatagtggagaatttttcttaggattaaagattagttatgaaattcaatcttattttattactcttacagtaacattctccagacatggcaatgttgatgtggaaaaaatggacaaaatatttttgtgccctgctatagagacaaaatttattagaagcctgttttttaactatacattttagtaattcaccccattttcttaaatgagaaaaacatcatagaaagaaattatatgtggtttatataaatgaagcatgattccaaagtaagacttattttttacacaaatccacagaacttgaaattttgtttttgtttttgagacaaggtctcattctctctcgcccaggctggagtgcagtggtgcaatcacaactcgctgcaacctccgcctctctggttaaagtggtcctcccacctcagcctcccaactagctgagactacaggcatgtaccaccactcctggctaatttttgtattttttgtagatatgaggtttcgccatgtttcccaggctgttcttgaacccctgggctcaagtgatctgcctgacttggcctctcaaagtgctggcatttcaggcgtgagccacggcacctagttagaacttgcgtattctttttcaaatagtcattttgaatagctagacatttattatatcagtattattgttgcttaacttactgttagattaatttttggaaccattaaaaatctttttaatatcctctttggctgcaaatatctatctcttaaggccatgtatatttaaaaaccaaatctgatgaagagagtatttttatttcttagatagggtgctgctctaaaattatgagattactttgtgatttatagaaaaaaaagcatttctaaaacgtgttctagaagtgtctgtgggccgggtgccatggcttatgcttgtaatccccagcactttgggaaggctgaggcaggtggatcacctgaggtcaggagtttgagaccagcctgcccaatatggtgaaacctcgtctctgctaaaaaaatacaaaaattagctgggcatggtggggcgcacttgtaatcctagctacttgggaggctgaggcagaagaatcacttgaacccaggaggcggaggttgcagtgagccaagatcacgccactgcactccaacctggttgacagaatgagactctctctcaaaaataaaaataaaaataaaaataaatgaataaataaataaaagtgtttgtagggagcttcattgttgaaataattatttgcaaggtaactactttgaagagaaacagttatttggatgtctattagcttcagtactcaacaatacgtttcattgtatacataatcagtattctttctacctcattcagcataatctgataattgattccaaatgaatgcctttaagctttaaaaaatattgtttgacaaacaaatgttaaaatgtacaacagtgcagcttagggacctactgtatgtttttgaaatagaatgattgaaaatattgttttgttttcttttacactttggcctaagtcttaaggggcataattttatttactccttttgtcatagggaaatttccttatcatagaaatatggcatacataaatacatttaaatatagaaaaaaatcacatgtacatcagcctgcaaagtgtgttgtttaaatatgttaaacaattaaatgtgttaaactttacagtgaaagacttctctttttacagtttttgacattcaaatctaaaatgtagtatttttgtaatattattaattagtaattcaaaaagtcattgtaagctttaaagcagaaaaagtatgcttgtaaaattttgagttttttttttttttgacggagtctcactctgtcacccaggctggagtgcagtggcgtgatctcagctcactgcaacctccacctcctgggttcaagtggttctcctgcctcagcctcccaagtagctgggattgcccaccaccatgcctggctaatttttgtatttttagtagagatggggtttcaccatgttggccaagctggtcttgaactcctgacctcaggtgatctgctcatttcagcctcccaaaatgctggattacaggcatgagccactgctcccagccttgagttctttagtaattacttttacaggttcatatgttaatgttaatatgctttgaaagttgcaggtattcatagaaacagaaaactaagaatgctatatgtattgtaacaaaaagtacctttattttcctagggagcaagctttattcgttgcatcaaacctaacttaaagatgacaagccaccactttgaaggtgctcaaattctgtctcagcttcagtgttcaggtattttcataatctctgtcagtgtgtgttagtagtcatagctcaaatacaatttaataggttcagtattttcaaataattcaccattatcttgattattttacagtgcaataaaattttcatcttatattttctttaattataagaaaagtatagagccacatgtggtggtgtacacctgtagtcccagctacttgggtggctgaggcaagaggactgtttcagcctgagttcaaagtcagcctgggcaacatagcaagatctgttttagaaaagaaaagaaaagaaaagcatagatggcaaattatttgagcaatattgagatgttgtttattgtgaaataaacaatttcacattaaacatttatgaaaactctctaacagcaaaactggatcttccttaagtgggcagctttctcaatccagcagtagttcatttctcattccacacatgatggtcagaaggtaggttttgttgtcctttcttcccactccacgacttgtaaagaaaatgaaacacgattccctctgcatctgtgacacttcatccatttgcttaaactatcacttcctacccctcaccctgccatgtctgaccttgctcaggcaccaggcttgctctgtttgctttatgccttgcccatcctcccttctcaccaacactacccctaatttttcccaaggtatcagccttctcctttcttgtttaccttttgatccaactcagcttcctgacacttccttaaactttcttctctgactccttattttgctcttttgagaggtagatttactatgaagctaagattacttaagcttcagggtccttcatttaaataaaccccttccaaagccctgcatgtaattttctgcttcgctaaaggcctctccccaactatataagcttcagcccccgcctcacaaatctagatctacccttgacctctctcacaaaaccatagctattgagaaatctaattctgttctttcttattgtctgcacagggttggtagacaagacaggatggcaccagttaaattcatcgtcattatctttaaagggctctcaaacctgtcctgccaagttttcctggtcagcatgttctgtttctcatcagagactggtcagacccatcctgctttcctcaaatctctgcgcctctgctgtcagatgggcttacctccttaactaaatatcctaaagcttctcttgtctgctatcaagcacttctgcctaccacttaaccttccctcttgttgagaaagtaggggttgcctctctgcctggttgaggcttatagttctttgaaagccatctcttcctagtttttcatggatcttcagcattgtttatgtttgtcatactattccctttcagatggatctttcccattaccatttaaacatgctgaaatctcatctctaagccacatttctcttacagctacctcttcctccttatttttctccagttccttttctctccaagaataggttattgttgctttttcagtttcatgcattctacttactctttaactccaggataatttagctcccaccttgatgaggtcaccagtgattgccttgttctgaagcaaatgtcccttttgcagtccttattttagtggacttcatagccacatttgactctggccaacccttttaacatatccttttcttggttcctgacatggcgtatgcccctgcttttcttttgaattctctgaccattcctgattcccctgcaggctcattttcttctacctggacatatgttatcatttttcaggatttaagttaggcctctttttcttctcattctatgtcagtactgtccagaagacctttacatgatgatggagattttccatatctgtcagtttagtagccatgagacacatttgactcctaagtacttgaaatgtggctaagaatgagtgagttactaaattttaaattttgtttaattaaaaatttttttttggttgggaggggcagggtttattctgttacccaggctggagtgcagtggcacaatcatggctcactgcagcctcaacctcccaggctcaagtgatccttctgcttcagcctctcaagtagctggaactagaggcatgtgccaccacgcccagctaattaaaaaaaattttttttgtacagacaggatctcactgtgttgctcatgctggtctcctggtctcaaactcctgggctcaagtgatcctcctccctcagccttccaaagtgatgggattataggcatgagctgccatgcctggccttaattttaatttttaaaaatttaaatttaagtagtcttatgtggctagtcccgctgtagagcatgtggctagtgactgccaagttgaacagcacagatgtgtattcccttaggtaggctccccagttctgctattgtaaccttctaaatagtgagtcctgatagtctctaatccaagctgtcaccatctcttacctggatttttgctgtagcttcctaagtattctcctatctcttcagtctgtttttcacatgcatccagaattatcactccacaactcatctctaatcatcatgtccttttactgcttaaaatgctctaatggcttcagatgagtattagggtgaagaggtcccatagagcctggcccgtgtgtccctagcttcatttgtttacactctctccctcccttctctccttcagtcaccctgactttcattttcattccctaaatgctgcatatttcctcccagcacaggacctgtgcacatgctgcctcctctgtttgggatgttcttgctatactttttcctttatctttcacatctcagctctgtcatcacttcatatgaaagcttttcttgatattcctgacatggaggggagcctgaatttggggtgctgagctcaagtgcctttatttcacagttgtagttacaaattttatacatatttgtataattattttatttttccctcctttattccataagccccatgagggtgggaactgcatctgttttggcttacacatacattcctatttccctggcatatactagactcagtaaatatttgttgaatggaatgaacagtgtagaaaatatgaagatttatttgtgactaatgctaacaaatactggaaaattaagtaattcatgtctgttgtattcttccataaagtagagatgtatttttgtaatattcaagtccatttttttccccattggaattcctctttatttcctaagtgaacacctagtgtcctggcaagttgcacctgtttagatttagctatatatgctatcagattagtggagagggtataggctactgatgaatgctttagctaggattcctctttcaataagcagtatatttcaacatcttaagacatgttggcactttaacagataataccaattcattatactttgatttttttaagtatcaataatagatatcataatagtaataatgataatgatatagaatttgttccagtcatgtagctaggtgatgagaaaatgcaaaaatccataagttgtagaaataaaaatatttacgaagctttctaaaataaagatatttaagatttgaattgtactttaactttccattttcattttaaagagaattaataaatttaagtcaccttttactaaaattactatttttttttttgagacggagtttcgctcttgttgcctaggctggagtgcaatggtgcgctcttggctcaccaccgtaagctccgcctcccaggttcaagcaattctcctgcctcagcctcccaagtagctgggattataggcatgcaccaccatgctggctaattttgtatttttagtagagatgggctttctccatgttgaggctggtctcaaactcctgacctcaggtgatccgcctgcctcggcctcccaaagtgctgggattacaggcatgagccaccgcgcctcgtcttttttttttttgagacagagtctcactctgtcgcccaggctggagtgcagtggtacaatcttggctgactgcaacctctgccttctgggttcaagtgattatcctgcctcagcctccccagtaggtgggattacaggcgcccaccaccacacccggctaattcttgtatttttagaagagactgaatttcaccatgttggccaggctggtgtcgaactcctgagctcaaatgatctgtttgcctcggcctcctgaagtgctgggattgcaggcgtgagccaccatgcccggcctaaaattactatcttctgattggcaaataccagggcaaagtaggggaaggtgaaagaaggcaagttttcttcttctgtaaccttggggctgtgctgcctgtcttgtagcaaagaggggtgccagctctgcaccgagaagccactcatcaaactccaagagtaaaagccagttcatggaaatgtttagaaggcagagtatttgccttagtggttaaaaaaaaaatttaagcttcaaaacatcttaagagtaaactagctgcaagtgctgagaaagcagttgtaggcttggtaatttgttaagcaccatgaaattcttaatgaactgtgagccagtttatagtttgcagctacagggcaagccaggagacttagatgcatacatttccaaaggtacttgtttatttgatacaagtgggcaaaaactgtgatgatactaaccaaactttacttttctttctccaagcaaagcctagagctaaatctagttctggagattttttttccccatacgaatgatttctttaatgtgtttcattaattaatattgaaaattcacagtaacagaaattaaatagtacagaataatataagtaacaagaaatctcagctcttaggggtgaccacttaactctacgtcttgggtatattttttatgctggttagattaagctctgctttattcttttaaatatgtcatatcccatcatatggttgtaacataatcaattgagattttagtttttttctggttttttttctattaccaacagtgacccagaggacatctggacattgtccacatgcatatctttgcccacaagtgtgaaaaatcatagaatagatttaccgagccaaagggatatttccaaattgccatccaaaattgttacactggcttacttttctgctaagaatgcatctgtgtgttttcctacactgtcatcagctctgagtactagttgttatcttatacctttgccagtcaaatgggttaaaattcaatctgactgtctgtaaaggccatctttcctgtgagattactttaaaataaaaattcactggtttaaaaagtcttagagtttgttttaatttaaatttttggctagcaggaatttattttggtgtaagaagtgagacaaggatctagtgttgtttttgttttccaaatggcttgccgtttgtcataatactatttattgaataatcttactttctccgttgatttgaatagtcccagagactgaaatctaggtcttgtaaataaaagtcctggcatcacttatagctcagcctttccctgcctatctcacactttttctgacctgaaaagctcacattgactcaagactcagattaaccacttactagagttatactgaaaatagatatttatccaatagactaatcatcccagtagtctagttgctttgagaagtgagtgaaaggcagtctttatagtgaaacagtgagctcttctttcttttccatttgccttatgcactgatgataacttgggaatgtatctactttttggagtttctttcaggaattttgttctaaaattcacctcaggcctttgaaagtggtttaatgcagggctttgccttatatactgtgtttgtgacacagagtcttctaacagaaaaaaagatacaaactagacttgatctttccttagttttgttttgttttgttttgatacagtgtctcactttgtcacccaggctggaatacagtgtcctgcaaggctcactgcagcctccacctcctttggctcagatgatcctcctgtctcagccccctgagtagctgagactgcaggcatgcactagcatgcctggctgatttctctattttttttttttttttttgtagagatggggttttgccatgttgcccaggctggtcttgaactcctaggctcaagcagtttgcctggcgtggcctcccaaagtactgggattataggcatgagccactgcacccagttagacttgatctgtctagagaccaataatttgcctctagaaaagagtcttattgggtttacaggaaatttgactatagtagttttaggtggtggataagttgggacataatgagcataaatattttcctatataatatttagttgctgataattctcataaattgcccgtttctaaacagtatcttacaaaaatgatcattcacaaattattttggacttccgaacagtgattgacagtgctttgtgcttgttcgtgaatctagggatggtgtctgttttggacttgatgcagggtggttacccatcacgagcttcatttcatgaactctacaacatgtacaaaaagtatatgccagataaacttgcaagattggatccaagactattttgtaaggtataaatgccacccaaattgaaatttcttagctatgaacttgtcttttctattaataattgacatttaactttttaacttttatttttcaggctttgtttaaagctttgggcttaaatgaaaatgactacaagtttgggttaaccaaagtattttttagacctggcaaggtaaatatacattttttactttaaactgtaacatcatgaaaacaaatagttggggttagtgaatatcttaaagtatttaataatttgtattattcttgaattatatggtcactaacaacatgaattgctattttccataccatttctcagaaaagaaaaaaaagttgagaggaagataattatatataatgttcataatttgtttagctttactcatacatatttattctaaactccccatttattttagagcacaggtgtccagtcttttggcttccctgagccacattggaagaagaacagttgtcctgggccacacataaaatacaccaacactaatgatagctgatgagctaaataaacaaaacaattgcaataaaaatctcataatgttttaagaaagtttatgagtttgtgttgggcctcattcaaagctgtcctgggccacatgtggcccatggactacagcgtggacaatcttgtcttagagctttaataattatttgagaactaatagtctcatagagaaagcactttttcttgtttaaactcctgaaaaattagaaatatttattgaaagcttaagacaaagatttaaatatcttttctctcgttatgttacctttaatttaattttgactataagaagccgttatattggttgatgggtttttgacattcttaatattatagtgggttatttggtaaaggattgaaatcattatggaattttgtggtatatagtggaaataatgtattttattagttaagaacctactagctgttttatttgtgttgtctgtcacttagtagcaaaaatttctcatctctgtttaaaatggaaatgggggttgggcgctgtggctcacgcctataatcccagcactttgggaggctgaagcagtgggattgcttggttccaggagtttgagaccagcttgggcaacatggcaaaacctcatctctacaaaaaaatacaaaaattagccgggtgtggtggtgcgtgcctgtaatctcagctacttgggtggctgaggtggggaggattgcctgagcctgggaagttgaggctgcagtgaaccaagattgcgccactgcaaaaaaggttgggggtgggtaatgggagttaggagagacagaataattttggcggtacctggtattatatagctaatatgcacttatcaaaagctccataaggatatctgagaatgtgggtgagccaattcagagatacagtagtcctttttcattcttttcttaataaagtcttctcgctagccatctgtaatttaaaagtcatcccccccccccacttttgttattgaatatgctacctagcattaagtaacctccttacctccaaaaaagctcctgaagaaagaaaggaagcaaaacgtggccaagtgtgtttgtgtttgttgtattctctgccaaggcctatgtaattgacatgtgaccattttcagacagttagattttggatttgaattctgtttacatcatgtctttatgtgttcaaatgcatttatattttaatactgatactaaattatttcacttcctagtttgcagaatttgatcagatcatgaagtctgaccctgaccacttagcagagttggttaaaagagtcaatcactggctcacatgcagtcgctggaagaaagttcagtggtgctcactctcagtcatcaaatgtaggtgttttcctttacacctataggatctttcattgtttcaagatggtttgtggagtgttgtaaagctgtctcagaggtgatgctgagcaacagagactgagacttgttcacactgggtcccaggttcctatttgtagatgttctttctttttttattttttgagtgtatgatatttattttctttattcaaatgtgttataagagtgtcagtttcatagtgtcctaacaaaacagaattcactatcttgatctctcgtccccgcacccctcaccatcccctaatctctcagacttaaaccagaacttttctttctgcctgcatggcatctacaatacacataccccgaaaattctaattgtaattgattttcctttcttatccctgaaatattgtcagtcaccagatcctgttgattccttctccaaatactgtacattcctttctttttcttgccagtgccttagtgaagtccttttccaccttttgcataataattccattagctcccagactggttttcctggtttcttagagatatctctctaaactagaagccttttataactttcctttcataaaaggtgaagtctaaattatttgatgtctttcaagatcatgtaaaatggtgtgtcagttttttgtttcagtctcttcccccaccatcccctcttaaatcctgttttttgaacggaagtctgtcataatcctgaaagacactgtcttgaacaccataatcccaaatgttgaaatcttaaaagatgaaagtcccaaaactaggattctgtaaaaataataaaaaaagatatttatttacattttaaaaaggggatttgagaaacgtataaaaacatgacagaactcttcataggccacttttcacaataaaataggcaataacatatatataggcaataaacatatatgtttattgaaactataaacacatatactaacaatagttgcatgggtataacaggagcagacaaaccgtattcataaagaatagggcgaaaggtgaaatgcataaacacatattattgtggttggtaattgtgcacccagctttgttactgcagtcatctgaaatactgtgatgatgaacaagctgtcttttgatgagatcagtcaaaaaccatagtgagtcaccactgcatttgtagttgcccagagaactgaaatcttgagaaattttatcttttacaagtgcagatgtatgataaaggacatctgttcattgattaagtttcagtgtttttatatacatacacaatgtttacccagaaagtaaatgttgtggtaatgcattttcatggagttaaatttgcaaaaaatgaatacagtaaattagaactctccaaaaatttctacataattaaaaaatgctaacaatttaagatagtgaaaataaaaacaaagaaaaaaaaaacacccaaaactaaaaaggaagtttgacataaaaaaaagtgtatcacagggacagattataggcagttgcatggagatagtccatagagctggctgtctttctcagtcattaactatattttgaagtcttgtaccacgaataataggtgctttttttcttttaggacatggttcttggagaatatgttcatattcattttcttcatgagattgctctttttggaattcttctgtgattcctctgattgggatttttaggatttttgatgttagggattttaatctaggaattttgatcttttgggatttcaacatttgggattatggcttttgggattaggaattcaaacccctttgacatactgggctaagctgcttttatgtgtggtttggccaggtcatagcagctacatagctggcccaagacaaaagtgagggacagaacattttggggttacctaaggatctgtggcaaacctttaattgttgggagctgtgtaggaatcagtaacttgattacatttacagttgccccttatactcatcagagtacctgaaatagtgctaggtacatgaaaaggatccagcgaatttttccttatcagtagaaaaggaaaattcttttggcctaatgaaaaagaatcatgctaacaaagattatttttgaggtattttgttagacaattgtgaatatagataaaaagagaactattaatataaaaagaaaaaagatagcagaatcttttccccatcattttccaaataaaatacagaaacatctttattactgtagtttaatacgttcagctttacacattgcattatgataggaaacacattatagtaaactcatctgttacaccattcatttgtggactgtgttctacagtggtaccgaagtcagtaaccgggcagggatctttgcagaatgttaataggaaactctgaaaaaaaagttcaaggtcagatcatcctaggaaattgtgagtaactgaagttaagtagatttctttgctgtaggattctcagaggcttcactcagtatgttcattgtgaacctccatacagaagtatagtgtacagcttttcataaactcatttgacaggtaaatccttttttcaggacatacctattcacatttcatagaacaaatgttgcctaagacagtttgggaggtagcagtgtagcatactaaggaaataatgcatttaaaatgtaagcctaaccagatacatgatattgtaactgcccagtgggttctccttgcccactacccagacagagctgatttatcaagataggaattgcagtagagagacagtaattaatgtagagtcggctgtacgggacactggagttttatgattactcaaatcagtctctctgaaaactcggagatctgaatttttaaggataatttggtaggtaggggcttgggttggagatgaaatcatagggggtcaaaattgagtttttcttgcttgcttctgttcctgtgtgggagcacagaactggctgggccggattacctatctaggtggcatcagctggtgcattggaaggtctgcaaaatatctggagcactgattttaggtgttacaactgtgatgttatacctgggagcaatttgaggaggttcagattcatgcagctggaggctgtgtggctcctaaaccgtaatttctaatcttggagctaatttgttagtcctacaaaggctgactggttccccaggcaagaagggggtttattttgggaaagggttattatcatgtttgtttcaaagttaaactttaataaactaagttctttcccaagattagttcggcctacacccaggaatgaacaaggacagcttagaggttagaagcaagatggagttggttaggtcagatctcttttacataatttccttggttgtaatttttgcaaaggcaaaattacatctttcaacatctttttatttttaagaagaataagaaattatagaaatgttaaaactggctgggcgtggtggctcacgcctgtaatcctagcactttgggaggctgaggtgggaggatcacttgaggtcaggaattcaagaccagcctggccgacatggcaaaaccctggctcgaataaaaatacacaaattagcccagcatggtgtgtgcctgtagtcccacctcacctactcaggaggctgaggcatgagaatctcttttttttttttttgagatggagtcttgctgtgtcacccaggccggagtgcagtggcacgatctcagctcaccgcaagctccgcctcccgggttcacgccattctcctgcctcagcctcccatagctgggattacaggcgcccgccaccatgcctggctaattttttgtatttttagtagagacggggtttcaccgtgttagccaggatggtctcaatctcccgaccctacgatccgcccgccttggcctcccgaagtgctgggattacaggcgtgagccaccgcgcccggccgagaatctcttgaacctgggaggtggaggttgcaatgagccaagatcatgccattgcactccagcctgggttgagactgtcaaaacaaaaacaaacaaaaaaggtgttaaaactttgtttttgatgtctgatatataataatatggtcgtcaagatttcatgtttcttgagcattactttgtgaaaatgagtttttttaatatatgttagatttaaactgaataattttctatcattttattttactcttacacatagtgaaaaacaaaataaaatatcgagctgaagcctgcattaaaatgcaaaaaactattcgaatgtggctttgcaagaggagacacaaacctcggtaagatgaatagttcctaaaaagaactctacaaaacctagttactgtaatacaaaatgacaataaagtcataataaaaagcagtttggatactcaggttttctcatgttctttgtaaaatgatgtattagtcttttatttgtaatatttatttgaagttagttaattcatttattaccttattacttgcctcattctataaaaggatttgaagtggcatacaaaaatgtgtaaagactataaaacaagaagtaagtagttgagagaagctcttttattctgattattttagttatttgagtttcttgataatgtcaaggtgacattttttaaaaaacatctcactaatatgtttacataattttcaagattatctgtaggaattacattgtcccattataaattagtgtatttcttatttgaatctttcatttttaatttacacttttaaaaattggaagtctgaatatctctattgatccatcacaccttttcaaagagactagattaatttcctctgtgatttgaattctcaaagttgtagaaggctttaatcccattgacaggcatcagtgtcattcacactcatatttgattttttttagccttcaacaagagatctgaaaaagagaatagtagataatattgaaaacagaagtgaaataccctgtttagcattttataaatgaaaaatctgccaaaagtactaaaggatgaaattaagctctaatgaagtattatttttacagcattgatggtctggttaaggtgggcacactgaaaaaacgacttgataaatttaatgaggtagtcagtgtgttgaaagatggaaaacccgagatgaataaacagatcaagaatctggaaatttctattgatactttgatggccaaaattaaggtatgtaatttcaacccgaatgactttgactttttatgtaatttaatatattttgttattggtattgaaattgtatagaaaacgtccttagtttttcaaaattacaaaatgtgttgagactcaatgatggcaagtacatgctcatcattattacctctactctttatgtttgaaaaatttcatagcaaaaagttaaagaagacaatttttatgccatttcttctgttgctaagaaagatatccctcgcaacttaatacctaggtgatgggatgatctgtgcatcaaacccaccatggcacacgtttacctgtgtaacaaacctgcacatcctgcacgtgcatccctgaaattaaaataaaagttggaggccatacatggtggctcatgcctgtaatcccagcactttgggatgctgaggcggacggatcatgaggtcaggagatcgagaccatcatggccaacatggtgaaaccctgtctctactaaaaatacaaaactagctgggtgtggtggcgtgcacctgtaattccagctgcttgggaggctgaggcaggagaatcgcttgaacctgggaggcggagattgcagtgagccaagattgtgccactgcactccagcctggtgacagagtgagactccatctcaaaaaaaaaaaaaaatgaaaaaagaaaactaaagttggagcaaaaagaaaatggccgggcacggtgggtcacgcctgtaatcccagcactttgggaggccgaggcaggcggatcacaaggtcaggagattgagaccatcctggctaacatggtgaaaccttgtctctactaaaaatacaaaaaaaaaaaattagccaggcgtgatggggggcacctgtagccccagctacttgggaggctgaggcaggagaatggagtgaaccgggggggcggagcttgcagtgagccgagatcgcgccactgcactccagcctgggtgacagagcaagactccgtctcaaaaaaaataaataaataaaaataaaagtggtggggcatggtggctcctgcctgtaatcccagcactttgggaggccgaggtgggcggattatttgaggtcaggaggttgagaccagcccagccaacatagtgaatcgccgtctctactgaaaataccaaagttagccaggtgtgatcgcacgcgcctgtagttccagctacttgaggcaggagaattgcttgaacccaggaggcagaggttgcagtgagccaagattgtgccactgcactcctgcctcagcgacagagtgagactacgtctaaaaataaataaataaatgataaaagtaatataatactataaaaaatttggaggccagatgtgatggctcacacctgtaatcccagcactttgggaggcccaggcgcagggatcacctgagctcaggagttagagaccaacctgatcaacatggccaaaacctgtctccaccaaaaatacaaaaaattatttgggcatggtggtatgagcctgaggtcccaaggaagctgaggttagaggattgcttgagcctaggagatggaggttgcagtgaacagagattgcaccactgcactccagcctgggtgacagtgagacccctggctaaaaaaaaaaaaaaattggagaaaccaccaaaaacctcttaatacctccacattaacaaattcagttagttactgttatttttacagtataattttacttgtttttactttaccttacattctcttttatgcatacatttttacagttcttatcataatatacatttcaatttctatctctaccattgttatatacttgtccatgttaatacattatcttcatagatacgataatgtaattaattttgtgaaaatagcaatttcctctccaattttgtaggaaaaaaatgggatcccttattttgttttgatttttatttatttgattactagtggagttgaagacttttctatatgcttgttaattatatttcatatttcattaattacatttcatatcttctcattatattttagagttttaatgctttttctcagtttcataggtcagtgcaagtatgtgggatataatgaatatcttaaagtgagcgttttatattttctgcagatattttatgtaaacaatggcaatcttggaggtagaaaggaaaaaaaagatctggaggaaaatgaaaatgctataaatagactcagctgattttataaatctgtcaagggccatctttgtttatgtggtatcattataaattaaaattaacccacccacattttttgaaggctaattttagaaatccaataattttggatatattttgtaatttttaaaatattctctaggtactatttgaacattattctaaaatagtagtaaactattgctaaattagctgatcattacttaagaaataattctttttgagataagaggcttgctctgttgcccagtctggagtgcagtggcatgatctcggttcactgtaacctccgcctcccgggttcaagcaattctcctgcctcagcctcccgagtagctgggactacaggtgtgtaccaccatgcccagctaatttttgtattttatttttataagagacagggtttcactatgttggccaggctggtctcgaactcctgacctcaggtgatctgtccaccttggcctcccaaagggctgggattataggtgtgagccactgcacccggcctagaaataatttttaactgcagtatattaccttatccacagattacctgtctaattgatgtgtaatacttgtgtgcagagataacataaaacattttttgaatagtatttaatgtacaaacagtatagtaaagataacggacgtattgcttaccatcttacctagtttttgctgtatttgcatattggagtagttttttattttaaattgtaaaaaacaataaaaacattaaaatttatcttagccatttttcagtttataattcagtattgttaagtatattcacattgttgtgcaacagaagaaataagcttttacgtacctatttattttattttttaaagtccactatgatgacgcaggaacaaatccagaaagaatatgatgcactggttaaaagctcagaggaactcctcagtgcattacagaaaaaaaaacagcaggaagaggaagcagaaaggctgaggcgtattcaagaagaaatggaaaaggaaagaaaaagacgtgaagaagacgaaaaacgtcgaagaaaggaagaggaggaaaggcggatgtgaggcatttatattattttgaataagagacttaaagaaatagtgaattcttggtattgacagtggttaatgacaattatttgttttgttttgtttttgtgacagggtcttgctctgttgcccaggctggagtgcagtggcgcgatcttggcttactgcactctgcctctcgggttcaatcgattttcctgcctcagcctcctgagtagctgggattacaggtgcgcaccaccacgcctggctaatttttgtatttgtagtggagacggggtttcactatgttggccaggctggtctcaaactcctgaccacaggggatccacccgcctcggcctcccaaagcgcttggattacaggcgtgagccaccgtgctcggttgacaattcttaaaactgtgttcttattttaatgaactaattttgtaataagtttgaaaattgagagaataaggtcattttataatagtgataccataaaataattttaactataatctgaatttgttagcctcttacacctgaggattttcttctttttaaaactatgatttgtttattgttttctaagctagataaatgacacttctacttttctgcagttttaaaactgataacattttgaaagattgccatgatagggtagagagaacagatgagttgttgacttggagagggactagagggaagcacctttaatcaggaccttacagccaggctttgtaaccacattcatctagagatgttaaaagttatagaatataattatatttgttttatttaagaattattgtcaatagagttaaattttattttattcaaaataagttgatgtatgtggccaggaggttaatttgcattcccaatctgttacctttgtttattattaaataatagttaaattgccttctgaaggattctttattttctgttaaatttttgaagagttttctattttttattaggaaacttgagatggaagcaaagagaaaacaagaagaagaagagagaaagaaaagggaagatgatgaaaaacgcattcaagtatgtacttactgggttgaatttctattaaaatggaacctacaggctgggtgtggtggctcatgcctgtaatcccagctctttgggaggccgaggcgggcggatcacgaggtcaggagatcaagaccatcctggctaacatggtgaaaccccatctctacttatacgaaaacaaattagccggacatggtggtgggcacctgtagccccagctaattgggaggttgaggcaggagaatgatgtgaacccaggaggcagagcttgcagtgagccaagatgacaccactgcactccagcctgggcaacagagcgagactccatctcaaaaaaaataaaaaataaaaaataaataaaataaaatggaacctatgaaagaagtgaaaatgagatcttgatttgctagataagctgtcactagtttatcctagagaccaaaggccagtttttgaagtggttatgggaatggactttggagctagggaagtgggttcaaatccaagatcagtcactgacagaaattgtgacattgtacacattatagtgaggaactatgggtcacagttgtctctctgtagaatgtggataaataatagttgcaagcatttgacagttaatacatgttaaagcattgtgaacactgtgtagatcaataaatattaataattgtttttatacctaggggaaagtcaaatgaaaattcacttaaaatgttaagttttaaaatatcatataactttgtagatactggaattaataaattaggattaagagtctctctccacccctagtttttaaaaagtcccatgttgagaataaattgctcatgtatttgaatttctgtttgtcatggctttcataatatatcctaagcataaccaaaactttaaattcctgacatctgctctctaggtgttagtgttaatgggatgcctaagatactcatgtgatgtttgggacactaatatttgtagtcatagagttatggagctgtggttcttctaccttctcttggtcttgggaaagaggcaaaatggggatgtgtttgaagcattaatcataatagagaagaaagtagagactgaagagatctgtgcttaagcaattctttagtaaagaacttgtatgggggcagttatgctttccctttattttaagtaataaggggagtgatcaagtaaacaagtgaagaactcttggtgaaatagctttctgcccttgtcaggctgaagtggaggcacagctggcccgacagaaggaggaggaatcccaacagcaagcagttctggagcaggagcgcagggaccgggagctggccctgaggattgcccagagtgaagccgagctcatcagtgatgaggcccaggccgacctggcgctgcggaggtactggggcccctgggtggggtatagcgctctctcctttgctttctctacctctctgcctctcatttccatgcagaagggaataggagaaaataatattctgaaggccctgatatatttgagctaaaataattttaaaattatttgtatcgactttcatactcaagtgaatgagataattgatttttcatcatattattaaattgttgacaaataagactaaaatttcactaatgagtactctattaagaaaatatatcaacctttaccctgaaattgtttaagagtatagtatattaggtagacacctaatttctaaatacctgtcatcaaacactggcattgaaataagtgactgtgttatataatgcagtgtaatgtatttgtagttgagatttttctaatgcaaaaaaatttaatgtattaaatatcctgtcagttgaaatgagaactctactctgcaatgcctcagaataaatgagtttccctttacaagaagggagggttaaattcattgaaatattttggcttcttgggtttctgaattatctctaagcactccactatagtggagtgtataggaatgtggaagctcttattaaaagttgcagaaaggtttaatagattcagtttaaaaaaatttagtatgtagaggcattaattattttgattatttataataacaaaactaatttgtaaggttcctttgtatgtaggtatatatatgttgtatatatactgagaggcacatagacacatgtaaccatgcttttccgagcttaaaagcagtttatgacaaaatatagagtacaaccactagatggcgatgtttccttgtgaaaggatcaaactgcaatgtaatggaatatttggcaaaaaaacaaaagacggggaaggaaaagggcatattgagttgccttcatgctttttctattaggttggtgcgaaaataattgcggtttttgccattgggaaaactgcaataacttttgcacccaccaaatagtatgtgattgtattggggagctctgggactgcttgtatatgaaagtacattatattgtaaatgaactgaatatggctatatgaacaaaagatgttataattattaagctcttgggtttgagtccaatatttgggctctttattaagatttcactgtaattaaaatattttggcccagatagggcttttataaatgcagactcagctcagctgctgttctgttccttccacctgtgttgcatcagaatgattgggagtctttatgtgtaactgactagccgcctagggcaggctcttaaacgaaccaaactcttacagctgctatccctgatgtctgtgaggaagtactgcagttgacagagttgattttattatggcagaagtcaatttctaagggacttgttaatggagtcattgttggtactcatcatcaagctttatatttatgcacttgaaatgttaagctgtatccagtgccattccatatactgtatacaagatactgtctcatatgtggaccccttcccatcttcagaaaggtacatgtcttccaggttgagaagagtggatcgtttaggacctttaacataaacaagttacctgtaatttaaattaagcagaattagctaggtaatgggaccatattaagtaatgaggagatattcaaacccttatgacctgaaaggcagaagagctagttttagttatgtggttcaggcctaggggtggtatgaagaatgcccttcaaatcctttctgtcagctctccaggaagctttccctgaccctcaggtcctcatgagctccttcccttctggtcgtcgtggttattttatactgtgaactacaagcattagcacttcattatgaatgatgttctatacagatatcacatgtttgatagtttaatcttactccatgggctatagctaaatgtttttgaatgtttattttacctttgttagcactgagttttttctctaacaaatttatgagtaagaactaagtaaactgttcttaatctatagcatgatgttgttgggttctatgctgtgttaaaaaatgtatatattatagatagattctgcttcaataagcaattttaagttacttttccagcttggattcctatccggtaacttctaagtaagaattgttttctatgtatgtcatatgttctgaaatataatttcaatcaattacacatatgattcttgatgcaaagagatggtttcaaattacctaaaattgtaaaataatatccagattctattaaaaacaaacctcacaatatatgaattttctaatctagatgtaatgtatttgctctttaattttcactgcatgccttattttccaatcatttttaatgaatacttaaaaatatattaaaattctgagtgatctcatgttgattacaaataattgagtttttaaaatcaatgagtaaagtaattgaaacacaaatttgcacaatccagattttcacagttcacaattggttacgatattaactaaaatatattcttttcacagaaatgatggaacaagacccaaaatgacaccgtatgtcacttacctttacctttttaaaaataggttgtagatactttttgggagtagttttctcattggagtaaattttaaattattttcttctattgaaaggtaatgagataacctttttcatatttttcttgtctaggaaagtttaatgctcttgtatggtgctcaatcacagtagctcatgatttggtttccttctttgtattgtctgtttaaactataatgtaacacctattttgttttatgtatatatatgaattttttttttttttttgagacagagtttcgcttttgttgcccaggccagagttcagtggtgtcatctggggtcaccataacctctgcctctcgggttcaagcgactctcctgcctcagcctcccaagtagctgggactacaggcacgcaccaccacactcagctaatttttgtatttttagtagagacggggtttcaccatgttggccaggatggtctcaatctcttgacctcgtgatccacccgcctcggcctcccaaagtgctgggattacaggcgtgagtcactgtgcccggcctgttttatgtattttttttaaactgccccttaccttacttctttatagaagcaggtgtggaggcataaataataataaaatatttgattttcagtatatatggtagttcattctgctatatctaaaataattcatcatctgaaattgtatatgtagtgctaactttggtgctaatgtatctttttcatatgaaaatctacccacaaagaatccaggtaacatttggaatatacattttgtttatataaaatataaaacatattttgtatgtatgttatgtatactacatataaggattttggaatatatataaaatctttattttaacagctttaaggactccaacttaacatttatgatgaggattctcaactctatcaggctccagtcccaataacaattttttaataaatgatgcaacctatgtaaacaactctccaaacaatatatgtaaaggagaaatacaaggatagtcatttataataaaatgtttatttaatatgaaagtgcttctgcataactgtagtagaagacatgataagcgatcagatgtttttgcttacgtatagaatcaccacgaatgctgtatctacaaatacaaattgatataggaatgttgtgttgggcattcacatgccatgaaattgtgaacaatcctttgtgaagttctgaacagagccaagtacaatattctctcaattacacagtatttgcgtaagccctagacaaattctgtgaatattaaaggcatgcaaaaaatacgatgtttacatgtataactttgtttacatgtaaaatatgtgtttgtatgtgtttttcacctctgtatgtctcacagacatgttaaagttaaatggggcatggagtagttcttccttgggtaggacatttggcattcctttccccttacctcagcagatgccaggagtatactcacacattgttgttaccacaatactgccccaaattttgaaaatatctctgagtgggcactcttgccctccattgccacaactgctttatagttaccatttgagcttgaattaaataagcccgcaatcagtgtctaaggtgaaattatatttgcatatagtttggtaaaatcagaaggaagaaagcacctgggtgcaggaaccatttctgtctggcaaatttgttgcagtgtattggtctaggtcaggtgtatcttgatgcagggtcagggaggataatgcatcagtagagattgccatccattgtagtgtcagagcatgcagaaaaacacctgtgtgatcaacagacccagtggtaatgagatttgaaagtccatagactcccttaaaacctaccatgggaaaagaaatggaggaagctttaggagaaaaagatggtaaaaacagatgctcttgaatcctgagacaaaaaccttgaggtggagtgataatagaattaaacatacttatcaaaatctgctgcatttaaaagtgagacgattctgagaaactactagcttgaagagagattgataaatgtattgctcaaaagataatttttattagattgtatttgtgttatattttgtttttgctgtccttcactgtcagctttgaaagatatcttgttctctgactgtgctttcatagacctccatccatacataattgtagacagtgttcattacgagaaaagaggaatacaggagtgttctactcctttagtcagggtcccagctcttggcaggcattcaggaaattgcacctggaagcaaatacacccatcttcttttcttatgattttactgatttggaagggtttgaggttactagagtttgatgagtagaatgaatgagaaaataattacgaaggaaaagagcaaatagggaaataagttaaagaagtgttgatgaacactatgaaacttcattctgttttaaagaattaaacaaaatttgataaaagttacactcttctgggtaacaaaagcaaaataagttttttgcctttggcaaatgtttatccctggaaaatcagaatgcctcagatctttcattagtccattttgatattctttttcttaaaagcatgctttgatttggaatttttagagctttgaatacatcagattctttttaaaactctgacgctgtcaaatacatcagcttgtggttttcaccattgtgccttatctaagtaatatttactaagcaactctggtgcaaaaatcctcatatggaatctatatcttgccaagtttcctgtatggatttagaccatgttatttgtattctatatggaaaagaataccataaaagctttcctgagattttatctaaaagttgctactgcaaaaatggagagacattcaaataacttgaactggatttaaacaaaaatttttctgtgtgttacggctagatttgttgaatagtatattctaggcattaacaaagtaaaacagttatgaacagttgttaaataatattgaaaatatatattttaattatacttttagatcttttaattaatttatgtagtatgacttttatgtaaccatattgtattatcgtttttcttgtagggaacaaatggccaaagaaatgtcagaatttttgagtaggttagtgcagtgtaattgggggaaataagtgttcacctcaaaatcatatttttaaattacttttgattatttggaccagaacctgttacatgagtagcctagtctttctatgtaaagtgatatttctttctgtacaagaaatatcacttctccctcaccccacccaacaaagaaaaagttaaaaaccagtattccttcaaagtcatggggataccattggcattttgaatgggacagttcccttggcagtggaactctactgcttatctctggcctccaccaactcagtctcagtaggggacttcttcccctcatcatgacaaaatgagtattttgcaactctccctggggtggtgctgcccctaatttgggcaccactgtgcgtcgttgaagaggaggtagaggaagaacatgactcttgaggggctctgcactgtggcacatggtttgaaaaccactggtgtaaattgagccaccagcaggatctggtccattacttttataaatggatatgattcactaacatgttaattcttaattttgaagttacaaagataattaaaagtgttaatatattaacacttaaaaatcagtttgctactattgtattctttacatgattgtctttatagcaagtctgaataatcagcaaattacccctttactattttagtaactccagagatgggggtggggaaacatttaaatgtgttgcattgatgtacttctttggatgctatgttttttagtagatgtacttttgtttgaggtaataggaatgaaaagttagggatattaaaaccatattttaagcaataatcatttgaatttaatgtaatttttaaaagtatcaaaacacattttacatatattctaataccttatatacattctgacaattataaaactgtatattatgtcaatttacctcttctttcaaaagaaaagataacaacaaaaacaaaacttaataattttcagctgccctcctagaaaagactcccagaacagcttaaaaataaaaggattttttttgtttattgattggtagtttagggatgtagaaaagacaaataatatttgaataaatataaaagcataatttattgttaaggaaatgagagaccttgctgatacacagctggccatttttgagcaaagcaattaagaccaaaaagctacatggaaaattgccacttagaccgcttatgaaaagtatagattctgcaacaaagctaaaacagattttaatcataaaaatacgggaaggactaatggccacacattattctttttttttttttttcttctggaacatttttttaaaaaaattattattatactttaagttttagggtacatgtgcacaatgtgcaggttagttacatatgtatacatgtgccatgctggtgcgctgcacccactaactcgtcatctagcattaggtatatctcccaatgctatccctcccccctccccccaccctacaacagtccccagagtgtgatgttccccttcctgtgtccatgtgttctcattgttcagttcccacctatgagtgagaatatgtggtgtttggttttttgttcttgcgatagtttactgagaatgatgatttccaatgtcatccatgtccctgcaaaggacatgaactcatcattttttatggctgcatagtattccatggtgtatatgtgccacattttcttaatccaatctatcattgttggacatttgggttggttccaagtctttgctattgtgaataatgccacaataaacatacgtgtgcatgtgtctttatagcagcatgatttacagtcctttgagtatatacccagaaatgggatggctgggtcaaatggtatttctagttctagatccctgaggaattgccacactgacttccacaatggttgaactagtttacagtcccaccaacagtgtaaaagtgttcctatttctccacatcgtctccagcacctgttatttcctgactttttaatgattgccattctaactgatgtgagatggtatgtcattgtggttttgatttgcatttctctgatggccagtgatggtgagcattttttcatgttttttttggctgcataaatgtcttcttttgagaagtgtctgttcatgtcctttgcccactttttgatggggttgtttgttttcttgtaaatttgtttgagttcattgtagattctggatattagccctttgtcagatgagtaggttgcgaaaattttctcccattttgtgggttgcctgttcactaggatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatgactagccagttttcccagcaccatttattaaatagggaatcctttccccattgcttgtttttctcaggtttgtcaaagatcagatagttgtagatatatggcgttatttctgagggctctgttctgttgcattgatctatatctctattttggtaccagtagcatgctgttatggttactgtagccttgtagtatagtttgaagtcaggtagtgtgatgcctccagctttgttcttttggcttaggattgacttggcgatgcgggctcttttatggttccatatgaactttaaagtagttttttccaattctgtgaagaaaggcattggtagcttgatggggatggcattgaatctgtaaattaccttgggcaatatggccattttcacgatattgattcttcctacccatggatcttccatttgtttgtatcctcttttatttccttgagcagtgatttgtagttctccttgaagaggtccttcacatcccttgtaagttggattcctaggtattttattctctttgaagcaattgtgaatgggagttcactcgtgatttggctctctgtttgtctgttattggtgtataagaatgcttgtgatttttgtacattgattttgtatcctgagactttgctgaagttgcttagcagcttaaggagattttgggctgagacaatggggttttctagatatacaatcatgtcgtctgcaaacagggacaatttgacttcctcttttcctaattgaataccctttatttccttcttctgcctaattgccctggccagaacttccaacactatgttgaataggagtggtgagagagggcatccctgtcttgtgccggttttcacagggaatgcttccagtttttgcccattcagtatggtattggctgtgggtttgtcatagatagctcttattattttcaaatacgtcccatcaatacctaatttattgagagtttttagcatgaagggttgttgaattttgtcaaaagccttttctgcatctattgagataatcatgtggtttttgtctttggttctgtttatatgctggcttacatttattgatttgtgtatattggaccagccttgcatcccagggatgaagcccacttgatcatggtggataagctttttgatgtgctgctggatttggtttgccagtattttattgaggatttttgcatcaatgttcttcaaggatattggtctaaaattctcttttttggttgtgtctctgctaggctttggtatcaggataatgctggtctcataaaatgagttagggaggattccctctttttctattgattggaatagtttcagaaggaatggtaccagttcctccttgtacctctggtagaattcggctgtgaatccatctggtcctgaactctttttggttggtaagctattgattattgccacaatttcagatcctgttattggtctattcagagattcaacttcttcctggtttagtgttgggagagtgtatgtgttgaggaatttatccatttcttctagattttctagtttatttgcgtagagttgtttgtagtattctctgatggtagtttgtatttctgtgggatcggtggtgacatcccctttatcatttttgattgcgtctatttgattcttctctctttttttctttattagtcttgctagcggtctatcaattttgttgatcctttcaaaaaaccacctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgcgttgaatgcgtcccagagattctggtatgttgtgtctttgttctcgttggtttcaaagaacatctttatttctgccttcattttgttatgtacccagtagtcattcaggagcaggttgttcagtttccatgtagttgagcggttttgagtgagattcttaatcctgaattctagtttcattgcactgtggtctgagagatagtttgttataatttctcttcctttacatttgctgaggagagccttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttccgtctcgttgatctgtctaatgtggacagtggggtgttaaagtctcccattattaatgtgtgggagtctaagtctctttgtaggtcactcaggacttgctttatgaatctgggtgctcctgtattgggtgcatatatatttaggatagttagctcttctttttgaattgatccctttaccattatgtaatggccttctttgtctcttttgatctttgttggtttaaagtctgttttatcagagactaggattgcaacccctgccttttttttgttttccatttgcttcatagatcttcctccatccttttattttgagcctatgtgtgtctctgcacgtgagatgggtttcctgaatacagcacactgatgggtcttgactctttatccagtttgccagtctgtgtcttttaattggagcatttattccatttacatttaaagttaatattgttatctgtgaatttgatcctgtcattatgatgttagctggtgattttgctagttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtgaagtattttatttctccttcacttatgaagcttagtttggctggatatgaaattctggattgaaaattcttttctttaagaatgttgaatattggccccaactctcttctggcttgtagagtttctgccaagagatccactgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattgggtaagttctcctggataatatcctgcagagtgttttccaacttggttccattctccccgtcactttcaggtacaccagtcagacatagatttggtcttttcacatagtcccatatttcttggagtctttgttcgtttctttttattcttttttctctaaacttcccttcttgcttcatttcattcatttcatcttccatcgctgataccctttcttccagttgatcgcatcggctcctgaggcttctgcattcttcacgtagttcttgagccttgattttcagctctatcagctcctttaagcacttctctgtattggttattctagttatacgttcttctaaatttttttcaaagttttcaacttctttgcctttggtttgaatgtcctcccgtagctcggagtaatttggtcgtctgaagccttcttctctcagctcgtcaaagtcattctccgtccagctttgttccgtggctggtgaggaactgtgttcctttggaggaggagaggcgctctgctttttagagtttccagtttttctgctctgtttcttccccatctttgtggttttgtctacttttggtctttgatgatggtgatgtgcagatgggtttttggtgtggatgtcctttctgtttgttagttttccttctacagacaggaccctcagctgcaggtctgttggagtacccggccgtgtgaggtgtcagtctgcccctgctgggggtgcctcccagttaggctgcttaggggtcaggggtcaggggcccacttgaggagacagtctgcctgttctcagatctccagctgcgtcctgggagaaccactgctctcttcaaggctgtcagacagggacatttaagtctgcagaggttactgctgtctttttgtttgtctatgccctgcccccagaggtggagcctacagaggcaggcaggccttcttgagctgtgatgcttcccagttggagcttcccggctgctttgtttatctaagcaagcctgggcaatggcgggcgcccctcccccagcctcactgccgccttgcagtttgatctcagactgctgtgctagcaagagactccgtgggcgtaggaccctccgagccatgtgcgggatataatctcctggtgcgccatttttttaagcccgtcggaaaagcgcagtattcgggtggaagtgacccaattttccaggtgccgtctgtcacccctttctttgactaggaaagggaactccctgaccccttgctcttctggagtgaggcaatgcctcgccctgctttggctggcacacggtgcgcgcacccactgacctgcgcccactgtctggcactccctagtgagatgaacctggtacctcagatggaaatgcagaaatcacccgtcttctgcgtcgctcacgctgggagctgtacatcagagctgttcctattcggccatcttggctcgtgcctccacattattctttagctagtcttatatgtaactaagaatcactatgtcaaagaattttaagtatgtaggatgaagtatgctattttttattttctagaatgaaagcatacagagaccttttaaagaagcaagggcaccttatttatttcattgttaagcttagtattgaaagaataatttcctttacttcaggaagaaagtgacatattctcagacatcatttttcaattaagtatgtgtcttcactgcttgccaggatggctgttatctttcaaaatgtaaaagactgagaaaatacatgtttattttcaggtattatatcttgatcaatcctctttaagaggaagtatattttaggtagtaggtggataatggagaatttccttgtgtcacacctaagaagcaatatttttgttctttaatagttagttagtttaatattttgtgccaccttcttttcatgtcttgaaatgtgatgtatttaaacgcttctcgttaccttgagcttaaagtcttgcagcttattctgagtgtctgctatttgcaagtgtaatcttttgctgaaaaataagtttattattacagaaaagaaattgttcccatattttctgattaatgatctcaaattatatgcataaaagtcttaaaggccaggtgtggtggctcacgcctgtaatcccagcactttgggaggctgaggtgggcagatcacttgagctcaggagttcgagaccagcctgggcaacatggcaagaccccatctctacaaaaattataaaaattagcctggcttgttggtgggtgcctgtagtcccagctatttaggaggctgaggtgggagaattgcttgagcccgggtggtggaggttgcagtgagccaagattgtaccactgcactccagcctgggtgaaagagccagaccccttctcaaaaaaaacaaaaaacaaaaaacaaacaaaacgcaaaaccaaaaaagcaggccttaaagcactgcgtagcactgttttgaaaaagttgaatttatttcattttattgactgctttggattttatttctttcctctttccccatatgtgctactaaatgagtcatgatacagcacttgtgccctttgaaatctctgttatttacctcatgagctaaaacctcttgaatttactagttttcttattacttatgagggtgtgttttttgtgtgcttatagaacttttctaagtgttcttatagcagtgaagcctacaaagtaagagtttccagattccatccgttcttttagctgacttgaatgactctaatgcagtgggttgcaggtttggctacttacctatgtactctgtaaacatccagaggcccagggatattctgagccactgtgtgtgaatggagtttggccatctgtagatttccgcagtctctccaggtgatcgcactgtgcagcctcattgctcataaacaaaactttaatatgcttttaatgatctttcaagtgtgttgaggatttctttcttgattttgaggaatatatgtcagtatatttttcaactttaagtgttcgtatatatattagtaaaaacattgaaactgaagtctgggggaagtttgtggaactagaatattagaatcaaaagtttggatttaaaatctaatgtgactatcgagtggcatgctggaaatttttaatttatttggccatcttttagtatgccattcttaatctcatctgtcaaagaaacaaaaattatgtttttctagtagctgtttccggttttcaaacttatgcatgctttcttgcctctttagtcaatgttttcttcatgtttctggtttaaacatgcaaaaatgtgtaataattacagaggtcctgctgtactagccaccaaagcagctgctggtactaagaaatatgatcttagtaaatggaaatatgcagaactacgtgataccatcaatacttcttgtggtaagtgtttggagaagatcaaaaatagaaaatgttcatagtgataggtgataaatacctagattagggtgaggtgtgtgtgtgtatgtgtgtgtgtgtgtgtgtgtgtatgtgtgtatgtacatataatacctatattatctgaatcttttggtccatgaatgcacagtaacaaatggcaatgcagtgctttctttttaaggctatttttcttcccacagaacaattagagtaaaatactatatccagaggatcccacatagttatgttcttatttaaatcacagtgtttgagttcagaaaactatgagtaggaacgatgaattcagaaaactatgactagaaacaaaagtatcataattgtacataatttctcactacactttcctccattgagtatatctgcataattataaaaaatgtcttgcttgtaaatctagtttgtattttatcacagtgactttttattctattgtcaagacttgttgccttcgacaaattgcttaatgtttctgatgcaattccttcatataaaagacctgtttagttcagagttcttctgtggagcagatgatataagatagtaacactgtgtaaagaaatgatctgtgaatttgaacaataatattataaaatgcttatccttatgaataattagcttacttttgattttgtaccattaatttaaaaataaaaaaatctccttatgcgacagaataattatatcattatgttagacgaataaattaacatgtcaattttttttttttgctcaatgtaatcaatagatattgagctcctggcagcttgcagagaagaatttcataggagactaaaagtgtatcatgcttggaaatctaagaacaagaagagaaatactgaaacagagcaacgtgctccaaagtctgttactgattatggtaaagagaaatctgtacttttgaacgttttaaaatatatgtatataaatgcatgtatctgtacttaagacatgggtaaaatgtcccatataaattttctcctattttagaactgtgagccattgaacctaatacagccttgatggcctatcttttatagcgttatttttatgagtatgtctttaaactcatacttgttaagatatattgaatttactataattgagacaagaattttcttgtctgaagagggtgtgcatgcataattttcacacacacaaacacgtgcacacactcacaagattaaatgtgaaaatgtcaggattgccatgcatcttttaccttacatgtgaaatgaattttacatatgaaaatgagttgctaaaaaggatgatggttagtttttatttttaaattttctataatttttattttttaaataaatagagatgaggtcttgccattttatccaggctggtctcaaactgctgggctcaagcaatcctcctgccttggccttccaaagtgctaggattataggcatgagctactgctcccacccctttttctaatttttaaaatttaatgtagctcagtttttagaaatagttccctgaaatacccaatattgttatcttttttatttgtaggtataagtacttttctgttgctcccagaatagggttatagcctggaaaaagaaaggaattgattcatgcattgtccatttacactctaattcctttgtttcaaaaataattttactgcaaacattattttacaatactgcaaatatataaaagtgagaaatattaccttgcttcagactagtgttttgcctagatcaagatttgattttttgattgggatcctgaacatggattttgttactttgttatgcaaaaggccaaggtgtatacttgaaattggaaagtagagtagaagagatgtaacctagtacaagcatgcatgagctttaacattaactgagaatacgtgtgatatgcgagttgtaatttcaatctttaaagcaataattggacttactgtgttcaaattggcacaatttattcgcttaattctggttaacatcaaggtgacagcagattcaatattttgtgtgtttttttcccctaagcggtatattcccaacagttgatagtatagtttagcaatgcaggacccaaattgacttaaaaaatgagttcttggttatattttgctttcctcactaccttccaagtaaataaaagcagtgtttaaataaagtcaatttaatagtggaattctagtgtttctaagttgttgcaaagaatagattgagtgagggcaatattattattaataggggtaatattagtgccagttattgctccaggggtgtcagtcagaatacaggactatgcaagggcagtgggagatcacttgtaaccaagaagtggcaggtggaagccccactaaatattgtgacactgctctcttctccagtttcatatttttcctcttctaattgaacacaacaaaatgattacattagctgttcactgtctgtgtagtgagttctgaccacagattacctttgttttgcaaaaaatgacagtgagctgttctttttagctgtaaatattataattactaactttagcttgacagactttcattatattgtatttcaaaattaatacatctgagtgatcacacttcttaaaaagaggttcatgttgtaatatttggcacacacattttaaattaatgtacacatatttattgtatttgtgactcaaactttgataccttattcatctagctttacccaaaaaagttgcaaataatacgtggctcaccttgctggttcaactactgtttctgtttgtaatatattatttaagaaaacaaaagagtagattaggaaagcttcctaagggttctatcaaggtttatggacaaatttaggaatttatgtgaacacaaccccacacatacatattaagccttcagagaacttgattatgagtcattttcaggatatattttatcaaatgtaacttctgctctgaaaagtacttttttttgcttttctctttctctttatgttcttcctcatacaaaattcatcttgacacaggagcatagctaaaagcaaaggttaaagagcaccaagaagctcaattgagaaaattctatacttaaatgatttcctaatgtggcagctaaacaccctttaaaaggaagtgctgtgtagtctaatatttagaaggaacaattcattaatttgagaaaataaaatgatgacaacttatgattaacaaaaatgtagcttcgtattgttgacttaaagagtaataggttgacagctaatggtaaactcttaaaataatgcataaggagcctcagaccctcttcctggtacagtcctggatgagcatactttcatctcatttactgcagagggagattttttagaaataattttttggtcagtggcaaatcacctagtaaatatttatagtaattaattgtttaaaacaatgattttggaaagtagttttattttatagtttataaaataaaaatggcatgagtttaagatttagagagtttaaaaaaagcaaaacatactgttaccaaaacgtagtaacgtttttactcctgtaatgtatataattttttgatgaattctcattattttctatgaaaattctagtaatgtatgaaaggtactataatgtctattaagtcattgtattaggtttttgtttggatatgtgttccaaaaatcacaaatgaagtatgattttttaattttggtcctctttatatgtgcttcaatcagaatttcctaagcctaatgagtcaaaatagccttttaaaaaaatcagaaagcagcacctgcttttaggtaattctgagaatatttggcttgtggataggatatttacttttcagtcaccacctcgattggaaggctttataaattagaaaaatgctcatttaacagttttggcatttttatcttttcttcaacataaaatatttgttcacagattttgcaccatttttgaacaattcacgtaagtcaatgggtggtaactcatgagctaactggaagatgggttaaaatactttacaaagtactaacttctattaaaagttgttttgctacaattttcagtggaattgtagtgtgttaaagttgttatatccatactaagatatattttaatttgagatgatgctttatttggatcactccaatatgtatatgtattacaaaaaatctagtgaaattaatgttttatcaaattacttgcattaagaaaatgactagcattttaaactgagagtatgtacaattcttattgtagcaaaactcttaacatagcagctgaccttttagaataaagactaacttttaggtgctggtttttggttactgtattttcaaacactgatggtgtctgcatttctgccaaaggtattttagttttatagataatgtgatagtgtataaaggtttaataatgatacctccttaaataggaagaggagattattctgttacgtttatagcctcttatgatacacattctttgataatttaaaagctttgagtcaccttagtgcacagtaaatctcttgtagaattagttgattagtaatgatttggatataatgtcacattcatttgccaactggttggacctgatgttttgaagtgcttcttataatttataaggctgtatttgaagattacacaattgaatgtgaaggaaagttatttagaatattagtttcaagcttttaatgtctgtgtctttgtgtttttccagataagtattcgtttctagtcttccccaacaaaatttcagttctcctgttagtaagaaaagctatcaaagactttctatttagtttctgaattttatccagtatcttaacttacaggagacttacttcaaattaaaaagtaggttaattaatgaatgactatcagtatcatggtaaatttcctgtaaactggacattaaattctaattcactactttagatggagggaaggtttttaaattcttagttttgaattagtacattttcaacaatgtagggagttttgaaaacttaaaagtagaaacactgaactgtaagtagctctgggaaaacaggagcaaaagaatagataagcagatgtctgttaatatgtgatgcagcttttaaagttactaacaaaaccgggcctctcgttccttcatagggatatatagctttgctaactgctttttgctttctctggtttgcaaagaaataaattcaactgctataaagcttttgctatttcttggtgtaaaaagtagagtaagagtattttcatcctttcagtatttgcaaattcttacagaagccatgtggctcttcttggctttatatcatatgtacattttacaatatttctttgacacacttggattttcatagtgagactcttaactgagctgctgtaaatggttgttccacttttgaagttctgtgagtataaaacagattaaacaggctaaccaaaattatgctgctaaagatgtaaagtcattgccccagggaaatgtttacatttgcagataaaagaaaaacctaattgttaagtaatgaaaattgagctaggaatgaaagattgatatgaatgaaatgcccagtactagtagaaaagcaaggatttttcttttcttttggcaaggagaatcaaatgttacatactttgcacttcattggattttattctaagagaaatctgatttcagagtaagtaaatatctttaagggaaagtttatgcttactgttataaggttttttttgtcatatggttgtctaaatgttgttaatatctatgtcattgtggtcattttaaatcctaaaatttgttggcaaaagaaaaaatttttatatggcttctactttttgtggaaatagtgattaaactgacaaatgtctacatccttcagatttttgaaattactgtttattttgttctatcataaatagttgaataaaagttactgtacaaatttgaactctttacaggaagaatataaatctagtaaataatagtagtttgttttcctgccgtgtgagtttattttaggttactgttacagtgatttgtgggaatctgacaggggtttgttgctggtagtggtggtggtagtggtatgtgtgtgtttgtgttggcaatgctaagaaacatcttaagggaaagacaattctaagaagtaacactctgaattttattaatttgtaggcaataaatattttcattttgttttaaatttactattagggacctttcttctttttaaaaaattattggggtatattttaggattaaaggctcttttcttttcccttgagctgctggtataactttccttgttctgtgtaatagctcagcaaaacccagcagctcagattcctgccaggcagcgggagattgaaatgaaccgacagcaacgcttcttccgcatcccattcatccgccctgccgaccagtacaaagaccctcagagtaagaaaaaaggctggtggtatgcccattttgatggaccatggattgcccggcaaatggaactccatcctgacaagccacccatcctacttgtggctggtgtgtatgattcacatggaaaacaaattatagaacaaaaaagatcataaactctctgaatgaaacattctaatgtataatataataatttattacatttcagggttgagggatggagtcttgcggttaaatcacatttccagttcagtgaggattaactcatttataatgtgaaattgcttggattaaattatgttcttagcacatagaaacttgtctgtatcctaaaaacctttccatttgtgtttcatcatatccattgatttgtagtggcttgaggaaatgtagcatttttattaactctggtaacttgtttgatcaatagcagtgtttattaatattgaaagggtccttgatgggggacaaattttaattgtttctggtgattttattaagcagatttccatcttagagaaaaagtcttaggaagttttcaaatctatgagaattaataggtatttcaggcatacaactggtaagaaatggtcctgaagagagagatggtaattttctgatatctcatgaatacaggtaaggacgacatggagatgtgtgagctgaatcttgaggagactggcctgactcggaagcgtggtgctgagatcttgccaagacagtttgaagaaatctgggaacgctgtggaggcatccagtaccttcagaatgcgattgagagcagacaggctcggcccacctatgcaacagccatgctgcagagtctgttaaagtagatgttgcacaccagccttacagctgggagcctttgccatggtacttaggtagggtgtgtgcccccagatttaaccattccataatcatgttagagttacttctataaagtgaacagattttattaatcacggcttttggtgaatttgtttaaggttaattatggtagcaaattttggacctaaacattatttttctgtatcccgctgtaattcccaaaactctcattattctctaactattacacatgggcatattctgatgtttctcatcctttgccagaagactaccttacatccatcgtaattgttctctaggaaaagagaacttttttcaaaattcaaaatactttttaaggatggcacagtaccatataactggagtaataaaacatgagcttacattcttacaataactaaaccacttaaaatgatcaaggcactaatgttttggtctgaaaagctgtgtactttatagacattttcagacatttttggaaatttccattaaaggtggaaaatctatttttttcctcctttgcagtgtcttagtttgaatgaaacacttcgaagttctagaattctagaaagagccttaatgtatttgatgtattctgtgataagaggtactaatagtatccagcacagatttgcttttctttgctagcacaatgtgtgttgctgtcagaatattctttttatattctgtggaaaaataaaggaaattcagattgtttaaatgcctaaaagttttgagataagttttgtttcaattagaaaaggaaataggttttaggtggcatagtggcttaactggactgaattcaaatattctttcaacttcatctcaatagtgatttttgtatcagaatcttgtccaagttgtttcattgatttagtaagtgttctgcttccaacatctttctttttaagaaattcctagtgtcttttttggcctttgaggttttggtaattgtagacctgtttcataagctttgtaattcagaaatccttgtatttagtaagtgcttgttttacataactgataattttaaaatgttttctttgtgtgctgttagtattgattcaaatgtcagcagctttaagcctaatatttatgactttcacatttggaatttaaagacaaaaatacatcaaggagttatgctgacataattctaaggagttttgttgtattttagaataaaattataaagtaaaatgattctctgtactgctttttcccccagtttttagagaccctaacctttgaaatgaaattccagtgatttcttttttccctagaaagattacctcagttagggaagtatttcccagctgactagtgtttgtgagccacagacactgtcttcagaattgcttctctcatgtcttagtagagaaatatttatttattatgatacattcaaatgattgtcaagttaaattaaatggttgtgtctgtgctattgagaatgcaaatgtgattatcttttgaaggctgtattactgcatagcttcacccaccctcgggtcatttcgtccctgtgattggggacagaaggtgtagctactgaagtaaatgacctattctctctcttccatctctcgcctttaactggtgtttttatttgtgtaggatagtgaatgataagcttttttcctaaccagtagtgagtaaagttcttgaacaaaatttagtagccaaattgttttttaatgacatgtctctttagtacaatagttttgtgtatcttttagatacattaataggcactagatggaaaattaaagagttaaacatatttaaatgagagaatctaatgtttcagaaatttgtaagaaatgtatcacagcaaagggttgttataagtccttagtttttgactctaatagttaatacaattatagttaatcttaagccataatgtttctaatcatgtcacacagctgtcctagaacttatctatttaaaatagtttcctgagttaattttggccagcagggcaactgccctaattcagatagatttacagtaacctacgtacagtagatgcacatacacacagacacccctttgctggagaaacttaggaccctgtcagccttttaaaggaaacagcaggagtggtgtcctaaatgatgttcatgcagctgctttaccatgttcacagtcaagcccatgcatgccaggttaaaactgtggaaatcaaaagtaaattcactcatattttaatcattttaactgagatttaaaattagaagtttaaaccactatatataaagaactaatcttttcttaataccagttctttccatagcatatgctttgcaaaggcagcatgcataaaatatttaaaatgagaggacagaatgttttcacatttgattcaattttaatataattcctaattgtggtaacacagttgagatatgtattatgagttatgggaactaattgagaaaaggaagttactctaatccacgtatgttaagagaatattgagttttcttagttgtaaagttggggagatggcaccttctcagaggattgtgaaaatatgaggaagaaacaaaacagtgcatgtaggagcacagggccacacaaaggcattctattgttatgctcattctgcttctgtaatgacttttcataggtcattcttgtgaaccattttgttttgcaagcaaccaaggaaagaacatcttaagtggaaaatcagtggtggttgtgaacacttagagaatagcaatccacaggcaagaataatggtattgtttgtagagctttattaattggatattttttaaaagacattttcattcacaggtcattactatggttctcagcgatccaaatatgtagatcattggtttttttttttacctgaagtagcttaagagtacttggatcagtagaataaatatttattgaatcaatcagtcagccaattaatatgatgttagtgatagacctgcctccttttatggaagaggtaacagatccagagaggtcaagtaatttagttgtagactgaaaaatatatcaaagcctttgctgcaatcatatgtaacaaaaagaaccaaaacaaacactttttagtggcacctgtggatttacaaagggttgcctctctgtcattccacaacttcagaaggtgtgacaggttttccctatttatcattaccaataataacaagtattgagagttttaaaatttctcccagaagataaactaacaaggatggaaggggagggcaaaggatatctaaacatgagaataaggacatgttagagggggggaaacagttgtaacaataaggaaagagaagagcaacagtggaagagacaggttgtgtgcccctaaagattctgcacccccagtttggaaacactgatacattttaggacacagagcactcctagatctctacgaaattttagaatgaataatgtgtaatttataggatcagaacgtatggttattaaaacttggatcaagatatgcccggtgtatacattcttagcacataggaatggcactgccatactggagaaggtcagcagtaaataggcattctgtacataagcctcatggaagggtaagatggagagactggcagaagtagcacctactctgctgggagcacttctctgagtacgctttagttcaattcaaatcactgtattctttccccattgctaacctaatatatgaaacaagcttagctgtctcagaagtttttcaagagatgatcaggaaaaattaatgcacattcaaaaggagaatcttcagtacaaatttgtttttttaaaaatagatttagggctgggcgcggtggctcacgcctgtaatcccagcactttgggaggccgaggcgggtggatcacgaggtcaagacttcgagaccagcctggccaacatggtgaaaccctgtctctactaaaaatacaaaacattagccaggcgtggtagtgggtgcctgtaatccctgctacttgggaggctgaggcaggagaatcacttgaacgcgggaggcagaggttgcagggagccgagatggcgccattgcactccatcctgggcaacaagagcgaaattccatctcaaaaaataaaatagatttagggggtacaagtgcagttttgttacatgggtatattgcatagtggtaaaatgtgggcttttagtgtacctaacacccagagaagcatacattgtgcccagtaggtaatttttcatccctaaaccttttctcagcctcccactttctggagtctccaatgtcggttattccactctttatgtccatatctacacattcaatcctaatttgtaccaagtagcatctcacctttaaatcacaggcttattagttgggtgttttctttttacttatgaaaattcatctagtcaaactgtcaattaatttttcctcatttcattaaaagtgtatatctaatgctttctctaaaaattgatgtactggaaatacaaataaataaatgctccctgtgtagaatttc

SEQ ID NO: 200 - DNA, 95043 bp, Homo sapiens
  source 1..95043: mol_type = genomic DNA
tgcgcttcccgcgggcgcgcggagtgaggacggtgacagccacgcgcgcgcgtacgcgcccgatgcagcgcggccccgtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccgggcagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgaggtaaccggccggcagccccgactgctgcggtgacagtcgaggtggaagctcgagaggttctctttatatcatcttatgggtgtagctagagacgggcagaaccggaagggccaactaggcccaaaacctcatgttaaagatgattgctgctttttttcataggacttttgggttttggcatttcctgaaggttattttcattcattgttattggaagaagctggatgctcctgtgatagaaaattcaggatttcagtgtcaggcttaagttaggcttacgcttaaaagcttgaaagtttattctttcattaggtaatattgttatgtacccaggtattagaagttgcgtcttgtttattggaaagccaatacttgtttcccttttctaaagcttgcatattctgggaaaaaaaaccctttgaagaacgatataacatctcatacttactttccacatagtttccaacatgatgataacagctatcaattgttcagtattttcaaagtgctagacatttgcacatttaatcctcagaacaaacccatttatctagtaaatggcaaggtggggttttgaaccaagctcacagcccgtacagtactgcttctcaagtaatttaagttcttgctgctaaaagtgtggtttgtggaccagcagcattggcagcagtaagcaagggttggcatgctttttctgtacaggaccacatagtaaatattttcaactttgtagactagagaatctctgttggagttattcaactcttcaactctaccattgtaacacaaaagcagccttagataagatcagcttccagcatgacagcttaaggaacccattcctctgtaaaactggtgaaaattcttttttgttttgtttcgttttgagacagaatctcactctgtcaccgaggctggcatgcagtagtgtgatcatggcttactgcaaccctgaccaacctccctggctcaatcagtcctcctgcctcagcctctcgagtagctgggaccacaggcgtgtgccaccacacctggctaattttttttttttttttttttttgagacggagtctcgctctgtcacccagagtgcaccgggctagagtgcaatggcgcgatcttgtctcactgccacctccacttccaggttcaagtgattctcctgcttcagccttccaggtagctgggattacaggcgtgcgccacctcgtctggctaatttttctatttttagtagagacagggtttcaccatattgggcaggctgatctcgaactcctgacctcgtgaccagccgacctgggcctcccaaagtggtgggaaagtggtgcgattacagatgtgagccaccccgcccagcctcacctagctaatttttgtaaagacagggttttgccatgttgcccaggctgatcttgaactcctgagctcaagcaatccactcgccttggcctcccaaagtgatgggattacagatgcagccaccacgcctggcccaaaaattctttttttaaaatcaactatttaaaccctccggcaatggtcctgagggcaaacaacaaatgaaaaaacacctattcaagaaaatctacaaattcggtaagaaagatgagagggtatggtatttgaaccaagatcattccctccttactcactcctagcttagtgaggtggagcttctactccagactattgcaaactgtaataccgggcactgctcccccagctcccaatcaaatgctttcttcccaggaaaagcaggacatcagcatttctcatcctacctagagctacttgttgctgaggttaaaacctgtgtgagtgcaattgaaagttggagctctctttttttttcttttgagacggagttttgctcttgttgctcaaactggagtgcaatggtgtgatctcgcctcaccgcagcctctgcttcccgggttcaagcgattctcccacatcagcctcccaagtagctgggattgcaggcttgcgccaccatgtctggctaattttgtatttttagtagaggcagggtttctccatgttggtcaggctggtcttgaactccctacctcaggtgatccacctgcctcggcctcccaaagtgttgggattataggcgtgagccactgtgccctgcgaaaagttggagctcccttcttccacctagtccctacttgtggaacaggactgtaccttggacatgacatactgaaattactggtgccccaattgctcatcccccagttcttgcaggctgagcctcaggttattgcggtcccctgcctccttccaccaagtgctcagttcctagagtgagggtatttctcagagagaatctttccagggtccttccccacagctccagagccttggctccgggattttgcctcaggagagaagcaggccctaaaacagatagctcctaatctctttccaatggcagtgacttcatttgcaacacagtgtggagaaattcatgcctaagggcaatctggagatgtgaaggttttggtaagaggcaactgggagatctgcggatttaatggagatgcagcctagactgtaggcctcctggtttgctggaaagaattggggaataagacagctggaagaagccattctaggatcagaagaaggatcaaacattgaccgcagcatggtggctcacgcctgtaatcccagcactttgggaggctgaggcaggcagatcatctgaggtcgggagtttgagaccagcttgaccaatatggtgaaccccatctctactaaaaatacaaaaattagctgggcatgggggcatacacttgtaatcccagctacttgggaggctgaagcaggaaaatcacgtgaactgggaggtggaagttgcagtgagccaagatcacgccactgcactccagcctgggtgacagtgaagctctgtcctgtcacaaaacaaaacattgaccacagacctctgaggtggtggatgtccctcctgtcctggttgtatcattatacattgtatattaatgtatcgaaatactacaggtacccccaacatgtgtacaactattatgaatcaataaaaaacaatttgaaaagtaaggtatgtggcagaggtggaaaaaaatgctttcctccaaacagccacaatttgattgtatcagtttgtagagtaagagcaagttatgcctcagtgtgttgttgaaaataatagaacaatatgccacaattagtggagcttcatagctgggtgtggtcaaggagagaatagaagagaaccctaccaaaaccactgtcatcccagggtgactgtgagcatacccaaagctgcacctccctgaagagcaatatcataggccttaacacttttcaggggaaatggatttcactcaaataatccagccagtcgctaaacaaataaataacaattggccctggagagggggtaccaatccccagagttgctacagtatattatctaaaatgtccagtttccaacaagaaattgtgagacgtacaaagaaacaggaaaatatgacacatacactggaaaaaagctggcagcagcaactgcctgtgagacaaggggccaaattaatgaaaaaggcttcaaactggcctatatatatattcacagtactatatatattcacaatactaaaggaaaatatgatgacaaagaagtaaaggatggtatgacactgttgcatcaattaaagaatatccataaagatatagaaattataaaaaaagaatcaaatgaaaattctggagttgaaagtacaataacagctgggcgcggtggctcacacctgtaatcccagcactttgggaggctgaggcgggcggatcacctgaggtcgggagttcgagaccagcctgaccaacatggtaaaaccccgtctctgctaaaaatacaaaaattagccaggcgtggtggccggcacctgtagtcccagctacgcgggaggctgaggcaggagaattccttgaacctgggaggcggaggttgcagtgagccaagatcgagccactgcacaccagcctgggcaacagagcaagactctgtctcaaaaaaaaaaaaaaaaaaaaaaaaagtacaataacaaatttaaaaattaactagagggactcaggactcaataacagatttgaactgggtgaagaaagaattcgttaattttttttttctttttgagacagagtctcgctctgttgcctaggctggagtgcagtggggcaatctcggctcactgcaacctctgcctccctggttcaagcgattctcctgcctcagccaccgcacagtggctttgggagtactctgggaggctgaggtgggtggatcacctgaggtcaggagttcaagaccagcctggccaacatggtgaaaccccatctctacaaaaatacaaaaatttagttgggcatgatggcgggtgcctgtaaccccagctacttgggaggttgaggcgggagaattgcttgaacccgggaggcggaggttgtagtgagcagagatcgtgccactgccctccaacctgggtgacagagcgagactccatccctgccctgaaaaaaaaaaaaaagatgtgaaacacatacaaaaaaaagtaaaatggcagttgaatgccaagtaattagataacttcaataaaatggacaaactcctagaaagatataaaccaccaaaattgacccaagaagagacactatctgaatagacctataacaagtaaagatattaaattagtaattgaggggactcgtggggtaacttgcccttgggaaccagtagtatggcatcgggctgcaagattggcctgtccatcctcaatgctacctggccaatttaggggcccagtgcctctggatgctagactctggggtcgattatctccaccggaatgtaatggatgaacatgcatgtgatggtgtccaagccagaacagtgggtaaagccaatggctataagaggagccaatcagtacatctttcatctcgaggaaactgagaacccaggggctttgattaaagacattcaggagaatgggatgaaggttggccttgccataaaaccaggaacctcagttcagtatttggcaccatgggctaatcaactaggtatgaccttggttatgacagtggaaccagggtttggagggcataaattcatggaagatatgatgttaaaggttcactggttgaggatccagttcccatctttggctatagaggtcgctggtggaatagatcctgacactgtccataggtgtgcagaggcgaagctaacatgattgtgtctggcagtgctatggtgaggagtgaagaccctagatctgtgatcagcctgttaagaaacatttgctcagaagctgctcagaaagattctcttgattgatgaaaccttaaggagcccaatgtttgtttatgaaatctcctttttactggaaaacaggaatattgactaccaaatcatagtgtagttgaagccattctgcgtttttgagcagttattcgtttcagtgattataattgattgtgcagagtattctaagaagttagaaattggtgtgtataactacattttcagtgatgcaatttaatgattagtgagtgagatactgtttttattgagagccttgatttttataaagagtaaaaatatggctgcattaagggtacaaacagaaaagtgtcttaatgtctaaggagggcatattagctacactataaaaacaatttttttctgtatttctgaaaagaattttgttgtttctcagttgttttccaaaagcaaaggaagtcttaatgtttttttctatttcgtgttatgtgtgatttgtttatatgcttggtaatatgagtctaatggaatttaaaaatataagtttgggtaggatagtatacccttaaaaaataaataaataattagagagagagagagagagagagacctgggcacagtggctgttgcctgtaatctcagcactttgggaggtcaaggcaggaggatcctttgaggccaggagcttgagaccaacctgggcaacatagagagaccccaactctaaaatatacatactatatctaaactcagctaggcgtggtggtgtgagcctggagtcccagctactcaggaggttaaggtgtgaggatcacttgatcccaggaggttgaggaggcagtgagctatgattgtgccacagtgcttcagccagggtgacagagtgagaccctgtctcttaaaaaaaagaaaagaggctgggtgcagtggctcatgcctgtaatcccagcactttgggaagccaaggtgggcagatcacgaggtcaggagttcaagaccagcctgtctaatatggtgaaaccccatctctactaaaaatacaaaaattagccgagcatggtggagtgcgcctgtagtcccagctactcgagaggctgaggcaggagaatcgcttgaacccgggaagttggaggttgcagtgagctgagattgcgccactgcactccagcctgggtgacaaagtgagactccatctcaaaaaaaaaaaaaaagaagaaagaaaagcaaagcaaagcccaggcctgtacctactagaggtcctgataacttcaccactgaattctatcaaacatttcaagaaaaattaatacagttcttcacaaagtcttcaaaaatgaaaaagaggagaaaatacttacaaacgaattttatgagactggtattaccctgttgccaaaaaccaggaaaagacattacaagaaaagaaaaccatagacaaatatatcttacaaatgtggaagcaaaaatcctcaacaaaaatactagcaaactgaatccagtaacatataaaaataattatataccataaacaagcaggatttattccaggagtgcaaggttggtttaacatccaaaaatgaattagtgtaaataatgtaatgcattatatcaatagaataaaaaacaaaaatcaccttgtcatctcagtagacacagaaaaagcatttgacaaaattcagcatgtttttcatgataaaaacactaaataaactaagaagagaagagcagttcctcaacctgatacacagcagttatgaaaaacccacagctaacttcataatagtgagactgaggccaggcacagtggctcacgcctgtaatcctaacactttaggaggccaaggttggagggatcacttgaggtcaggagttcaagaacagcctggccaacatggtgaaaccctgtctctactacaaatacaaaaaaaaattagccaggtgtggtggtgcatacctataattgtagctacttgggaggctgaggtgggaggattgcttgaacctgggaggcagaggttgcagtgagctgagatagcactactgcacacaataggctgggcgacagagctcaaaacaaacaaacaaacaaacaaaatagtgaaagactgtatgcttatccttaagattaggaaaaagagagataagtctactttcactactgctattcagcattgtactggaggttctagccagggcaattaggcaagaaaatgcaataaaatacatctatgttggaagggaacaagtaagatcatctctgcagatgacatgatcttgcatatagaccctgaggaatccactaccaaagtattggaactaataaattattagtttagtaaggttataggatacaagatcattacacaaaacttagttgtaaatgtatccacttggaatgaacaatctgaaaaggaaattaagaaaattccatttacaataacctaaaaaataaaaatacttataacaaaagaggtatctttttttccatcctctgacagtttagtaaaagaaagtataaaacttatactctaaaagctgtaaaacatttttggttttgttttttaaattaattttttttgaaacggagtctcactctgtcgtccaggctggaatgcggtggcgcgatctcggctcactgcaacctctgcctcccaggttaaagcgattctcctgcctcagcctccggagtagctggagctacaggtgtgcaccaccatgcctggctaatttttgtatttttagtatagagggggtttcaccatgttggccaggctggtctcgaactcctgacctcaggtgatccacccgcctcagcctctgaaagtcctgggattacaggcgtgagctagtgcgcccagcctggccttttaaaatatttaattaattgatttttttttttctcggacttgcactgaagtgagaacaagtgcagtggtgcaatcatatctcagtgcagcctagaccttccaggcttaagtgatcctcctatatcagcctcccaagcagctcagaccacaggcatgcgcgatcatccctagctttttttttttgtttgtttgttttttaatttcttgtagagacagagtctccctgtgttacccaggctggtcttgaacctgacctcaagcaacctcccatgttggcccctcaaagtgctgggattacaggtgtgagccaccgtgcctggcctgtaaaacatttttaaaagaaagaagatataaataaataaataaatagaaaatagctcttgttcatggatcataagacataacgttgtcaaattggcagtattttggaaattgatctacacgtttgacataatccctgtcagaatcccagtttatttcattgtagaaattgacaagtctccaggcgtagtggctcatgcctgtaatcccagcactttgggaggccgaggcaggcggatcacctgaggtcaggagttcaagaccagcctggccaacatggagaaaccctgtctctactaaaactacaaaattagccgggtgtggtggcacatacctgtaatcccaggtactcgggaggctgaggcagggaatcgcttgaacctgggaggcggagcttgcggtgagctgagatcacgcgccactgcactccagcttgggcaacaagagcgaaactccatctcaaaaaaaaaaaagaaattgacaagtcaattcataaattcctatggaatcgcaagggacccacaatagctaaatcttgaaaaagaacaaagcagaaagactcacgctttgtgatttcaagacatactataaaacaactaatcaagacaacgtcaccaggcaccgtggcttatgcctataatcccaacactttgggaggccaaggcaggcagatcacttgaggacaggagttcgagaccagcctgggcaacatggcgaaatcttgtctctaccaaaaatacaaaaattaaccgggcgtgggggtgcacacttgtagtccaagctgcttgggagggctgaggcacaagaatcccttgaacccaggaggtggaggttgcagtgagtcgagatcgtgctattgcactccagcctgggggacagagcgagattccatttcaaaaaaataaaaataaaaagacagtgtggtactggtataaggataaatgtgtagatcagtggcatagaattgagagtccagaaataaacccagtggaatagagttgagagttcatggtcacctgattcttgacaagggtgcaaagaccattcagtgggggagaactgtcttgtcttgtcttttcttgctacatgccacagactgtgagaaggaatagtcctttcttttcttttttctttttttttttgagatggagtctcgctctgtcatctaggctggagtgcagtggtgcaatcttggctcactgcaacctccgcctcctgggttcaagtgattttcctgcctcagcctcctgagtacctggactacaggcgcctgtcacaacgcccggctaatttttgtatttttagtagagatagggttccactatgttggccaggctagtctcgaactcctgacctcgtgatccacctgcctcagcctcccaaagtgctgggattacaggtgtgagccaccgcacccggccggaatagtcctttcaacaaatggagctgagacaactggatagccacatgcaaaaaaaagaagaaattaaacccttacctcacactacatacaaaaattaactcatggctgggcacggtggctcacacctgtaatcccagcactttgggaggccaaggcaggtggatcatgaggtcaggagttcaagacgaggctggccaacatggtgaaaccccatctctactaaaaatacaaaaagtaggccgggtgcggtggctcaacacctgtaatcccagcacttcgggaggccgaggtgggtggctcacgaggtcaggagatcaagaccatcctggctaacatggtgaaaccctgtctgtactaaaaatacaaaaacaaaattagctgggcgtggtggcgggcgcctgtagtcccagctacttaggaggctgaggcaggagaatggcgtgaatccaggaggtggagcttgcagtaagccgagatcgcactactgcactccggcctgggcgacagagggagactccatctaaaaaaaaaaaaaaaaattagctgggcatggtggcgggcacctgtaatcacagctacttgggaggctgaggcaggagaatcgcttgaacccaggggtgagctgagatcacgccattgcactctagcctgggtgacagggtgagtctccatcccccacccaaaaaaaagcttaaaatggatcaaagggccagttgaggtggctcaccccagtaatctgagcactttaggatgttgaggtggatggatcacttgaggccaggagtttgagaccagtctggccaacatggtgaaaccctgtctatattaaaaatacagaaattaggctgggtgtggtggctcatgcctgtaatcctagcactttgggaggctgaggcaggtggactgcttgaggacaggagttcaagactaccttggccaacatagcaaaaccccatctctactaaaaatacaaaaattagccagccgtggtggcatgctcttgtagtgccatctactctggaggctgagacatgagaatcacttgaactcgggaggtggaggttgcagtgagctcagattgtgctactgcactccaacctgggcaacaaagcaagactctgtctggaaaaaacaaaaacaaaaacaaaaaacaaatgtggagaaatgtgaacccttttacactgctggtaagaccgtaaaatggtgcagccagtttgaaaagcaaactagttagccaggcatggtgggtcatacatgtaattcctgcactttgggagaccaaggtgggaggatcacttgaagccagaattttgagaccagcctgggcaacagagtgagaccttttctctacaaaaaatttaaaaattagccaggcgtggtggcttgcacctgtagtcttagttacttgggaggttgaggtgggaggatcacttgagcctgggagaggctatagtgaggcatgactgcaccactgcacctccagcctggtaatcaaagcgagaccctgtctcaaaaaaaggaagacaattagctgggtgtggtagcgttcctctgtagtcacagctacttgagaggccaaggtggtaggattccttgagcccagaattttgaggttgcagttagctgtgattgtggtgctatactccaggctgggcgacagagtgagacccagtctcaaaaaagataaaaagaaaaacatggtggcagttcctcaaacagttaaacacagagttaccatataaccccacaattcaacttacagatgtcttctcaagagaaatgaaaacatagctttacgagaaaaacttatatgtgaatgtttatagtagtattattcataatagccagaaggtagaaacagttcaaatatacatcagctgatgaatggataaacaaaatgtggtctatccttactatggaattacttggcaataaaatagaatgaagtaccagcacgtgcttcaacatggatggaccttgaaaacactatgctatgtgaaagaaaccagccgcaaaagaacacatatgattccattcatatgcaaatctaggataggcatatctacagagacaaagtagatcagtggttgttcagggctgggaaaaatgggtggggtagagggtgtgatagctgaaatatacaaggttttatttatgaagtgatgaaaatactctaaaactgactggtgatggttgtacacactgaatgtactaaaaactactgaattatacactttaaatgggtgaattttagggtatatgaattatatatcaagatgtttaaaaaaaaccttaggcaaaatgtaaacaatgggcatgactgtgttccaagaaaactttatggacacagaaatttgaatttcacataattttcacaagaaaataaacattaaaaaatgtaacatgctgggcactgtggctcacgcatgtaatcccagcacttcgggaggccgaggtggacggatgacgaggtcaggagtttcataccagcctggccaatatgtaaaaccctgcctctactgaaaatagaaaaattagctgggcgtgatggcacacgcctgtaatcccagctactcgggaggctgaggcaggagaatcacttgaacctggaaggcggaggttgtggtgagctgagatcacgccgttgcactccagcctgggcaacaagagtgaaactccgtctcaagaaaaaaaaaaaaaaaaagtaaaaatcattcttagttctcaggccacacaaaaataggtggtgggttggatttgtcctgtgggccatagtttgctgatctctgatctaagttactatttgatagatgttagatgttgtgagagggtaagagagactagcctataaggaaagggattttagttttttgggggtttttttttttgagacggagtctcgctctgtcgcccaggttggaaagcaatggtgtgatctcagctcactgcaacctctgtcacccaggctcaagcgattcttctgcctcagcctcccaagtagctgggattacaggcatgtgccaccatgcccggctaatttttgtatttttagtagagatgggctttcaccatgttggccaggctgatcttgaactcctgacttcaggtgatccgccctccttggtctcccaaagtgctgggattacaggtgtgaaccactgtgtccatccaggaaagggattttgtatgacatttttcagccgcaattttgccaggaaaagctcttttttcttcattaagtagattccagacccaaagatgttggacagtattatcagctagagcaaggtttttcaaccctggcactattgacattttggctggatgattctttgttgtggggagctgtcttgtatgttctaggatgtttagcaggatctctggcctctacctactagatgccagtagcattcccccaccccatcccagttgttgtgacaaccaaaaatgtcttcagacattgtcaagtgtccctggggtagggaggacaccctccaatctcctctttctccctacccaacctccatgaccacattgagaaccactgatctatagaaaaggataatagtagtgacattcagagaggcaggatggtatagtgcaaagcttgccaaactttaattttacataaatgacctggggaatcttggaaaaatgtaggttctgattcagtagttctgggatggaagtgagaattttgtattaataacaaactctcaggtgatgatacctgtgccaccggcccaaggaccacactttgaatagcagagcagtagtagaaagtgcatcggctttgaaagaagacagacctgggcttgaattctagctaaaatacttctactttggacaagttacatagctctctggaccttattttctcattggtaaaatgagactaataatgctgaccctgcagagttcttataaggattcatggaatgcatagtccctggcagaaaggaagatataggagggactataattggcctaaagtaggaggctctggttaccatgggcactgccctgttgtgatttatcaagccattacacctcactgaacctcagatttccagtggaaaaacctgtttgtaaaccatgttcacatattctgttgaaagtaatcatagtttgatttatgatgatagggctcaggtaagtgattagttttattctcctgcctgctttttatgttgtccattaatgagcaaggtgctgatgcaaggagatggcagatgcattttgaaaaaaaaggagagagagagtacttgtagaattcttgactttattgaggtcaaatgtaggtggcttttcaagaaggactcaatttcagaaccggtggcatttaacatatgagtcatgttaccttatgctaataagttcagactttttttctttttactgcagagatagggggaaaaatctcctgcactacttgctgcattgctcaattggctggatgctttggaagatttttccacttgaaagatttgttgtttgtcattttgagaaagtgggtgctgagtgtaatttgccaggaggctaaacggctatgttatttcttatctaggctggaattttactctaataattcaatctatcagtaagaaaagccaaataggaagttgtaagagatcctaatactatcttatattgaaaacaaagcctccttctcctgttgtttggcattctaaatgttttcacatacctaagtgagattatgattgtattaaataccaacattgcagatcattccagcatacaagtggacgtaagttgtccataacagaaggaactttctaaaggggaagacagatagaacaattctggcattttcagtaaaatcttaaatcctaggctccctaggaccaggcaaaccatccccttcaaggatgtaaactctggagggcagtgtagttgtacagggtaatagttctatactctatattagtgcaacaagaaacttctattcctgtttcagaagtaagactgttatctacctttttttttttgagatggagtttcactcttgttgcccagactggagtgcatgatctcagctcaccaaaacctctgcctcctgggttcaagtgattctccagcctcagcctcccgaatagctgggaatacaggcatgtgccaacacgccctgctaatttttagatttttagtaaagacagggtttctccatgttggtcatgctggtctcgaactcctgacctcaggtgatccacctgccttggcctcccaaagtgctgggattacaggcacgagccactacgcctggcctgttatctacctttttaccgctgtgctctcccatgggttttttttgtttgtttgtttgtttgtttgttttgagatggagtctcgctctgttgcccaggctggagtgcagtggcgtgatctcagctcacttcaacctctgtctcctgggttcaagcaattctcctgcctcaacctcctgagtagctggaattacaggtgcctgccatcatgccaggctaatttttgtatttttagtagagatggggtcttaccatgttggtcaggctggtcttgaactcctgacctcatgatctgcctggctcggcctcccaaagtgctgggattacaggcatgagccaccgtgcccgacctctcccatgggttttaagtagtgcctatggatggcatgggtgccactactcaggtctaggacaggcaggggtgagtgatgagtgcgtgcgtgctgatgaaggggtgcgaagaaacagatgctggctagtgctgccctccactggaccccattctgcctttgtgtgggacaaagggctagggactagcagttactttgtgctaggtaccatgctaaatgctttaaatgcacactacctcatttgatataacagggactcatttattcattcaagagatattataaaataggctaggcacagtggctgacacctgtaatcccagtgggaggccggggtggccagatcacttgaggccaggagttcgagaccagtttgggcacatggtgaaatcctgtctctactgaaaacacaaaaattagccaggcgtggtagtgggcgcctgtagtcccagctactccggaggttgaggcaggagaattgcttgaacctgggaggtgagggttgcagtgagctgagatcgcgtcactgcactccagcctgggcgacaagagcgagactctgtctcaaaaaaaagacaataattaggcgtggttgtgcgcacctgtagtcctaactacttggtaggctgagacaagaggatcacttgagcccaggagttcgaggctgcagtgagctatgttcgtaccactgcatgaagcctgggtgacagagtgagactctgtctcttttatttatttgttttttaaataatagagacagggttggccgggcatggtggctcattcctgtaatcccagcactttgggaggctgaggcaggtggatccctgaggtcaggagttcaagaccagcctggccaacatgggaaaaactcgtctctactaaaaatagaaaaattagccgggggcaatggcatgtgcctgtaattccagctacttgggaggctgaggcaggataattgcctgaggtggaggttgcctgagattgagccactgcactccagcctggatgacagggagagactccgactccaaaaaaaaaaatagagatgggggtctccctacgttggttgctcaggctggtctcaaactcctgtgctcaagggatcctcctgcctcagcctcccaaagtgctaggattataggtgtgaaccaccacacgcagctctgatttactgggtgcccacgttgaccaggcagggaacacctcctagcagtgatcaaggactactttggacctaggttctgtaactgacttcatctttaagtggggaaacagaggctcagacaggatacatagcatgcttaaaggcttagtgcagccactatctattctgaaagaggcagaataggacagggacaggtaggtagtgagagaatagggagaatagatgggcacaccctttaacttaatatcgaccagtaaagcctgcagttgcttatttgaacctcacattgaggctgacatgtaagttgagcaaatcttaactcaagcttcagtttccttgttggggccgctgaggcagcatagcctagagattacaagcatagacttcagagtttgattcctggctctgcctctaaccagctttgcaaccttaaagctccttaaccccctcacatgcctctgttccctaactgtaaaatggtgaatgtaattaattcttcctgcatagtgttacaagaattaaatttgagtaattactggtaaagtacgtagaatagtacctaacacaagataagtgctatatataatggttgttacctaaagaaataacagcctgggcaacatggcgaaaccctatctctacaaaaaatacaaaaattagccggttgtggtggtgtgcacctgtggtcctagcatctcgggaggctgaggtgggaggatcacatgagcctgggaggtcgaggttgccataagcttcctgattgcaccactgcactccagcctgggtgacagagtgagaccttgtctcaaaaaataaataaataaaataaattaaaaaaataaaaaggaaataagttcagtgcctgtcgttagcttgctccctttctcagcctctcctccacttcctcacgcaccctcttgctctgagcctattatcctggtccctccttcacactgccacatctttgcataggctgttctctttgcctggaatgccattctcatttgttgcttggcagaactgaactcattctccttctaggctctgctcaagggtttcctcttctttgtgtccaaagtcaccacatagcttctaagtgatgggactgagatttgaagccaggtcatctgtctttcaggccagccctctttccactaccctatgctacccaaataggaagcgtaaaagagaagtaggagagaaaaagttagaaacctggagagaacttaggtatttggtaaacaggaaaaagaaagtggaaagaagagatcatttgaaggacttcctcaacttaacaactatttgcctatggcattattttattgcatttggtgtatgatactatctcaaaagcattttgtaaacttgccagtggcttacatttttgccggatgaatgacatgactaacgatccgtgctacattacctcagtgtctagtttgtcattttgaatcaagtggacattttctgtaagtgaatcattttcacttgctcatgatataatgagaattccttacctttggcttaaaatgaggcttatgttataacagttaagcattgtctagttgcatatttaacatagtcagaatgctcctgcctgtattcagcctggtgtcttataatatttggtatgcccacctagatagcaattggtaacatctttattctgagactctttcatgtatggattttgaaaagttagttaactgttcagacgacattgtttctttgacttttacaatccgcttccctctcactgacagttcagttttggaagaccctgtatttttttttttttttttttttttttttgagacagagactcgctctgtcgcccaggctggagtgcagtggcgtgatctctgctcactgcaacctccacctcccgggttcaagcaattctcttgcctcagcctcctgagtagctgggattatgggtgtgcaccaccacacatggctaatttttgtatttttagtagagacgaagtttcaccatgttggccaggacggtctcgatctcctgaccttgtgatcagcctgcctcggcctcccaaagtgctgggattacaggcgtgaaccaccgtgcccggccttttttttttttttttttttttcgagatggggtctcactcagactggagtgcagtggtgctatcacagctcactacagacttgacctgctgggctcaagtgattctcctgcctaagcctcccaagtagctgggactacaggcacatgccaccaatacctggctaatttttttgaagaaatgggatcccgctatgttgcctaggctggtctggaacttctgggctcaagcgatccttccgcctcagcctctcaaagtgctgggattacaggcatgagccaacatgcccagctagagatgtgtgtgaattggtagcttcaagctagatattggaggctcatgaagcccaggttaaagaggcttgtattcatcagatgcgatgaagagctttgaagtttttactagaagtgtgatttaaagtggttggcatgcaaaatgatttggaacgtttggggtttggggtagggagagagaggttggaagtaggaaacaattagaaggcaaacgctttgggcaaggtatcacattgaaacctgaacagcagtgggacttgctgggggttgggacaaaactaggcagatgtaagcatctagtgaatctagagattagggtgttctgtgaccaagaatgagcagaagacctgctaggctcaagattcaggagattctcaggtccaaagccagtcctcagtctccgaagtcagtcaggcagaagggaagttggatcaagctggccagagttgagctcaggaagtcagtgcactttctcttgtctggttcctgcatcgttttacttgtgtaaaatcatcaagatccctaaaccgatgtctgaacaccaggcttctaggcagagctccaccgtgtgaccttgggcgcatcacttatttcccccaggcctcagttcttctgaaagatgaggggaagaactcacattcaaaggccctcagctttagcgtcttattttaggtgatctgggcagaagagtctcactgtgctcctctccctttcatatttcctgctttggtaggaagtcatctcaagacttgagtgtataggcatgaggaagtctgctagaggacaggaagaatattgcttaaagaataagagctacagccctgatggaaggggtaaattggcctgggaaaagccctgcctctgctacctgcttcccaagtgaccttgaacttaactctttaaacctcagttgctgcatctataaaatgagaataatagtatcttttttatagggttttttttgttttgtttgtttgtttttagacggaatctccctctgttgcccaggctggagtgcagtggcacgatctcggctcactgcaacctttgcctcccgggttcaagcgattctcgtgcctcagcctcctgagtagctgggattataggagtgcaccaccacgcctagctaatttttgtatttttagtagagatggggttttgccatgttggctaggctggcctggaactcctaacctcaagtgattctcctgccttgacctccctaagtgctaggattacaggtgtgagccaacgtgcctggccagggttgttttgagacatgaatgaggtggacctttacaggcacttggttcagggcctgacccgtagtgagcatttgataaatgttacctatctatgttgtcatgggctgggagtgtgggaacaggaagtgtctcatgccagaagcactgtgaattttctcctttaatcattgccttcattttctttgaaccttattcagattgtccatgcctttgtaattgtagaccctctaaactataattagtccaaataaaatggactcaccttatgccatgttcttgttgaagggtcctctttctttctttctttctttctttctttctttctttctttctttctttctttctttctttctttctttctctttctctcctctttctgtctctctcttctttctctctctctctctctctctttctttctttctttctttctttttctttctttctcttttcttgctctattgccaggctggagtgcagtggtgagatctcggctcactgcaacctccgcctctgcctcccaggtttaagcgattctcctttctcagccttccgagaagctgggactacaggcgtgcgccactaatttttgtatttttaggagagacggggtttcaccatgttggccaggatggtctcgatctcttgacctcgtgatccacgctcctcggcctcccaaagtgttgggattacaggcacgagccattgcacccggccagatcttcttttttgtaacatgctaagtaatacaatctctatttagcttgatgtccacggtgatagcaggattcttttcggatttctgccatagttaattattctgcattcttttgtccctagtgtgtcatattgaaatttttcttttttctttgtttttgatgacttctccagttattcatgctagttttgcattcctgtccaagaacatttttgctgcttgtttatttttaatttcataaactaaagcgtttgaggttttaaaaacccagaattgagttttctcagagctgctaatctttctagccagctggtgacgaggcttctcaattcttgttacaggatgatgtgttctgtcctcctgtctgtgctttgtctaatttagattctaaatccacatgtttaggacatttttagcgtgtcaaaatttattaccaaagtagtgctgacttcagggaaaaatttttaatggaatctttagtcactcatgttgacacaaggtgcttgtcctagtgcaggaatctgtgtggcaccactaggtggtgccagactgcatcatttttaaagacagccttttctcttccaactcttttgccactgttctcttttttgcttctttgccaaatttggaccgagctttgaaaacttcatataaactttctcttagtgagttatgttgcttatagcttttccctccaccttgcctgttttagtcttcttgtttcaatagttttgatagtttgacattcagataaaacttaaaactgaagcccaaagtaattactaaatgtatctcgactgatctgtggttttaaattcaccaacagtgcatctccctacttgcttaatcatattgattttgagattaaatcagtctcataaatatgttagtcttcagcccacggtagttctcatccatctgcagactttttttttttttttttttgagatggagtctaactctgtcaccaggctggagtacagtggcgccatctcagctcatggcaatctctgcctcctgggttcaagcgattctcttgcctcagcctcccgagtagctgggactacaggtgcttgctaccacgcccagctaatttttgtatttttagtagagacagggtttcaccatgttggccaggatggtctcgatctcttgatctcgtgatccacccgcttcggtctcccaaagtgctgggattacatgtgcgagccaccacgcccagccccatctgcagatatttttaccagtcctatccactcatgcctgtaccttctaatgttattaaagtcagttttattatcattgatgaccatgagacttaatcaaaaggtcaagctagaaacagagaatattcaaaatttctttccaggcaaacatctgggttcaatagaagctagttcacatgaatggatcatgctctagctctgttgtgctggagcttttttgaaggaatgcattgttacatactaaccacaatttttacattgtccagggcaggagtaaccagttggttgatacttagtcaggggttgtgtttcgtaatctgctagttgtacttgatgtttaggcatttgaaatttaaccttgtgccttatttgtgctgaatttactattgtttcctatttgtagtgctctgcaaaattattctcagtatatcacacatttgtaatcattgccaatcactgaatatcaataacatgctaggtgataagaacttctatttttcagcagcattatcattcccaattttactacatcagagagttcatcattatacagtcaactcatgattattaggagtaaggaacgtaatagcagaccctgaatgagggaaaagaatgtgaaaccacacataaactaaaggtgaagtcatttacatccctgaaaatgattttaagatacagaatgagatgttaaaggatcaaaagaaaattatcgtagcaatgaaaaatgctacatggtttatacaaagtcatgtcaagctcatagactcagagagtggtgttaatcctgaagaccacttgatgattatggaagccgagacccaaagaggttaagtgacttacccagcacagcgggtttgggtgttttatagctgtttgactatatgagctatgattgctctcatgttgtgagctaaattccaaagatattgtcgtgtttgcttttgtggggactgtattgctttcatagcatgatggttgtattgtttctttttgctttgtcatctgtcagtcaactttgaagtgaatcttctttgtttacagcatagtaaaatatggtgattgcatggctcataagagatttacaaatgaagaaactgaggcccggttgagctgcatggcacacccaagtcatagacttgtgtgtggttgaggcagagaatctaggatacagacctccctgctgggttcctcccgctcccataactgctctgcacttcagcgggaaagatgccagaaactgcaagcataaggcctttttttcccctaaaaaactgtaattcatttggttttgaaagacttaccagagtttaaaagctccattttgtggcttcccaaggtgctgtgatttgtttcttactagtctcctttgttctgtggaaaattttcttctttggttgtttgagatttagatttccttgccaaggtatttttagagagaggaaatcagtatgtttcaccaaaggggtaaaatatataccttaaggcctaattatgcaattacatttttaataacgagtgtcataaattcttgcttcattgcaatcattaattggaagactgttctgctcagaagcctcatctagttatcatgattatcatcaacatcgtcaaccaaccacaagcatcaagcatttatggagtatccacagattatgcagcacttgccagggttctgggagacttaatctgtgtgtgtgtgtgtgtgtgtgtgtgtgtgtgtgtgtgtgtgtgtacacccttgccttcaaggagtttgtgatctgcagaactggaggaaagacagaaaacttggggaaagacaagtacctcatttttcaatatgtgtaaagcccatactgattcatgtatgtggcattgggggacatggacagcagggagacaaagggatagatcttagaaaggtctagttacaaataaatggaagcacataagtttgctgacatgggaggacataggctgggttgtaataaggtagggtaattggttgaaggagggaggaagaaattggtgaagagttgaaggcagtaattaaatagatttggcataataacagagatgattggagaactgggagaagaaaattacttgctgtagttgattatggcagaaactgacagggcaagagattacagttgggattttttgcaaagaggagctttcaagtttgtgacatctttttttttttttttttttttttgagatagtcttgctctgtcaccctagctggagtgcagtggcgtgatcttggtttactgcaacctctgcctcccaagttcaagcgattctcctgcctcagcttcccaagtagctgggactacaggtatgcgccaccacgcccaactagtttttgtatttttagtagagacggggtttcaccatgttggccaggctggtctcgaactcctgacctcaggtgatccacctgtctcggcctcccaaagtgctggagttacaggcatgagccactgcgcctggcctccaagtttgtgagatcttgcccagatttaaatgaaggatgtggggttcaggattggtacagcagaggaaaaaagtctctctctctccccactcccctctttttgctgtgatctattttttttcccacacttttcacaggtgttgtcctgtgatctatttctatttggtggatctcttttcccctcatgttgagaataatggctgaggtgtggtgtatcctttaattttgaaaggaaacggcatgatggttttgcggtttaatcatgagacacaagaacagcttttgttgtgtggtgataccataccctgaattgagattatcagtgtcagacatatattactgcacttttttatcttcttcgcttaatcaaaatagattttaatggaatttattattcacttactgtacagtaaaattacttttataactttccattgtgtttttcttgtaaattgaggtatttggcctctatttttcaaaacagacaaaagttgtattcaggttaggtttggatctggtatattagcatcttaaattctcaagtctcctataaacctgttctcttaggccagctatggctgcagaagtcagttatagataaacattgagaggggagatcacatcatcctttgttttccatttctgaaataacggcagacacgtggcacatgtcctgagcctggggtggtgccgttccttttgttgctctatctgtatgggagctaaccttttgacaatttttatggcaaatgctagggcagcttgtgagctaattagaagaaactgataagtgaatgctgagtttgtcgattctctttcattttctgcagaggagacagccgttgaaacggcattcttcgtgtggctgataatttagcccaccagacccctatgaaagggaatattgcttctctcttagctttttccacattttagtattctctttaaagccaacatttctccataggttctaatacctaggcatttcatatatagtagccaaattcagttcactttcttcaagaaagttgtccttttcaaactgtggccttttcctgtcatgggtctggtttcttactcaccccgcactgttgtatcagcaggtactaggatttgattgctgatgactgtatgtcccaaagaaaacagtgggagaaatgcagctgtcaaagcaaaaaacaaatagcagttttaaggttgagtctcaacctggccagttgcaagatggctgttcagtagatgttattcctaatgcttccctggttaatagaactcaatcagtcctgcaggttattggtgctggttgcttcctataacagaaaagtactgcattccagctacgttcctgctgtggaacataagtgcttagtgctatttacttaaaacattctaggttgataaattacaagcccttcactctgggtaaagctcataaatccagctcctacaaaaaaaatagcaagctgatagcacttagtcctgtttataaagttcatacacatctatccatgatataggcacaagtatatatctatgaaatagcactgcagcctgttaaagtaatgggtgagcacagccacaaaggcgagaagcatccgacttccagactcctcctattagtctctatgcctgaagggcaccttgaggaggaggtctgtggaagggagcttccaggcattggagtccacatttgtgctcctttctctctttcttcttcccgcaagtcacctttctcacgccctccacctctctctttccttctgcaaaatgagcatctgcctcttagcctccctcttcgtcactaggctgagatgaggcagggaaccgtggtggatccagagcagtttgaacactttggctgcgtggaaagcgatggggttaaatgagcatttaatcagaaccaggagctgttcttttggcaacctgttgaggaaaaatgataaaccctaacaaaaaggccctcaagtggcacgagtgcagggcctgaaagcgttacgtgccatcagttatccaaaaagaacattttttaaccagaaaataaacatgagactcatcccactagtcctaggttcttggagccccacaggtattgttgcaggatgcatcattgcttcgaatcagtgactgaacaacccagttcctaatcagcgtggagagtcagaattgtcacacgcactgggctgaagctgcatattcagtactgcattgaacattcagtactgcagataggataattatgctgtttgtcagatactagaaaagtgcaaagaacattccttcactttgcaacagcttggacccaagtggcagacctgctgttccctcaggctggcgtgacctccctattgtcagccccttcaccacagctcaactacccccctggctttcaagatacagctcaaacagcatctctcctcaggaaagaccttactcccggagacccaggcccgagttgtgttgccactgtaccctgttctgttagcacttaccaggttgcatttttgtgatccatttacctgtcttccctgtcagacatgaacagggacagtgtcttgtcctcaattcatcatttttctcctgttttgagcacaatgaccaggacgtagtggatgctcaataaaggtttgtcaaatgactgatagtatggttagctcagtgagaattgatggtgccctttgtgatctgtcatccatcatccttggtgtgaagcagggctgggaggctttaaacagtgccacttgagaatctaaggagaggtggcagagttacaattaacaataactaccccttactgagtatttatttgctatgggccaagcactctcttagggtttttaaatgaatcaatgcacttaatccttagatcaatctgctaagacgagttctgtttattatcccctttgcaaagcacaaggaagttcagtcacttgcccaaggtcacacagtgacagtgcagagattcataccaatggagacaaccatcacttatctatattccttttagactagttcctggaaagattaagccctcatgtcctgaggcatccatcttaggtaacaatttaacttctctcttgtttctagaatggtattagtgtgttccctacttgggagaatggagaaaatggtcaccagataactttctgtgttttttggttcagatgagataggtagagttagttgacaaagaattgattttatgtatttatttttattttgttttttttgttcttgattttagatggtagtttcggtccttttggaaacatagcattatcctccagccagactgaactatcctactcccatttcctgtaaggacgactgacctcttttttgcctctagacttgtgcatatgctattccctctgcctggaacatacttacctgcttgctcctctttccccaagcccagtcttcacttggttcctcttttctaccatgagccagtttagatgtcatttccctacctgcccaggataggaggttcccacagccgctgggtgtcctgttgtggcactcacaagtgttatagtgctgaaagcccactcctggggtttttatgtgtgcgatgaaggaggtgattatcttttcccagctagttcatatcctagtcctctgagtgtagagacttgtttctttttccccatttgtcccctgcaccttgggcggtgcttggacacaatgtgtgtgttcactaactatttgtggaagaggtgggtgagcgggagttaactggctttaagtctttgagttttgggtttttgaagtagtcaagtccgtccacagtccgtcctgtggacagccattgtttgccatgtcttgtatgtacacacttgcctgggcactgtggggagcagaaagaggactaatactgcccttgtgctgaggcacctacagtctcgggagatgttcagaggacagtgagtcacttcacagcatcagcatggtatagtggatgagtgatgacactgaagatgagcttggtcatattctggcaagttggctgacacctggaagtcccgtccacaccccaagacctcttttcccagggtgtcctgagaaccacccagagcaactgtgaccaatggcgcttgtttttaaagaagtagaaacccaaattaggaagactgagcaaacctcatgcatttggggaagggcttgttggaaagtggaacctgatgtaggtagcaacatgttgaggttagatttaaccaaacagaaagacttcttaattgcttaaagacaaaattttattttataagtggaattagggctttaaatcaaatatgtttgaacgtctttacttggtttcctcaggcaccttcactcatcttgtctaaaacttaattgctggtctatccctgccagatttgctgcttctccttgattccatctctcctttagtggaaccacctggtactcaagccagacacacaggtgtccctcttaattctgtctcctctggtcctgttcaggcacctgttctgtgactctgcctcttttccgtttctcaggctgccttctctcccttctactgccttccttatgtcaggggttggcctactttctggccttcttgatccagggcttcttttgttcaactcatactccaccctgttgtcagagcccatccagattgcagattggagcctatgactcgtctgctcaagggtcttcaaagactttgcagcttttggctgaagttgagccacctggtcccaaatggagccccattcccgccatgccacctcctgtctgtttaagctttacaagatgacttgcagtttcctgtagaaagcatgacttttaaaaaaagacttatttccttctctcctgcatctaactctcacttgctctttaaagccttctctgacctaggtcttgcctgtttctcctgcagaacactgcttccaccattttgtagcatcagtgtctaacattggttggcatgtagggtgtgctctataatccttgttgaaagaataagtgggaggtaacagaggcttaattcacattgagctgtaaacgagcaatatctgactcttctgagaatggattttgtttcaaacactggttacttactggaaaaggtgtctggggagtgctggacagcaagaacaaagggaccccacagaacaggaaaagaggcactctagggtctgcggtttgcctatgttagatcaccgtgaaaaaggccagtgtatgctttggcagctggcaaagaatcctgtgactcagtttccttatttgcacaaaaagggtatgagtctacattaggtaattactcatgctcatttccaactcttgacagtctacgatcctttgtgtcaaagttaaaaatctaagtagggcattctgaattggtgtcagagttgatgcacttctcactgtattgcaagtgccaaggggacaaatacattgtctttttgcattcaacaaagacagttttgcattttaaaaacaaagtagaagggaatacaggaaaactgcattaatacaattttatgctggagaatttaaactcccatgtcaggaaattcactcatcattcccttggcagcttttgtttctctgcactgcacaccccacttacagacagccccttcttgccaaagcccagcccagccatgaccatgagttatggcagattgggaatcgttaccttgatcttctcaacccttgggtgtttaccttttccaagttaatgcctgttctttaatgttacattatcttgtagcaaggtagtcatttataatttatatactagagctgccttaaaatagagacaagaggataatcagcatcctgaaacttctagttttccaaaataacatttcttcagtgaagtctgcctgtaggaattaaaacttttggtgaattaaaaagctttttgtcctattgtcagactgggaaatggatgtgcccattactcagccttaaaaacgaggaaggagatcatctgttaaaaataaaactcatcattttcttttattcttctcaaaataatccctaaagacctcaatctttatagtgttccagtggccccactatagtcagagaggagacagggcagaagttgaaggacagataggagaaacggccctgctaaaagataaaagccagtatgcatctcagctacttgtctgctgtggtcctgatattcttccatctaggttgctgctttgcttgactttgactgcaaacacagagaagggatgggctttcctgttgagtaccttgtagagaacccactgttcattcatatgtgttaaaaatgaaaagcctacttgaaaactcccctgtagaatcaggttttagcaaaaaccaatcaggtatcagaggtctaacttatttttcccttcttggttttatagcaagtctctaaaccctaagattttttgtttgtttgtttgagatggagtcttgctttgtcgccaggctggagtgcagtggcatgatctcggctcactgcaacctccgcctcccggtttcgagtgattcccctgcctcagcctcccgagtagctgggactacaggcatgcgctaccacacctggctaattttttagtattttactagagacagggtttcaccatgttggccaggatggtctcgatctcctgacctcatgattcgcctgcctcagcctcccaaagtgctgggattacaggtgtgaaccaccacgcccggctgcctaagaatttttttcattccttttcattatatacatcttcagtgtgccaagactttgagtggagatttctaatgagggcaggaagggacggatgcttctgcaattgagtggtctcatttttcccatgtctgtcgaaagattactctttcatgaccaccatttctatgatgcatctcatatgatcctaatgcactcgagtttgtatttgaatgtccatctgatatttaggggtggttggggcaaggagggggcaagcagcaactaaggggttgtatgggaacatcctggtggtttaacttgaaagccactaggtggcaacatttactaagttgccagccattctcttcccttaagacattgaacttgcttttccacatagcagatggaatagctgagaaaagagattgccattgcttcaggttcttttgaaagtgaggctataggataaacacactacagtatattgatatctattcgtcacctgggtttagataccaggagtttgaatttgctctgggtgactgggtgagtagcttcccctttggcctcagttaggcatccttgacaggacagacctgtgattggactgtctggtctctcatggttctttttctccatgatttatgactttgattatgatttctttatattaaaaaaaaacttgtagtaaaaccagtcttatttaaaggaatactagccttttatcaaagggcaaagtaatgatttaaaaaaaaaatcaacaacaaaatttcaagggaatgaatgtccctagaagctagccatctccccgagttaacttaagaggctagactctcctaaatgaggatgcttatttaccagctttcctaaattagcagctttggagatgttaaaatccgtaaggaactgtccaagggatgtattgtgtatgctttgcagtgattaagccattaagctctaattggtattttcccactcatgggtttgtaaaggaagctttaaaattatttaggaattcagtcctcatcagctgtcttagtgtcatccccacgttttggaacctgagagtggagagtgcagagaaaaggttttattaatgatttttgctcacagtgtccttccccattggtttgttattgcagatgaagtggaaagggaaggacctctttgatttggtgtgccggactctggggctccgagaaacctggttctttggactgcagtacacaatcaaggacacagtggcctggctcaaaatggacaagaaggttgggctagaactcgatgaaactggtggggctgacgtgagctttccagtttttccctgagcaggcgcctagctcatcactggggcgctgtagctgtatagtagagaagggggcacattcctgaattaagtcatgcagaaagcaggacgtagagatgctaccagtttccttctcctcacaggctctcctgggcaagcagaagttaccaggattagactgctgctggccctggcttctttacccattgttaccagcctgattgcttctggctttatgcctttcagtttatgaataaaaacttcatgaataaaaattactgttatcttcatatacttaaaaataaccaatttgtgtcttttagagagtattggggcttgtgttctttagggaattttttaaagtctttttgaggaacaccatagtctgacatgaagtaatcattaatatgatctaaggaatagagagtgcctggtccccagggtgaaagaatgtccattttgtcctcaggattctctggggcttctgacacatggccaagaaagctgggctcctggcaattttaatgtggcttggaaatgaatattgcctaaaggaactgccctctgcatgggttcatatgttcacacaaggatacacttgcttactgacctgcctacctagccatgaaaggcaggcggggagcaggaccatatgcttttgtcagtaactcctaaaagacacctgaacttcaaagtaagtcaatgtctaattcttaccccaaatgatgccccctccagttgcctacctgagcataataaataatgaaagcttcctattttttttttttttaccagtttgactcaaagcttaagtgttcgaattgtgttcacatatgtacacagtaatctaaataatcacatgggaatccctgctggttgtaagttcaatggtaattcccaatgatcatgagcatctaagtgccactgggggccactgtcagtgagggtgtcgtagaccagattttgaatctccttggcattgccatctagaatttgggcaggagcatggagagttatgtgtcaaagacagcaaaactttttgtatgtttttcatgattcttagcaaagtgaattttaatgatagctgagtgtaggccaaatggatattagactgggggcatcaggagccgtggaacttgctgctcaagggaaatacatcatgacacatgttaatggagccttgtagcctgtcacatggcgtgtttatgtcttgaaattcactctggagagcagatggttcaagctttacaggggtgaatggaattgttagaagatttaaaggcagtggtttacagactgtgcttcaagtattttgtggggcatctctggaggttccttgaaacaaagggttgccatgatggacacattttattctgttgctcagttaatgtttagatgacttcataatgatctagttcatcatctctaagctgtattttttttttttttttttaagacagagttttgctcttgttgcccaggctgcagtacaatgacgcagtctcggctcactgcaacctctacctcctgggttcaagagattctcctgcctcagcctcccgagtagctggaattacaggtgtccaccaccacacctggctaattttttgtatttttagtagagatggggtttcaccatgttggccaggctggtcttgaactcctgacctcaggtgatccacccgctgtggcctcccagcgtgctgggattataggtgtgagccaccacgcccagcgctctaagccgtattctatcacggacctaaatattggcagtaggcaccaagaaaaaagaaataaaggaagattccactacttcagataattaaaaaaccttccacctaccataaaggacagtgtccaagactgctgagtgatacatttctagtttttaactattctgtggccctgagaacatttatgccttaatcctagctctgctcacttcttggggctattgattaatttgtttcagaaacaccataggaagtgaatattacctcttgctataggtgactttgtgaatacttcaaactgtaaaatcacaactttcaggaaatgtgataaatttagtgggaaaaaaatttaatgcacgccttgcaaaggcttctttgagggtagcacaggaggaagtgccaatatagtgtgtttgtcttttgctctgcaattctgcaggtactggatcatgatgtttcaaaggaagaaccagtcacctttcacttcttggccaaattttatcctgagaatgctgaagaggagctggttcaggagatcacacaacatttattcttcttacaggtacatcagtcaaggctaccccccagttctgagagaacttgcccaggagtggttgcagagttggcctcagagttgaccacaaacacctttgtattgcaaaaatattctacctctggaaggtcagcccctttggttctgtaatggaaaaaaggcttcagaacagaactatacttgagtgatgaaaattggtgtcagatgaaattgtgaaggtgtgatggtgaagaatggatacaagtagctacctaacttaaaacctccttgaaaatgggtcctattttcttctagctaacttaaaagtactcaatagtttcaaaggaaggctaaagagagagtcttataaagcagtagttcttccaaaagtttaaaatctgctctcattaagagaggactggccgggcatggtggctcaggcctgtaatcccagcactttaggaggccgaggcgggcagatcacaaggtcaggagatcgagaccatctggctaacatggtgaaaccccgtctctactaaatatacaaaaattagccgggtgtggtggcaggtgcctgtagtcccagctactcgggaggctgaggcaggagaatcacttgaacctggaagatggaggttgcagtgagccaagatcgcgccactgcactccagcttgggcaacagagtgaggttccgtctcaaaaaaaaaaaaaaaaaaaaaaaaaaggacttcagccgggcgggttggctcacccctgtaatcccagcactttgggaggctgaggcgggcagatcacgaggtcaggagttcaagaccagcctgaccaacatggtgaaactccatgtctactaaaaatacaaaaattagccaggcatggtgatgcatgcctgtaatcccagctactcaggaggctgaggcaggagaatcacttgaacccaggaggcggaggttgcagtgagccaaaattgagtcacttcactctagcctgggtgacagagtgagactctgtcttaaaaaaaaaaaaaaaaaaaaaaaaagaggacttcagagctctagtgacacttggtttgtcccccatatgtggtacttcagacatcgtgcttcatgctatgctgtgtctctaattgtcctatttcttccttaattcctcattagattgtaagccccttaaaggcaagcctcattaagtacacagtaggcattccataagtaattgtcccaccgaattgaagaaattaagaaattcacaattacaggttgaccatccagaggcacagggaggggaactggtctgaggatgaaaaccttatcagtttcacttatgttcttactgcaggtcagagtggctccccagtttcatggccagttgcagtgattggcactggggctatttgtgtgctcaaaggtttcagtaatgtaaaagatggcagtaggggcattaattacatgatttcccagagatagttgggtagtctgtcacatagccctcctgtaattaatttcagcctcagtatattgtggtcagcaaatattaagttaaatataataaaaccccctaaattctttttaaaaaaggtctggggggcgtgtgtgtgtgtgtgtgtgtgtgcacgcgcaaaagaggtgacaaatttatttctgatgtttgcagatcaaagggacactcttaggctgggcgtggtggctcatgcctgtaatcccagcaatttgggaggccgaggcgggtggatcacctgaggtcaggagtttgagaccaccctgaccaacatggagaaaccccgtccctactaaaaatacaaaattagccgggcatggtggcacatgcctgtaatcccagctacttgggagactgaggcaggggaatcacttgaacccgggaggtggaggttgcagtgagccgagattgcgccattgcactccagcctgggcaaccagagtgaaactccttctcaaaagaaaagggatgttcttgcagtttttctatagcgttgctttttcccccctctctttggaaatgaaaccaagggattagaaagttgcactgcttgagaaacatctcaggtttcattttctctctaagaatgtaaaatcacttttaaaacctaagaagaatttttgtgtttgaacgtaaacacctaacaatctcctaggtcccagaatgtcctaatgttatagaaatggctttcttgtaagtacttggaagcactgcctgtctcttgtgtgactgacttgattttccccatactgaaatgttaaggcatttttatgactgagcaaggcaaaatttactgcttttatgaatccggtgactgttgacatctgtgagaggagagctggctttcctgctgtgtttatttcagtgtccccctgccacgtcatgcagttgtcttgcttctgtgtctggaacatcccaagttgcaccattctaagaaaattaagtgcaatgaaatatgttaattcaacattatggcttaagaattatatttcctggacctcacgtgtacttaaaagttgaatcgatcaaattttattgcttccttttcccttagagcagcacgttgagagtgatggttttttctgcaatcataactcagtggccttggtgacttttgtcttgtgttaatacttaaaagtagatccatttcctctggggccatgcatattcaaaggggctgaggctgtagtcatccccagagctgctcttgacacttcttgagttcatagcgctctgtcacacagcctctgttgtaactacagagaccgtttttactcttcagcattgatcatgaagagaagagataaggggtttttatgcatagccgtcataccagtaacttctgtgactgaactctccacctgtctgcatcagtaaaaaaaaaattgtaccctttgtcagaaaattattaacaggctgctctggcagccctcattagaacgccgtgaggccatctgttgtgatcagcctacacacctcacttccactcacagagtatcatgtctcccttgttgctcctttcaggtaaagaagcagattttagatgaaaagatctactgccctcctgaggcttctgtgctcctggcttcttacgccgtccaggccaaggtaggctcaaagaagaaaaatgtatttttcctgggcgttaatttgggtcatgggatcactcctatcttctctttctttgggttttctgtacttcagagagacttgccccagaaagtgagatgttatgggacttgtggacttgaagaaccactgtcactgttccagtgtttgtataatcttgtgtgtgtatgtgtgtgtgtgtgtatgtgtgtgtgtggtgtgcagaaattataagtatcgttctaatgaattagaattcattctaagtgaattcattcagaaagatgaatttcctgtgtaatctcattatgtacatgtggtttatgacatttactggaaaaaccttttttcttttttttttttaaaccataaactcaaccatgtggtacaacctttctattagccaggaaaaatgaatttatggtctccaattttagccaaacatggcctttaggtcagaaaggcccaggtcctcactccaaactcatttgcaaacaagctgccttgtgtgtggacactacactacaccttcagagaatgccctgcttcatctgcccctgattgacatgctagctgttcatgtggctaagcactgcaggtgctgtggcccaccaagcccacttgagctgtctggttagctgaaaatcgttcacttccgttaaatcactatagaccttttttttttttttacaagaccgatgagagggttagccacggagtttcatgtccctcagatttttcacttcagtcatatatcaccttctcttggttcccctgatccctgcctttcaccagagcacaagatgttgtccccagaattggggctccttgattacttgtgtgattttattttatttatgttttatttgtatttttatagagatggggtctcactatgttgtccaggctggtcttgaactcctgagctcaagtgatccttccaccttggcctcccaaagtgctgggattacaggtctgagtcaccatgcctggtcttacttgtgtgatttttttttttttttttattgatcattcttgggtgtttctcacagagggggctttggcagggtcataggacaatagtggagggaaggtcagcagataaacaagtgaacaaaggtctctggttttcctaggcagaggaccctgcggacttccgcagcgtttgtgtccctgggtacttgagattagggagtggtgatgactcttaatgagcatgctgccttcaagcatctgtttaacaaagcacatcttgcaccgcccttaatccatttaaccctgagtggacatagcacatgtttcagagagcacagggttgggggtaaggtcacagatcaacaggatcccaaggcagaagaatttttcttagtacagaacaaaatgaaaagtctcccgtgtctacttctttctacacagacacggcaaccatccgatttctcaatcttttccccacctttcccccctttctattccacaaagccgccattgtcatcctggcccgttctcaatgagctgttgggcacacctcccagacggggtggtggccgggcagaggggctccttacttcccagtaggggcggccgggcagaggcgcccctcacctcccggatggggcggctggccgggcggggggctgaccccccaacctccctcccggacggggcggctggcctggcggggggctgacccccccacctccctcccggacggggcggctggcctggccggggggctgacccccccacctccctcccggacggggtggctgccgggcggagacgctcctcacttcccagacggggtggctgccgggcggaggggctcctcacttctcatatggggcggctgcctggcggaggagctcctcacttcacagacggggcggttgccaggcagagggtctcctcacttctcagacggggcggccgggcagagatgctcctcacctcccagacggggtggcggccgggcagaggcgctcctcacatcccagacggggcggcggggcagaggcgctccccacatcccagacgatgggcggccgggcagagacgctcctcacttcctagatgtgatggcggccgggaagaggcgctcctcacttcccagatgggatggcggctgggcagagacgctcctcactttccagactgggcagccaggcagaggggctcctcacatcccagacgatgggcggccaggcagagacgctcctcacttcccagacggggtggcggccgggcagaggctgcaatctcggcactttgggaggccaaggcaggcggctgggaggtggaggttgtagcgagccgagatcacgccactgcactccagcctgggcaccattgagcactgagtgaacgagactccgtctgcaatcccggcacctcgggaggccgaggctggcggatcactcgcggttaggagctggagaccggcccggccaacacagcgaaaccccgtctccaccaaaaaaatacgaaaacccgtcaggcgtggtggcgcgcgcctgcaattgcaggcactcggcaggctgaggcaggagaatcaggcagggaggttgcagtgagccgagatggcagcagtatagtccagctttggctcggcatgagagggagaccgtggaaagagagggagagggagaccatggggagagggagaccatggggagagggagagggagagggcacttgtgtgattttaaaacataatcttttcacttatttttctttttaattaaaggtgttcatgaagccatttcccttaaggttagaaaaaataataaaatactcttaactcactttttggggtagattaatgcaatttcagatcaaagccaggaagtaactgtcatttgtggggaaaaaaggctatacatgctagtcagaccaatagaagcaccaaagtcaatttaatcatttgatggctcatgtaatatttgctgagtattcatcaggcccagggtggggagagagcatgagagttgttgaccatctcatagttgcaggcactaaagcaagtatctgccctcagtgatttgcccaagatcattcagacaatcttgggcaaagctaagagcagaagggtagaattcatggctttgagattgcattttgtgcctccaatattctactttcctgaaaaattagtaattgagaaaacagaaaatgggccctcattcaactaaaacatatgcttccttttatgctttgatcaagaatattagtaagaggaaaaatgtgtcctttcaatcagtatcaccccgacagtgatgaagcagtcattggcactttgattaaatccgagcacttcctggcctggagttgagttccttttcgcacgctttctccccagcgagagcagacccagcctctcaaggacaccacctctctttgaagggcttccatctcaaaggctacattttctttccatggatttttgggccacaaattcaaaggccacctgtagaaaaaaattacttttcagtgaaccagcagatgtttgcttaaacaggtttcactgtaggaaagccctgctaatttggatcgtactaatttggagatgaaagtgattcacagacgacatatgtggctcacatggaggaggatgttctagctattttttctggtgtaaattttaaggatcttacaaataaaggtaatctatggcttaaagtcttcatttgggaaactaaggcttactatgacatacttccagtttctaggactgctggttaatagttaaaggatatctgattataatattaataagatcttacatgcccatagtgttttctagttttaccaaagcaatacaaatgaatattttgtgcgacactcagtgtagtctttccagaagccaaggcttgagagtattatgcctgttttgcagatgaggaatttaaggctcagaaagggatttgtgacttgtgcaaactcacaatacttttatgttaagcctatttttatgaaatttttagcccacttctcgatggagaggatttcaggccaaatagaatgagtggagctgggatgggaaccctagtgtccaggctgcctaagttagcacattgcacttgcctgtcactgtctagcttgagggaggtctttgggtagcaaccactgcctttcactaaaggctagtttcatttatatgatcacatttgtctaagttcttcagtaagtcatactggttccttccattatattcagcttgttttcttccacaacctttctgaaacagaaaggaactttagaagtgtggaagggaaagcgaattgagctcattaacacatggaatgtaattatgcacaaatgtattcattacagtatttcagctgttggaatgatatagacacagttaattccaaagcataaagaaacaattaccctcaaagtataaatacaatactaatcacatggttcagttaacaagaaccatatatgagttatacttgaatcaaaagtgtaggcagggactgggcacagtggctcacacctgtaatcctagcactttgggaggccaaggaggatggatcacctgaggtcaggagttctagaccagcctgaccaatgtggtgaaacctaatctctactaaaaatacaaaaattagccaggcgtggtggtgtagtcccagctacttgggaggctgagacaggaggattgcttgaacctgggaggtggaggttacagtgagctgagattgagccattgcactccagcctgggtgacaaagtgagactccatctcaaaaaaaaaaaaaaaaatgtagtcagggtttttttggtgcagtcacatgacacactaaaccatcttgcaatgtttaagtcacctgttggattgtatattgaccatttggtgttggaaatgtgttcttattgaaaatgactttgggagagaatggcatataatttatgaatctcatgttgctgtgtgcagactcctagtgatcagaagagagaaaagaattgtgggaagggaagcttagtttcttagtactctttaatgcaaatcagggacagagtgccaaagtacaattgagttagaaaattgagtgtgtaaagtgtaggtagagagtggcaagagttgaggctggagaggtatgcaaaaaatcagatcttaaaaggtcttaactttatcctgtaggcgatgcagtgaagggtttatattttagatagagcctgtagtggctgtgtgatggacagattggagtgagacaactttggaaacagggagacctattagaaggctgtgatagttgccctggtgagagaatattaggttcacacttcaggtggttggttggatgggggctgactgatttaaaaatatccaggagataaaaagttgattagatggtgctatactctgcatatccctttttttcatatccttttacagaatggtatttttcttcccactcagcatctactttgagatgtatccatgttgtgtgtatagatgtagctcactgattttaattgatttaatatggtaaccactgataaataaacctagtttatttatctgttcctcttctgagggagaggtagtttgtttccactttttccttattatctaaacagtgctcaaatgaagatccttttatgtgattccttatgtacatgtgcaaatgctttttccccttaaggtaggtgcctacgaaaataaataaataaatacatacatacaaaaaatagctgggtgcagtggtgggcgcctgtagtcccagctacttgggagactgaggcagaagaatcgcttgaatccgggaggcagaagttgcagagagccaagatcacaccactgcactccagcctggacgacagagtgagactccatctcaaaataaataaataaataaataaataaataaataaagtaaaaaaattaaaaaaggtaggtgtctagaagaagaattgcatagaattgacagaagaggtgaaccccaatataaaaaaaatcttaagttgataaaaagacaaatgctataaacagggcatgaaacatgcactttatagaagagaaaacaagaatggtcataaatacaaaaagatgtttcatctcacaggtaatcaagaaaaagaaaaaacaacaataaggcaacatttcaaacccataagattggcagggattactagattgggtaactgcattgttggtgctcatttacctgccaaagggattgtgaaattggcataacctctgtagagcaccaagtgtggaagggacgggtggaagtgaggagacacaccgctggctgttccaggtggctactccagaggaatctctgcacacacatccttttcacttaaaactgtcacaacagatagacccacttcattttctttttctttttgagacagcagtctctctctgtcacccaggtggcacaatctccacccactacaacttctgcctcccaggctcaagggatcctcccacctcagcctcagcgtatgccctgctaatttttgtgttttttgtagagacagggtttccccttgttgcccaggcaggtcccaaactccagggcacaaactctatacccgcctcagcctcccaaagtgcagggattacaggcatgaatcactgcacctgaccccagctcattttcatttaactgccgaactatgtttcatagaaaggagggactggattatttaaatatatctttattggtagatatttaggtttgtttttctttctgttgtttttctattggtgaaacagatgcaatggacatccttgaatatgcatctttgggcatatatggataatatctctctataatagatatcaagacatggtataactgggttaaagaataagaacatttaaaatgtaagtaatgtgaagcaaaaaaaaaagccagacacaaaaggccacatattttatgcttccacttacctgtagatgaaatgtccagaacaggcaaatccatagagacagaaagtagatttagtggttgccagggaaagggagaaggaggaaattaggagtgactgatactggccaggcacggtggctcacacctgtaatcccaacactttgggaggctgaagtgggtggatcactggaggccaggagcttgagaccagcttggccacatggcaaaaccctgtctctacttggccgggtgcggtggctcacgcctgtaatcccaactctcagggaggcaagaggtgggaggatagcttgagcccaggagttcgagacctgcctgggcaatatagcgagacccctttctccagaaaaaggcaaaaacaaaacaaaacaaaacaaaacaaaagacaaaaaatatataaaagccagctgtggtggcatatgcctgtaatcccagctactcaggaggctgaggcacgagaatcacttgaacccaggaggcagaggttgcagtgagctgagattgcacccctgcactctagcctggggtgacagagtgagactctgtctgaaaaataaaataaaaataaaaaaggagccactggtacaaaaaaaaaaaagaaaaaatgagtaagacctactatttgatagcacaacagggtgactatagtcaataataattatacacttaaaaataactacaagaacataattggattgtttgtaaaacaaaggataaatgcttgaggggatggacaccccattctccatgatgtgattatttcacattgcacaccgtatcaaaacatctcaggtaccacacaaatatatatatacctactatgtacccacaaacattaaaaattaaaaataaatataacttacaaagattaaaaatgaaattagaagtgatggctagtgggtacaggacttctttttggggtgatggaaatgttctggaattagatagtggtgatggttgcacaagattctgaatatactaaaaaacactgaattgtacacttaatgtaaattttatgtatataaattttatctcaataaaaaatttaaatagatatagccaaatcaccctccaaaactgatgtcataatttaactttcaataacagtgtgtgagaatacctgtttttccacattcttgcgaacagtagatactatcagtctttaaaatttttgctaattgatagaaaaagattttttaaaatttgcatttccttgattgctattgggactgaacgtcttttcataaacttactgtccatttgtatttctttgttctgtgaatcaaccgtttatgacttgcctactactgtattgtttgtttgtttctttctttttctttctttctctttctctttctttctctctctctctccttcctccctccccttccttttctttcctttttcttttctttctcccttcccttcccttctctcccctttgctcccctcccctccccttctgtttctttttcttttctttcttcctttcttcctttcccaggttcaagtgatccatccgcctcagcctccagaggagccgggactataggcatgcgccaccatgccaagctaatttttgtatttttagtacagatgaggtttcaccatgttggccagactggtctggaactcctgacctcaggtgatccatccgcctcggcctctcaaagtgctgggattacaggcatgagccactgcacccaacctgttcatctttttccgattgatttgtagatgctccatgtattatgagttatcaaccttttgtctattttacgtataggactggtcaatctttttctttgtatgttttgagtgacttttagaatgcgtttaccaaccattattatatccatactctgttatgttttgttctggtatttttatggattttcatttataggtttaagaatttattgactggtgtgtgggtatagtagggagggggtctgtcttttttctatatatgtagtaatctaacctttatgtttttgtgaaatcctactcagagcattttatctcatttctcatagttatagacaggaaattatttcatatccagatagagcctccgtttaacctaagtattggctccacaagtcttttaaatggtaaactccttgaatttaaattcaattagtttatgtcacgagtaggtccaggttttctgggtctgaattttaataatttaggggattgtctttaatgcaagagtaccaaattaggtacaggcatatgaaggtgcagagacctgaaatccaagcttccttagcttcccagtaaattcaccctggttacattatcagaatgcatctgttacataaaacgatgaggagcagccatctccatccctggagtggtatgactttcttttgtattcaccagctaccacaacttcaggatttttttcttcccttgttgtttaaagagacatttaagagcagacacatacatcaaggtggctttaatgttggaagcagagttagtccagtggagaagttctttcagcagggtctttgccacctctgcattgctcaaatgtgatgtatttgatcagtggactagctgagaacttggtataataatgggggttgttaatcttgcatgcctttggaacctgaatttacagctttaactttgcatatctgcttgcttttgcattagagcttggtcagcactgttgagagatttgcaaatgcaactaacagggctttcttttagcatcctaccctttcaaaaatccaggaggcaaacaatgatcaatgttgtcataagtaatgcagaggatggcaataataataatacctgactttcaccataagccatgtgctgtgcgaaatgcttacctgtattgttttacttcatcctcatcatcccctataaggcagatgctattatgaccctcactctacagatgaggaagttgaggcttagagagaggatgccttactcaaggcctcagaaggggtacttcagcacccccccacttcccttcaggatcctctaaggccagtgctctcatttgacaaatgaaagacagatttggagagacctgagatcttttggacatcaggtttatgtgtcaagcatagttttatttattttattttattttgttattttttgagatggagttttgctcttgttgcccaggctgtagtgcaatggcatgatcttggctcactgcaacctccgcctcccgggttcaagcgattctcctgcctcagcctcccgaatagctgggattacaggcatgtaccaccacgcctggctgattttgtatttttagtagagacgggtttctccatttggtcaggctgctctcaaactctcaacttcaggtgatctgcccgcctaggcctcccaaaagtgctgggattacaggtgtgagccaccacgcccagccaagcatagttttaaaaactttgctggtcttatttaattaaatccctgtaagagtcctgcaagataaatactattattattcctgttttacagatgagaaagctgagacacaaaaatttccaaggccacatagctactatgtgaaagatgtaggataaaaccttaggcagcctgcctccagagccaggctcctaccctcactctacagctgccttgcagggagtactgttaaagcttagtacagttacgacttactgcatcacatctctgagcctcccagaaatagagagataccaaggcctttcatttataatttctaagttattttttatttttatagacagggtcttccactgtcactcaggctggagtgtagtggcacaatcacagctcactgtagccttaacccgtgggctcaagtgaccctcccattttggcctcccaaagtcctaggattacaggcatgagccatggtgcccaccctatttttttaaatgaagaaatgcctaaactgtgttacaaaaactgtggcatgtttaaaatgtttaaatttgacaaattaggccaggcgcggtggctgacgcctgtaatctcagcactttgggaggctgaggcgggcagatcacaacatcagaagtccgagaccagcctggccaacatggtgaaaccctgtctctactaaaaatacagaaattagcccggggtggtggcgtgcacctgtaatcccagttgctcaggatactgaggcaggagaattgcttgaacctgggaggtggaggttgcggtgagctgagatcacgccattgcactccagcctgggtgacagagcgagactctgtctcaaaaaaaaaaaaaaaaaaaattgacaaattaattctcttaagattcaaaaaaaacaatgcaatacaattctgctatttgaaagataattatgagattcaaaagaaatatgaattcatggggcttttacagttaaggtgatatgggaatgagacatgatttaaagttaatgatgaatatcttctttcactcctgtgtctgtagttttaggccgcttcatttggagaacacaccagaagtcttaacttgaggctctttgagaatgagagaacataacgaaataatgagatttggtggtatatagaaacagcagccttgtgcctgacctttgttttttcactgttggtggctaaaagaataaatgtttatagattatactgaagtactgagctttgttgtttttggtaaaatgaagagccactgtacgctgattgataagagataggctttgattttatattctactgtatgtttcagttagtttctttttaaacattctttaacttttgattatttccttatcagacttgagttttctaggaaaggagtttttttttttaatcagagaataaatttccaagtcattgtccccggagggataaattaaaatgcagggcctatttccaaccgcattagtgacttctctgtagctttaggaagatcaattaaccttttactcacttctttgtctgtacaataggaatggcagtgttgacatcagatttttccaaagtatttttcagaaacttgggtgaaaggtattaaaactactgcctgcattattcctggatccccctagtaatgggctccaattaccagtcacttataagaatttataggtaagactcttatcatatgttgttaatcacaactttcacagttgtgatttggtgttttaattcaaaagctactgttttggaagtgactgctttctttgagggttagaaaacatgcccacatttccatacaagtgtcacattcttgttagcacatcacccatccatctcttacaggattatgcaactcagttcatagatataatcagctttgtattttcattcaaggataacaaactagcaaggttgaaatcttgacttgtcatcggaattgaattgctccctggagctgggagggaatgagattggtccagctctgttcagaaatggcagttatctttagaatctcaatcgcctgctctccctttcttctttccagtatggtgactacgaccccagtgttcacaagcggggatttttggcccaagaggaattgcttccaaaaagggtaagagattaaattcccttttcaggaagacatagcagatatgtggtctaaaagaaagctaaccaaaggacttgaaggaatattggaagtacatagcaatttaattttaataaatattttgtaatctccagtaaacagtgtgggatctctgttaagaatattaaaaagcaaaggtttttggagttagtttggggtcaccaggactagcatggcctgtaaatgttttttctagcgtggttgttttttcagatgcagttgagcatcattgattcccaaagaggaggctggagcagagtgtattcagcttggggaattgagctgtttgcagtggcgaggggcggatagaggagatgaggtaggggtgggcattgtggtttttaatcctcagtgttgttcatcttattcattagccacagaagcaggcccgccctcccttttgctcctgccgattttacagccctcactcatctgtcactgggtaataaaggcccgtttctcacctctcactctctttacctgtccctcgatggcttctgagcatgtgaaggcctgagatgagtgagcattgcttctgactgagctccgctgtcagaggtggtctctgtgatgtatcgcccaggcagggacaggggcactgccagatgagggttgcacctaggtctgagttatcatgcagctttctgagttgctcctccaatagaatggtgccttatttacacgccctctctctgtgtgactatctccctgggtgtagctttttaaaaatagctttactgttttgtaaaaatgatgcataattataaaagtggcaaacaataccaaatttacttcatgtgtaggttttttattttgctctattttttggtaggtaataaatctgtatcagatgactccggaaatgtgggaggagagaattactgcttggtacgcagagcaccgaggccgagccaggtgaggcccattcattgttggtttacattcctttatgggcttttttttttttttttgccttaaagaactgcaaaactaggacatgcttgttaaacaaaatgcagtactgaagtctataaaagaaaaggggagagctggggagctgggagtaacgttggtcttcagttttgtgtgtgtccttttctagtacgtatgacataaagtaggtatgtgtactgcctgtcaagatatatagacctgtactcactggtaattaagtttaagatttttttttttttttgagacagagtcttgctctgttgtccaggctgaaatgcagtggcgccatctcagctcactgcagccttgacctcctgggttcaagcaaacctcctgcctcagcacccccagtagctggcactacaggcacacgccaccatgcccagctagtttttctatttttagtagagatggggtttcaacatgttacccaggctggtcttcaactcctgggctcaaagcaatctgcccacctcggcctcccaaagtgttgggattagaggcgtgagctgagccactgtgcctagcctgaattttaagaattctattgtatggctatcccattgcttttgcatccatccctttattgatggcatttgagtatctgtaggtttttcacttttacaaaaatttctgcagtgcacaatcttttatttttatacaattgtatgagtagttctggggatatattctttttttttttttttttttttttgagacggagtctcactcagtcacccaggctggagtgcagtggcgcgatctcggctcactgcatctccgcctcccaggttcacgccattctcctgcctcagcctcccgagtagctgggactacaggcacccgccaccacgcctaggctaattttttgtgtttttagtagagatggggtttcactgtgttagccgggatggtctcgatctcctgacctcgtgatctgcctgcctcggcctcccaaagtgctgggattacaggcatgagccaccgcgcccagccaatatattctttaaaacaagagttgttgggacaaaggatgtgagcattttgcattttgccaggtaccaccaaattgttctccaaaaaggctgtacctgtttatacatgcctgtcgacaagtgttatgagagtgtcccaccccccacccccagtctatcctcaacaattgtttttatcagtctaatttttgtaatctaaaaagtgaaaagttgtattatgttagaattccattcccttgattaggaattggtcatgttttcattagcctttaacatttttttctcttcttcaaatcagtttcctaacacttttttttttaaacttaagtgcaacatgcatatggaaaagtagacaaattataagtatacaacttgatcaattattgtaaggtgaaaacaccagaggaagaaataacctgtgtctccctacccccaattcccctttcttcctccccaaaggcaaccagtctcctgatttttaattccagattggcgttgcccatcttaaactttgcattctgttttttgtgtctccttttactcagcatcatgttgtcagattggggtttgtggcatgtggcaatagttttctcattttcattgctgtatagacttccactgtattagtatattaaaaattatttattcattctactaatgatggacagttaggttgttgggttgtcccctgagttttgctattacaataatgtcaaacaatttcccaaagtaattgtaccaatttacgtcaatgtgcatgatttctgatttctccaccttttcaccaacacttggcgttctctcaggctgggtttttaaaaattcattgagagcatttggagattggagagagaaggaagaggacaaggtcatagggagacttgagttaaaatatttcagtatgatacctgtttgggagttttctgcaagttattgctacttcaagagcttactttaaattataacttagatgaaggtgatctgacttgggttttacaacccagataactcttgccctaacctccaacaatactcaggaagcttgcagagagagctgtttcatttccagaaccttccaggtaaagaaagtacacaaaggaaaagcaagaacttaaataaaattccaacacccaaatctgtttgagggtagaagataacataccacacactcttgttgaattacttgagatgagtttactgtttaccaagggcaaggtgggaaactaaggccaagaaactccgtgatgagtctgttctctgactatcttttgatggggatgggaaattctgcttgacctcagtgtgtttaatagactcagggccgggcagagctttgctggtgtctgctgtggcttttgtcttctggcagcgacgtggctctagaggaatggcagggtcagaatgcttgatttggtgcccacccgctctccacccatctcacttagctccaatgacagtgtcttccgttctccccacagggatgaagctgaaatggaatatctgaagatagctcaggacctggagatgtacggtgtgaactactttgcaatccgggtgtgttgaaacctctctgagctccttgtgtagtagacagagactgagtgagggccagactgctaaaatggttacttcttcattccaaggcgatagactcttttatggttctgtggtaaagaaggaaagaggaaggaaagagaggtcttagtgcctaactttctatttttggacttcaattagatcataggtaattaagtgtcacttgagccttgggggacttggacctggttctgctctcagcagaaacctgtttgaatgctctgagtgtaagatttgattatttctggctctgtgagatctccgtccacagggagcacttgtaagtacttctccccccaacacacaccccacccccatccccacccccacccccaccccaggcactagtagagtagatctgcctttatagattactgatttgtttgggattctcactatgaggctaattggttttctattcagactattaatagtctgctgtctgctgggaacccactgcttctgcagggagaggcatttgtgtgcagcccagatctgggcctttagaatgtctttctcctgtgggtcagtatctggatgcagtgtataggcagcttcttacaaagggatgcatgcgatttgccaaagcatttcactacggactccaaactgcagatgagtagatgttaaaacaatgaggcgggtccacctttattttcatagtcatgctttgctttcccttattgggttcctacagttgttgtattaaattcaggtaaattgaaacatattttaaatattctaggatagctttctacttcatttgtattttgtaaatacagatttgtatggattacactgcataagaaaataaggcacacttaaagtgcctaaaagatgctccataatagtacaggaagttcttttctaaagttctgtcagtttgtatttgctaattgcttggtttctttaaggtcaaactaatgtaacacatttctgtggttttgtcaactcaactcctcttgccccatgttctggccacctagattctagaaaactaaagttttataatcctcagaaaacagtttttttggtttttaaaaatcttttttgttttttagaggtggagttttgctatatcgcccaggcctgctaggctcaagtgatccttccaccccagccttccaagtagctggggagtatcactgtgcctggctgaaaaggtttcttattagggaatatttctacatcagtcagactaatggatactgttttttgtgtgtgtttcctatattgagcaatagacaaagctactggctatcttagtgtcttttatgttaaatttcctgaaatctcaccattaactaaggaagatgtatgcttaaaacagtttaaaaggggctgcttgagtcctcacctctctctctgtttaatctctaggagtgttggagtcataatggtaggaggcagaaggctgaatctttttttaaaaatttaaactaaatagtcagaaactattttctgactattgaaacacaatgaaacatctcattttccaaaatgtactgcagatgtaaaagtacaaagcctcacttctattaatgcagtagctttcatggctttgctgacgagcagaagagtctctcatggtttggtgatagcacctgacttcaggatgttaggagtaaaaagatttatgctggagtactcactcctcagtctgatatctgctgttagatgggtacttctcttcacagtcccagtaccttctcagtttgcagacctgtttttctgcccttgagtcttggttcagtttccattatcgtcaaggggtcaggagctgtagtatccttgtgcagcgagtttccttccactccaaatgagggctagaccacagcactggcgggtggacctgcacgtgaagatacagccactcagtccgtcgcaggttcagtgctgtgggagcccagggcacccgccgcgggctgctctgactgctggccaggaccgctgtcaggggcagagcataagtacggcttttagacaactttgttgatgaatagaattctttttgatatgtatttcccatcatgcaattattaaaaatttcaaacttacaggaaaactgaaagaatttttcagtgaatacccatatatatgcacaatctagattctacagttaacattttaccagacttgctttatcacatgaagactacattttatcataaaatgagaccatccagccccaggcactgaaaattttcttcctagtagtccaacaatggtttctttaaatataagaaatcattaaacctatgggttttttttgttttgttttttaacgaagtctctctttgtcgaccaggctggagtgccggggcaccatctcagctcactgcagccttctgggttcaaccagttctcctgctcagcctcctgagtagctgggattacaggcgcgtgccaccatgcccggctaatttttttgtgtgtatttttagtagagatggggtttcaccatgctggccaggctggtcttgaactcctgacctcgtgaaccgcccgcctcggcctcccaaagtgctgggattacaggcatgagccactgctccccgcctaaacctatgggctttaattctatacctatgatagcctgcttatttaaccagagggaacaacacttatgttactcttcctttagccatcgagccagtgacagaagccctcagtgattgttctgggggacccagaagtcacaagaatggaacagttttgcttctacctgccccaattcagaaagctgaaatcttcttggtttataagacagctgtgacttctgttgggacctgctgaaacttgtcacatgtgacagtgtgtgccagattctttggaaggttgaataaaattttgagcctcagctggcgcttacagtagctgttcttattggatccacagaataaaaagggcacagagctgctgcttggagtggatgccctggggcttcacatttatgaccctgagaacagactgacccccaagatctccttcccgtggaatgaaatccgaaacatctcgtacagtgacaaggaggtaggacatgtgtgtactgcagatgggtccagcagatctttccctgtctgcccccctcactggagcctccccagccagggcatctccttgttattcatagagtcctttaattcccaggctttgagggtgtggttgttgattttcgaagtctttacagaacagtattggcatcaataaccccactatgactaataggaaactgggaagctcaactggccagggagaaaccccaaagaatagtgaacaaaaacagtaacattttcttattacttggctttctatttttgtcgatacattctctttgtatgttttcttttcttttttagagacaggatttcattatgcatgcccagactggatttgaatcctgggctcaagcaatccttccacctcagcctcctgagtagctactacaggtgtgcgccacagcacctggcttaaattctcttcgtattttaagtgtggtctttattgagctttctttctgtgtccggtgcttgatacatgtggcagagaaatacatatacacacatatacacatatggacatatatgtgttttgtgtgtgtatctctcagtaattatataaataagtatattaggttaatatgcttacaagaattccaaaataattaaggtggaataacttagataaatgctcttagaatttaaatatttccatatagggtggtgacttttaccaaaaaggtcccataatgtataatcttatgtttactcatccatccattcattcattcactcatccattcattcattcttcattcattttattttattattatcattttttgagacaggctctcattctgtcaccgaggctggaatgcagtggcacatgatcacggctcactgcagccttgacctccctgggctcaggtgatcctctcacctcagcctcccaggtaacagactacaggcgtgtgccaccacatctggctaattttttgtagagatggggttttgccacattgcccaccaggctggtcttgaacttctgggcttgagcaatcctcccacctcagcctcccaaagtgctggaattacaggtgtgagccactgtgctcagcagttcttcattaattttaaaggaattattgagcatctgctttgtgttagatttcatgggggaaacaaagatgtagaaaatccagtcttagcattcaaggaagtcaagtaactactcacctgctataataaataagtgccgtggaagagacatgatgacaacaaatgtagtcttccacatacaagcacattcaccctgaccgtctgaatttaatctctataagaacactgctgtaaaggcaggggctgtgttgtcaatatctctgtgtcacatcaggaagcagagacacagaaggatcaagtgacctgtgtctgagtgaagtagcagagattaggagccagagttgctgatgccacagcccccgcctttcagggaggcccagaggctgagtcctgagagcacaggggcactggggagagggaggctccactcagtgacctcctggtacctgcacagccaggacacagactagagagtgaagaacaggaacagcttatgttgctgcctgcagagccccaaacctgagcatatttcctgttttctctttttcatggcaactcaaggaagggaacaccaggcccctggtttccagtatatggttgggatctactcagccatgcttgataagacagactgagccccttaattcaaaacattctgactttgaagtttttgttagtagttagcccaggagataagcagttaggtatttcttttttaaagtacttaaattgaaagttccacatgacataaagctgtatgtgtgccaccgtatggtagtttttcatctcccaatttcataaagtctgtttattgcacgtccacacatttgtgtgctaaaggctccctaaacacccgttcttcaaagaagccaaggattgaaatctcccatactatggcctgacacagtaaactctaatatgccctctccgggggacaggcgccatcatgttccatcatgtcaataactcatgcagtaagcagaccccaagctgacttgacataaaagaagtagtcttggtagttatgcatgacagccatgctgtcaaaacagaaatgttagtttattttaaatgatccattgattctttgtgtacgccctggcatggtgcagagcctgcggtttccccactacttgtggtttcccaatgacagctccagggtttgacagcaaagccaaaaataagctcacaaaattcatgaatagcagcctacacaagagcaacactgcttctaagttaacttggctgaaagctaaacaaaggatcattttctgtcctcagtgtactaaccccttcttgggcaatataacgtgtgaaagaaatatatcttcccaaacatatttatctgcttagcaagtctttcttgggaatggatatccattttgtaagtgcatcttggaaatctaggatctgtttggtcttatcgggagtggttgagagcagcagccatttgttccttgcaggctttcctgctagtggtctaaccctaggttctcctaccaagccaccaccctgtctttatcattcatctttctctccattttgatttcagcatcaagaactgttttcccttctactatagtccattttttccccatttgattctattaacagcttttaccaaattattcccatgttcagaaacctgtggtgagctcaggtatcctgtcacatcaaacctaaacccttcttttttttgagataggggtctgctctgttgcccagcctggagtgcagttgtgcaattacagctcactgcagcctcaaactcttggcctcaagcgatcctcctgctttggccttccaaagtgttgggattacgggtgtgagccaccatatctggccgcctctgacttttattctcactgccagcccctacacccaccccttcctccctctcaggctaaacctattatatcatcttagtcaccaaaaagctaataccacacacacacacacacacacacacacacacacacagctcatttccctgtctctaccttatttctggttttgccctgtgcagaatgccccttcacctgccttttagctaccctgttggattgttcttctaagatcagcttcactctctcttgcttatggtggatctactctgaacctccacatatttgtgatttgtaccacccagtgaagcactaatatttgatgtgatttcttgagtaattggctgttgttagcctagttccaactagatggtgagcttcatgaaggtgggcccatgccctcgactacagtagccctccagtgttggcctcagggttgggcccattaaggatgcttattttaggttgtcaagaatcccttcccacactcatgcctaagatggtctagagagcgtacctttagggtcctgagcttccacagcccgagacttggtgctcctaattccctgaggtttagtgcctggatactgggaagccaggacaaggcataacttcatgctggtctgtggccagtgtggttgcgcatttgtggaatttccaattgctggtaacattccaggctgtcggactgaaactgtgttctgcttcattcttccagtttactattaaaccactggataagaaaattgatgtcttcaagtttaactcctcaaagcttcgtgttaataagctggtaagttgagatcctggttttcattactgataatggtagcttttctgagaattgaatacttctttttaaaggatatcagagtgacatcttgtgaagtatagaatggtatctcacttggcgcatactttctgtttagcttaaagagttaaaactaaattatatcatgaagaagtttttttttttgttttttttttgagacagagtctcgctctgtcgcccaggctggagtgcagtggcagtgccatctcggctcactgcaacgtccgcctcccagattcaagagattctcctggctcagcctcccaagtagctgggattacaggcatgagacaccatgcccagctaatttttgtattttcagtagagacggggtttcaccatattggtaaggctggtctcgaactcctgacctcaggtgacccatccgcctgggcttcccaaagtgctgggattacagtcatgacccactgcgcccagccgatgaggaatttttaaaaaggatttttaatgcagtatttcatacatataaaaggataagtgtaacatatgaattataaagaataacaaaagtgaatagctgtgtacccacaaccccactttaagaaatagcacagtcctggccgggtgcggtggcttacgcctgtaatcccagcactttgggtggccgagacgggtggatcacaaggtcaggaaaaaaaaaaaaaaagaaaaagaaaaaggaaaaaagaaatagcacagtcccaatactgttgagacccttcatgttaacaccctgctggtctctcctttccctctccccaagggtgatcactgttttgagttgagtattcatcatcctcttgcttttcaacagaattttatttcatatatggcaaaagaaaaataccattcaatgtcatatgtttatgaaatttatctaaatgctgtcaagtatatatattcttttgtcattttccttttcctttttcattatttttttgagatatatctttgttgatgcttaaagatagtctgttcattctcacctctgtagcactctgttatatatttttctgattcttctgttaatggataattaagtgctttttacttctatacttttttttttgaaatggggtctcactctgttgcccaggcacaatctcggctcactgcaacctccgcctcccggatttaagcaattctcctgcctcagcctcctgagtagctgggattacaggcggccactaccacgcccggctaatttttgtatttttagtagagatggtgtttcaccatgttggtcaggctggtctcgaactcctgaccttgtgatctgcccaccttggcctcccaaagtgctgggattacaggcgtgagccactgcacccagccacttctatactgttttaacaggctgttatgaaaacttttgtatctgcctcctggtgcacataggcaatagtttctttggagtcttgagtatactgggctaggtggggtggctcacgcctgtaatctcagcacttggagaggtcaaggcaggataactgtttgaggccaggagttcgagaccaacctgggcaacatagcaagaccctgtctccaaaaaaatgaaaataaataaaatttttaaataataaaaaagagggccaggcacagtggctcaactcctgtaatcccagcactttgggaggctgaggcaggcggatcacctgaggtcaggagttcaagaccagcctgaccaacatggagaaatcctgtctctactaaaaatacaaaattagctgggcgtggtggcgcatgcctataaatcccagctacttaggaggctgaggcaggagatcgcttgaacccaggaggtggaggttgcagtgagccgagatcatgccattgcactccagcctgggcaacaagagtaaaacttcgtctccaaaaaaaaaataaatacataaaaataaatcaaaaatagagcttagagtatatacacaggagtagaagtacagggcttggtatatgtttaaatttcaaaattatgacacattgttttctaaagaaggtgaatcgatttttacagacccaacagtagtgggtgaagtttgttttttgctatccttaatacttgtattatcagccttttaaaatttttgccaatcttgtgcatctaaaatggtatctcattatcaaatgaactttttttttttgagattttgagatagggtctcactctgttgcccaggctgaaatgtaatgacacgatcatgtctcactgcagcatggacctgcccaggctcagtgatcctcccacctcaccctccccagtagctgggactacagacacacaccaccatgcccagctaattttttgtattttttttatagagacaaagttttgccatgttgtccaggcttgtcttaaactcctgggctcaagcaatctgcctgcctccccttcccaaagtgctaggattacacttcccaaagtgctgagccaccaggtctggccaaatgttttgagttttttgtggagatggcgtctcactatgtcacccaggctggtcttgaactcctgggctcaaggatcctctcaccttggcctccgaaagtgctgggattacaggtgtgagctactgcacctagcctgttttctttattggctatatcttccagtttgttgctctttttctttttttatgtcttgacaataagaatttttaattttaatgtagacaaatatatacattttttccttaatcactttttgtgtcttacttggcatcttctcttatcctatgatcataaagatattcttctatattgtcttctaaaagtttcaagggcttaatctttgcatttaagtatttaatccttctggagttgatttttgtgtaaggtgtaagggagggatacaacttatttttttccacatgcataacctgttgcctcagcccagcttactgaacgagctttcctatcctccctggtctgcagaaccacatcttgatgtaggagagtaaggtgcacccagaagacatggtgaagtgtcctccagtcctctcttgatttatgatttttacctcctggcatatctgaggcgccttcattttgcatgtttccagagctgacggcactagaggccactagtagggctttggtgtttcactctatgcattcatcttcacgtttactgctacctgcaagagctcaaactgctatggcactagtgggccagtaggcagtgaagtaaatttgtggatattaacctttttgtctgcttctgtggccacagattctccagctatgtatcgggaaccatgatctatttatgaggagaaggaaagccgattctttggaagttcagcagatgaaagcccaggccagggaggagaaggctagaaagcaggtgagcacaaccttgttttaactgatgatgtcactgtgtggtcagtcctggcctgggaggcgaggagtggtcatgggctggcaggagtcttttggccgtggacatacctgctcttgttttataccttttggatcttcatttgccgatgcctacctggtgggatgtcatctctggaaatgaggaataaaccctaatagcatatctaaaagaaacatctctagtaatttctacgcttggagaaattaagtgtgattaacaccagtttgggatgaaatagccaagagtgcatgcatctatccgtccggctagctagcttgctttctttttttgcctgtctgcctccttgtgcagccttctccttttctaattagatggtgatagaatgccaggtggcatttcagtgcttgcggctggaatgctaatttgactctggctgcaattccccactgcaggtcaggccttatggcatgtcacctgccccaggaggtgccaggagcatctatcagcagactggatgatctgcatcattgttttctactcataaaccttctctgctcatggaaatccacacaactaatttgggccttactgctgagaatatcaattgtgtttttggataaactactagatagagtagcagcagctgcagttggctgcccgcaggacttgcaagctcagaagtgtaataattagtctgtgtgcacctttctgatttggatacattggagaggctggtcccagccctaggatttagaatgaaatgcccagtgtgctttcagctctctatctctttgctttctgaggtagtgggccacaaatgtgttctttgggatgctttcagggtgatgggatggatttgttggacaaagaaatcctactgagccagcatggggtcatagtggcagtttcatgaagagctcgtggcagtggctcatccctataactccagcactttgggaggccaaggcaggaggatcacttgcctaggaatttgaggctgcagtgagctatgattgcaccactacattccagcctgggtgaccaagcaagaccctgttttaaaacagaagcagaaacaaaataccaaaataaataaataaataagtaaataaataagaaggaggaggagagctttctttgacctttttcttagcagagcaaagcttagaagtaagaaatctgaaagtgtcagggaatatgcagtctgtgggccctggcagagaatagcaggaacactgcagatcggcactgcttacagcacagcagagccacaaacctggcatctgggcaaccacagatcaggtggacagacactgaccttggagccagatctgaaatttagaatgtgagtaagtcaatgacttaccttccagaccttagttttctcatccatcaggtgaaactaatgatataccttctccatctcagatgaagggacgtatattacaccttacagtctttgtatgcagtaaacttcttttgtgaataggaggtcttttatattggggtagaggtctcagggaaagtacagggccaggaactgaaggagattacctggcttttttttttaataaaagggtcttgttctgtcactgaggctggagtgcagtggtgccatcatagctcactgtaacctcaagctcctgggcttgagcaatccttctgcctcagcccctcaagtagctgggactacaagtgcatgctaccacacctagttaattttaattgtttcgtagagatcaggtcttgctatgttacccaggctgatctcaaactcctgggctcaaacattcctcctacttcagccccccaaagtgctagggttacaggcatgagctgctatgcctgcctggcctgactgggctttttctttctttctttcttagtttctttttttttaaaagaattgtagatatgtagtaagccaccttatggaaattgtaatatgatggaaattagagaacaaattggccaagcttttcattgacttacaaggagaaaattggagaagaactttcactgttttattgcttgtctttgcattatctttttgagcttgtgtgtgtgtgtgtgtgtgtgtgtgtgtgtgtgtatttggcttaggatttagaaaaagcagcagtcttagaaaccttgtatgaccagagtgtgggataagattgaagcaagaagtaattaaatgtgctttaattatttaaggcagaaaatagtgcagtggtcacttctgggttctgctttttgaactcagttagtaccctgggatcacagaggaatggcactgtcttgtgcttgttccccttattaagctcagcatgtggcccaattaatgcagtgatccagaaggcaagggaggtagtggtggctttgtgctgttgccttaaggacacggggctgtgtttcccgcctggctccctcctgtcctaggcctggctcaggagttgtctccacatgaggctgtgcaagtctgtgctgtggctgttgcagctcccccctgtgaaatacaatgtgtgaactattgatgcatcacgtagaatgattccatcttctctgtgggtcagaggcaagagtggagctattgttgatgaaatcagagatgtgagaggggtccatgtggattagaaatggtgagatggcttgcctgcccagatgagaaagctgcttatttctggggctctatctgagggaggaggtcctgcattgcatcccatcggccatggggcagagccacctggggtttcccaacaaaaagcaacattggcaaggtagccatttcagtgcaccgtgtataagaatgcctccttctgccaggcgcggcggctcatgcctgtaatcccagcactttgggaggccaaggtgggtggatcataaggtcaggagttcaagaccagcctggccaatatggtgaaacctgatctctactaaaaatacaaaaattagccaggcatggtggcgggtgcctatagtcccagctactcgggaggctgaggcaggagaattgattgaacctgggaggcggaggttgcagtgagccgagatcgcgccactgcactccagcctgggtgacagagcaaaactctgtcccctccaccaaaaaaaaagaatgcctttttctatccgggtcaagactcaacaggtttttattgtttgttcatttgttcattcaccactagactgtttttcaagtggcacagctttcaactctgcaactggtttagaaggacggggtggggggcaataagaatgaccctggctacctaaaggaaagggaaggaaaaaggtcccaaaaggggagactggagatggggcatctttgggcccttgtggcaccctaggtctcgagccctgtgattcaatgactgtttttcttcacccctcgcagatggagcggcagcgcctcgctcgagagaagcagatgagggaggaggctgaacgcacgagggatgagttggagaggaggctgctgcagatgaaagaagaagcaacaatggccaacgaagcactggtgatttctgaggggctggggttccaggaggctacttggggacttccttggcttttctggagcttggtctcctgaaaaccatgagttagcagcgtttgctttgaaatacttaatttcagctttgaaaaaatcagtgccttttcttttcacctgtgttggcagaagcagatttaggttgagcttatgtgcagccaaactccactttcaccacgaggttgcctttatagcagggcttctcagcctgggcactactgacatttggggctgaccatcctttgctgtaggaactagatcccagtagcagcacctcaccctccatttgtaacaatccaaaacatcttcagacattgccacatgtctcttttttttttttttttttttgagacggagtctcgctctgttgcctaggctggagtgtacagtggcacgatctcagcttactgcaatcttcacctcccaggttcaagcaattctcctgcctcagcctcctgagcagctgggattacaggcatgcatcaccatgcccagctaatttttgtatttttagtagagatggggtttccccatgttggtcaggctggtttcgaactcctgacctcgtgatctgcccgcctcagcctcccaaagtgctgggattataggtgttagccaccgtgcccagctgtacttttattttttttttttgagatggagtttcactcttgttgcccaagctggagtgcaatggcatgatcttggctcactgcaacctccgcctcctgggttcaagcgattctcctgcctcagcctcccaagtagctgggattacaggtgcgcgccaacacatccagcttttttttttttgtatttttagtagaaatgggttttcaccatgttagccaggctggtcttgaactcctgacctcaggtgatctgcccgcctcagcctcccaaaaggctgggattataggcgtgagccaccgtgccccacctgccacatgtctcttgcaggggacaaaaaactcctctggttctaaccactgatttaaagggaaagaacagagtttaagttgtttttctccacgtgaagcataagcctgagctgaggtgggtactcagagaaggtgctcttgttactccccatgggtgcagcccgaagggcccttctgaaaagttggggaatgtggcttgtcatttcttgtcagagggtcatggagggcactcagcagcagggccccaggagtccgagactctggtttgtcccatctcagtgttcaaggcagatctgggcgggagaacagcacatgatcccacttcagctaagagcactgtgccctccagatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggaggtgagggggcaccgggcaccagactggcgaggaggctggcgaagggccgcagaccagcctgccctgaggctgagctctacagcagttgtcctcaagctgcttgcccatcttctgggccgtggggaggctcctccttggctgatggtgactggtgctttatccattttggggctggcgctactggttgggcacaggaactcagttccccctccaggggggcctctctggtcatacttgtgtctctttgataagcccctgtccctctgatggccgtgtgtgcaggaaaacccctgagcatatccacagaccgctttcagctgaagagatgtgaggaggctctttgtgcatttaaaaaaagtgtggttcttttctgctttcattcagtggggctgcaggagaacagcagctgcctacctttaaagggaagctagtgcctgcatcccccagcctttcttggcacatgggggaggagggctaggatgatctctgtgactgggatgtcccactcatggccaggttgaaggatggaactgttgtctgtacttttgaaagactattctaggcctgcaaccttcagataaacactgacacattccccacagcttttggctctgttgatttagagcacttgaatttggcttttagctaccaaggtgcattcactacagttttcctcaccacgctttgcatgtcgttctgggaatatggttcctttttgcctgccctgcttcaggccccttactgtattcgggggtcactccctgtgcatgatgcaggttgggccaggtccctgcaccaggcctcacatgccgtgaccacctgagccccataggatgaggatctgcaccagggtgcgggtgccctcagtgactgggctcatctttctgctggagaaagtgggcacaaggcccactggtgttttatccgggggctgtgaagacgcagttcttgcacattctgccctttgcgatccaatataagaactttgatcctccaggttcttcctttgcccagctcactctcacccaaaaataaagcagagaaagctgctggtgccctctccagctcctctgtctcctggctgcagaaggtctggtttctctcattccccaccagttttcctgctcttccagtttagatttaccaactcaaacaaaagtcctcaggaatgttgtccttgcttggaagttctgatttcatgtaaatatccctgtctcactgtcctttttcacctctttgggtgccatcctcagggttagcccaggtccctcctctgcaggggtggggtggtgtcttttcctgctacctgccctcttctgtgaagctgacatctcatcctttccttgcagggccaaagaggcagatcagctgaagcaggacctgcaggaagcacgcgaggcggagcgaagagccaagcagaagctcctggagattgccaccaagcccacgtacccggtgagcctgggggccaccagctggggctgccttagtcctggtgatgttctctttcctcccggcccttcagttcatctggcggtgccttcagggtgaccattcaggcaaacacatggctggatgagaggtgcagagagcctgcagttagggactgggtagaacatcctggtctgccatttggctttggactagttagttgtctctttggttgcctggataacaggcaacagggccttttccagctctggaatgtttttctttttctaagtaatatagtcccaaattatcctcaagagaatttgctctcttgcctcttaatgctgagctgaatgtaatcttcaactatcagtatataccatatatcataattatagttctgggaagggattggctgtacacctcagagtgaattactgccgtgcaagaacgagcagccactctcagtttggggacagagagtcagacttccattaaatggggtcacaaaatgaatagaagcctctttccttcctttcttctgtgcattcagtttggcatttttttttttttcatatttgttcagtgtccacatagtgccatgcagttggaagtctctatcctgacaggtgttctcagggtgcacaggtgcctagaggaggaggacacagcccaccctggaggagcaggagaggctcagtgtggtgtctacactgatgcttgaagggggagcaggaagtagccaggtggagaagagaacatagggtattcagggtgagggcacagatgcacacatggcccagactcacacacagcacagtcatctacatggcacagacacacacacgtacccatacatacattgatgcacatagcacatccacacacacagcacggacacacacgcacccatacttacattcatgcacatggcacaggcacatacatgacccagatgcacaaagggcaccagaggcacaagctgcccagggtttgaggtggggaaaatgtaagcagtttgctgttgccgtatatcccggttctccgttactgtgtaacaacccacccaagccagctgtgtggctttgttagtacctctggtggcttgttgggttgactgggccagacagagatccttgctggggatctctctggtggtcacagtcagatggtagctgggactggagtcgtctgagcagtcaactgggctgaacacctgagatgtgttatgtttttattttttattttatttattatttttttttttagagagagagagttttatttactctgtcacccaggctggaatgcggtggcagaatctcggctcactgcaaccttagcctcataggctcaagcgatcttcccgccccagtctcctgagtagctgggaccacagacatgcaccaccacgcccagctaatttttttttttatttggtagggacagggttttgccatgttgccacagctggtctcaaactcccgagctcaagtgatctgcctgcctcagcttcccaaagtgctgggattataggcatgagccactgtgcccagcctatatgtgttgtttttaaaatatacactggagcaaagcttatacactgctgtaactgctctttcctcttagcagtcaatcctgaaggagatcatccatatcagctttttaatcatgttttgttgtgtggatggattgtaatttatttaaccagtccctcatggatgagtatttagtctgttttcttttgcaattttgaacaaaatgacactgaacatccctgaacacaaatcttgacacacacacgtggatatattggtagaataaattcttataatagaactgtggggtcaaattttcgattttgatactctccaaagaagtcataccagttcatgctctcactagtggtgcagcaactagtacgcgtttttgctgaaaatttttatgatgtgtaacatacacatagagaagtgcccaaattacaactgtacagtttgaagaattttcacaaactgaacatacccatgtacccagcacccagatcagaaaacaggacatccctggcacccaaggagccttctctcagcacccttgcagacggtctgcctcaggccttgagaatgtctcaaatgaatgttccaagcctctgctctttcccagacactgtcctagactcaatacgggatccaaggatgaaaaagaggcagattgtttgcaggaaacttgcaaatagtagaaagaagatacagccaaaaagaaatcttttacagggtggaatcgcagaagaaccattagagaaccgtaaacacagcgttaagggacagcaaagaaaagggttgccggctggctgggaggggctagaaaggctttggtgagagatcgtggtgtttgagaagggccttgaaagagggatggagcatagggaggagaaatgggataggcaggggtacagagatgggaaggcagtagtccaggggataataaacaatactgtctgtgacttagtagggcaaatagtaggagaagccgggaagctagattggggtcctctttagatgaccctttgtgctgggatgaaagtccaaaaaaaaaaaaaactacaccacccctgcttcaggccctactccggttccattgtccaagcccaagcccctcggtgggccggtggggagccctttgtggtggtgcccatctcccaccccacctctccacactgcatggcagactcctggcaccctcactgggcactgccccacccattgccatacttcccgtccggcagaccttctcctggcactgccttggatcccagcaaaagcagcatctcttctagcctctgttcgctccctggctacagtgtttaccttttttaacagtgatgatctgtgaacacatctatttcctgaacaagactttcagctgctcaaagccaaggatgctgtcttgttttctgcatctccagccccttgcacagggcctgggagtttcctaaatgaaaaagcgagtgggagtttgtgtttgattcagctgagcatgaagaacggttagagatttgagggatgattttcctggatttgtagtctttgatattgtttacctggcagtggcaaatgtggagggagtgaagtggagggatggggactcgtggtggcattgggaggtgggacccgagttgtgcccattgcctctgtggctgctggaggatcggttgtcaacacagtagtgtccttctgtgcttgtatgacccaagctcctaatccgaaatttctcattaacagcccatgaacccaattccagcaccgttgcctcctgacataccaagcttcaacctcattggtgacagcctgtctttcgacttcaaagatactgacatgaagcggctttccatggagatagagaaagaaaagtatgtagccccctgtgccctgctgtgggcagctgtgaactagactgagtgattggggccttgggaagctggggcagaggtgagaggtcgctgcagcagcctgtcattactcctgcaaaggtttgctctgctcttacaccctggaggaagaatttccttaatcagaaattaaggacaacagatcagcattcattctgaacgaataaaaataacaatttttatccaggataaaaataacacttgactggtgagctggagtttttggtggctctaagcctcacctaaagtgtaggactgggttgttagcatctctgagtcagttcaactgctgttatactactggactgtagtcacctcctagttgtgttctccagcaactgggatctgtggtggttcccatgtctagaacaaacaaaggtgagagaagagactcaggctcgaggctaaggaaagctgacagctggtggggccactttgctgcagtgggtggcactgggcagggccccagcatggcctgatcatggcagcaattgctgagctgccctccgtcttccctttattgtgggtagaagtggatcagagatggaaaggaaaggatccccactgcagaggaaatctaagcgagggcccctagttcccagagctagcggtaagttggttaactgctgctgcttgctagaggacaaccacagtagctaccatgcattgagtgcctgtgtgtcaggggttttggcttttgtctcatttaattcctgctaacttacaaacatcaaaatgacatcaaaggtaggttttcatgttcccattttataagtgagaactcagatttagagagtttagtgaactccaccagcatcccacagctgatgcagaggggttgaaacccctcacccatctgactctgcagcccatgtgcttttaccatgggtggtatcctcaggaaaaccctttggggaaagtgtctccatggagtccagtatgggcaaccagaacccaggctgtttttctttgggctctcacactgagggtatagctaagtagccaatgaaccagagcctctagctgtcatatctgctgtccatgttcctttcaccattatccagacatatacatttatgtggttgggatccgggatcagggtgaagctgttctgtgtctgctattttatagtttgtattttgttactatcttagtttgttttggctactgtaacaaaataccagaggctgggtagcttataaacaacagaaatttatttcttggccaggcacagtggctcatgcctgtaattccagcactttgggagtccaaggggggcagatctcttgagccaggagttcaagaccagcctgggcaacatggcaaaaccccatttctactaagaatacaaaaattagctgggtgtggtggcacatgcctgtggtcccagctactcgggaggctgaggtgggaggattgcttgagcctgggaggcagaggttgcagtgagcccagattgcaccactgcactccagcctgggcaacagagagacaccctgtctcaaaaaaaaaaaaaagaaaagaaagaaattgatttctcacagtttgggaggctgagaaggccaagatcaaggcacgggcagaggtggagtctagtgagggcattcttgctggttcataatcagcccctttttgctgcatgctcacccagtggaagggatgaggggtctctctggagtctcttttataagggcactaatcccattcatgaggctctaccctcatgactgcccaaaggccccacctcctgacactttttttttttttgagatggagtctcactccatcgcccaggctggagtgcagtggtgcgatctcggctcactgtaacctccacctcctgggtgcaagcgattctcctgcctcagcctcctgagtagctgggattacaggcgcatgctatcacgcccagctaacttttgtatttttagtagagatggggtttcaccatgttggtcaggctggtctcgaactcctgacctcatgatccgcccaccttggcctcccaaagtgttgggattacaggcgtgagccaccacacccagccggtgattaggtttccacatatgaattttgaagacacgaacattcagaccatagcacttcttacccttgcacatattggcagagtctctatactaaccatggcaatccctatggagtgtttttggtatttgtattgcatggtttttctggccatgccttgtagttggacactttgtgggtggtttccagattttcaccatcatagatgctgtcactcagtgttatctgttctcaggtgagggtggggatcttttcttccttgcgttgggtgagcttctgagtgagcttctgtcatctttagatgaagtctcagaacaagtgggaatgtggatgtggcctatcaaaagagatcacgtgaagctgggcgctgtggcttatgcctataatcccagccctttgagaccaggggttcaaagccagcctgggcagcatagcaagatcctataaaaaaaaaaaagagtttacttgaattactgctccaagaagggttgagacaaggagattgttctgggttcccaggaagcttgtttcacgtatgttttttttttgtacagaacgaaaagctgtccatgagagctggtatttgtagagccccctatgagaatttaccaagggcttttctactctttctttttctttccttttctttttttttttttaaaaatagagacagggtcttgctatgtttcccaagctggtctccaactcctgggctcaagcaatcctcctgcctcagccacccaaagtactgggattacaggtggagccaccgtgcctggcctcctacactgttttatttaatcctaaccacggccctgtgatcattatcccaattttaatgatgaggaaacattcatagcatttaagtgaccagcccaagctcccatggcctgtgagtggccaagtagagacgtgaaccccaggcctcaaaccctagatcgcacaccaagcagcttgtgggccgcagagcacctgagccgtgtctcactgtctgcccaagccctgatgcatgataccctcttgccggcagagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaaggtacccagggtctctttcttgtattttgctgatcaggaccatcattaatgaaatgtgcggttggcatctggtttcctcagtagccaagtcactagactattggcatcttttgtatgtacttagttgaggaaattttttaacttatgccagaaagggaatttaatctgccaatgactatgaacccattggctggatggaagttgagcttgtgttaaaagctctgatgtaatgaacccctgttacagggtggattttgagccctcatttagcagtaaagcataatgcccttttaagccaaggggtgttatacccagggagctgccttactttatgagaaagcagaatgaaatggaggctattgagaatggactttccctctagtcttgtggtgtctttaagtggcaaggactataaaaccaaactgaatttttaacttttttcatacttaaaaggaagtgtctaggaaagaacctctttgttttaaaagagaagactttattactttgcaaatggtttcatatctttctctactggtattttgagctttcagcattgtcgagattcagaagctaaattccatactaattatcagcccaagagcatacctctctcatttgggccaagcagaagggtcctctcataccaaataatgctctgctcttaactgatagcccaggaccaggttaacacctataaaataggtgttattaagataagactgtccattgagtttaggtgatactgatacagttaattttttattctttacctcagtctttaaaataggcttccagttttatggactgtctctgtttttagtggttaagctgtatctgaaaactccaggggatctgtttctgcctgccttcgttgttgggtacagtaggcagccctgacttctacctctcgactccagtcacaactggcaccgggtagagaattccttttaatagtgcaacctagaaggaaaggcatttccacattccacattcttctttcctctggcttctgtaatttactgggcttcccttccaaaacaaaattattaaacagtaaaggggagttcaagggaggcctcggtcattaaggaaagaggtaaaacgatggctgagccagtgagccagtcagcccttaaatgaactgcctcagacaccccatctcaccccttacccccagccttgtcatctgggtcccaggaacagtctcaccatttccactgctgctgcaatgagcagtgccctcagccacagaaacctgcagtgtgagagctggagagaccccgttccaagccattaaaacaaacaaaatcactcatcacgatttcaggcctatccaagcattttgcagatggcacttatggcattgttgatatcacagggtatgtttttgtttttcttcattttattttgctggtttagcctcaagcccaaggcagaagacctatctgcatttgagccctcaaagtaggttgttcccaggtactctctatgtggtgatggtgctgccctctgtgatactaacccgtgcatgagcttgcctgtctctgtcctcgggccacactgagcccttacgagggcaggtggtgcctgggtactggccgcagcatgctttgagtctaaaagtaggcacccaccctgtgaagccagaccagcctccagggccccagaagactgcctcgttccgaagagcatgtcatggggctgtaggaccagccattcttcccatctcgggtcattgttgggctggggaaggttatggcttcttgtccagtcaggtgtgtctaaaagtcctttgtcttggtggcatactcctagcatggaaatggggtcaatctgggcactttggagactggtgtgtttaactcaagatcaagaccttttatgcgttgacagcctctcaagacccatggtcacacctggcagcttctggtagtggggcaaaagggttgcttgtgctggctcattttcctttagagctttccctttctgcacacatcccttttcttttcaaataaagcaaacccagagcacagggtctgatatgtgagtccacggggagtggactgtctgttcatctgtgctcagccacctctgcttcagcttcctctccataggctgagcagagatgtggtcagagtgaactcacattggaacagtacactcacggcaccctggagaggagcggtcactggttgctgagtgaattaaccgaatgtttgctgcttttctcctgcaacagttcattattcctccagcatgcctaggcagtggagagaatgtattttgcccaataataaaatgacatcctgcctctacttctcacctaatccccagtagtacccatgccaacaagccccacaccacctgacagcagcataggatgtgtcctttggagtcttccctgcagtttctgctcatagagtggaataagctcattggaacctttctaacaaaaagagatctggcataagatagatcctacttgtggtcgttatcccatcaagagaggtcagctgttaaagtccctgatagatcttattaaaaggtacacttgagctgtcagtggttccaagaatccatgacatgaaccctgttttgtatgcgacactttcatttagcgggctcctgtttcttcagctttcatatccttgttggcattgataccctgatacagaacagtccgcgctctgagcagggcagttatggccagcattgtcacgggcaggccagctcatggcacccagagcagccaggtggacccaccttggtttactgaactttttgtaaccatgggggcaagcagaaaaccccgctgcatttcagccagtgctgccaggtgttccctccatgggaaggtgctgctcaacctgaatgtgacttcctctttcttctttctataatgatgcagaatgctgaaattcttcagggtcctgattttgactgtcatttctcactgagcttttactgcagacaaaagaagtttcatttttagttaaatttgcactgctcctgggacatacatggatgcatttatttattcatccattttaatgtctcgatgtgaacttgtttttaaagcaggctaccaggcagttaatcaaacactcgggttaatcaagggttaataaaagcagggacttgatgtttaatgggacaggcattctctcagcatcactagattcaataatgctgcactattaaattttgctgcacatgaagttcagtgcatgttccattttctagactttggcagtgcctgtggtcagtgaccgggactgatgagcagccacatgcctgcactagggtggctctggggtggtgcatgctgcagtctggctggcacaagcctagctgaagagaagtactgctttaggcttggatgtggggatacctagatgtcaagggcagaactccatctagaatgcctggggatgagatgcaaaagctgatagtgaatggaacagtttccaatgtccaaaagcttgctaatctgggatcaaaccagcctgtgttgatgttagttttgctttgttttgagacacggtctccctctgtcacccaggctggtacattctcggctcactgcaacctccacctcacaggctcaagtgatcctcctgcctcagcctcccaagtagctgagactagaggtactagccaccacactcaactaatttttgtattttttatagagatggggtttcgccatgttgcccaggctggtctcgaactcctgagctcaaccaatctgcccgcctctgcctcccagagtgctgggattataaaagtgagccactgtgcctggcctgttttgtttttaataaggttttttgtttgttttgttttgtttgagacaggatctcactctgtcacccaccttggtgacagcctcgacctcctgggctcaagcgatcctcccacgtcagcctcccaagtagctgggactacaggcatttgccaccatgcctgactgatttttttatttttatttttgtaaagatgggtttcgccatgtttccaggctggtctcgaactcctgagctcaagtgatcttcctgccacagcctcccaaaatgctgggattacagacatgagccatcttgcctggccattgtatttgtcctcgttttcagtactcttctgcctcactgagaggtctcagagtctgctgtgtggtttcagcagtacccatgggggctgtgtaacattgaagctgattcaaggagtttgcccttaggttaccaggggttaccgcattccctgaggaatgctgagcggccatccagtctgattaaccgaggttcctacttctctgccacttcctttctctataattcttactcgctcgctctctctttttttttttttattatactttaagttctagggtacatgtgcacaacgtgcaggtttgttacatatgtatacatgcagctataaaaaaggatgaattcttactctctcttgaggcacagtgtcctcacctgcaaaaggtggataaaaatagtctttgcccccaggagtgttgtgaggaataaatgagagaatgtgtgtgcaacactcagtgcacagtcagagctcagtaaggggttaaaactctgaaaagggaaaatctgcttgtgatcctgcagcaaagggcgaaggacggcatgtgggccacaccgccacatctaggtacactgcttgtgctgggcatattcattcattgtattaattgctacgtggctgaaagtaaaaacttttaaaaagccataattggccgggcacagtggctcatgcctataatcccagcacgttgggaggccgaggcaggtgaatcacctgaggtcaggagttcgagaccagcctgaccaacatggagaaaccccgtctctaccaaaaatacaaaatttgccaggtgtggtggcgcatgcctgtaaacccagctacttgggaggctgaggcaggagaattgcttgaacctgggaggtgggggttgcagtgagccaagatcgtgccattgcactccagcctgggcaacaagagcaagattccatctcataaataaataaataaatagccataattaacttcactgtttccttgtaatatttcacttgggtttgcaaggatgtatttttctcctcttgctaatcttaacttcctgtatttccatttttcccaattgatgatcagtacaactagtttgccatttgcatctgagtcagagcagtgctagcgatcaaaagccgccctggggaacctggaattgtttcattctcagtgggagcgacacgtgtcctggcatctgagccttccgagtgaggggagtgagtctggccatcaggctggggttgagggacacagggtgccttgagcctggctttcgtgccttcagagccacagtgccaatgatgggagtggtggcttggtgtggcgtaactgtaccaccataccttgatggtagaatgcagtcctggaatatatacattcagggtctttctttcatcgcttctcaagagaggggtttcagtctcccgatcctgagctggtctgagtgccagcaaacaaagtcatcacttttgtgcctgtggtctcccaaggagcacaggatttccaaggaaattgacggatgagaaatcatgggggtggtggagcttagaaagcttatttcattagtaaatggtttgaaccgtcaaggtccagctgtggtttccactgatggaggaacaggaagaagaggagccttgacatttatctcaagcgccagcagcttctcttggatcaggaagacataaaagtccaatgtcatcttcaatttgtgcaggctccccttggagttgcagagccagtgaagtgaagtagaacagttaaaaaaacacccggggaagtgataaatcacagagagagattgcatatgcgggaaaggtgtctcccacaattaaaacaagtggccagagcctccctggcgacctctggtctgcattgccagccctgaagatggctcctaaattacttaagtttaataggtagttaatatagccaaccctccttatgaccccagtgggctgaatggctctgcttgctttaggaactgggcgttgtatggtagagcatcttggccttgacataaaaggtagcatactggctccccagccctgaaccttccctgctagagcaaggcaggggtgagagggggaaggaaagaaaaaggagtggggagtggggtggggagcaaggattaacagggagcagtagcagcaccagatgtgggcatagcacactgggaagaaattgcagtggcgatctgaactcttcctctccgcctcctggctctgtggaagcccagggaaggcattaggaactgcaggctgctcttagtgctcctcccggatgggacaccttgggctcatccctgaaggccactcctaccactctcacacactgagttcctggtgtctcgtaactgttgagagcttagttttcttgcttgtttctggtagctctagatagaagactgtatcggcctcttctaaaagtcaacaagccaatcctgtttttggttaagagactttacctggtcaagcagttgttctttgggaggtgttgaagagcctacaaacctgccttgcctgcctaggtactttaccaccatttggagatgcctgaggatattaccaggccttatttgaggcagtaaaacaccctgttcggcccctcggcactgaagatgtgtttcagtgcagctctcctcggcaccggattcgttgctgcaacagtgggagggaagagccagatgcaaactcgttctgcgagcccgaggttctgttctcatgatccttgctgtgatttctcttttgatgttggcaattttaaaatgacatcagtctatctggacctttttcctaaggctcttgctcagaccactcagtagatagccgccacctgcccagtgaggtgaatcaggcccattaggccatttgtcaggggaaggaacagaggagcagcggagggccccgccggccagtgccacagggcagcctgcaaagcaggtagacaggttttcaggcagcttttgctgctttgggtccctcagggattaatacacaaaaagggccccttgggtattcagtggcagatttctcttgagagcagataaagtcgctaataacaaattggatttgttcattggggtggacttggcctttcgttccacctctgtgtaggataagtgtgtggatagtgctcccactgtgcacatcaccatatggcatttgggtgcagctgtccctagccagactgcagaaaagcttgatctgggccggacgcggtggcttatgcctgtaatcccagcactttgggaggccgaggcaggcggatcacgaagtcaagagattgagaccatcctggccaacatggtgaaaccctgtctctactaaaaatacaaaaattagctgggcgtggtggcatgcgcctgtagttccagctactcaggaggctgaggcaggagaatcacttaaacccaggaggcagaggctgcagtgagcggagatcgcgccactgcagttcagcctggcaacggagtgagactccgtctcaaaaaaaaaaaaaaaaaaaaaaagagaaagtaaagaaaagcttgatctggccacttagtacagccatccccctttactggcccttcctctttgcttatttggaagggggaaggtttcccacaccccaaaccaaagattcttttggaatttgctgctgctggattcagctgtcacctttctgctctgagtctgctttctccctgtggatccggtgccagaggatctgcacgtccttttgtgtctacaccctcccccgctccttcgttttcaatatgtagtagtggagaggaagtgtaacatgattttagggctcacatttcaattccactgcatttttatgggacaagcagagacccagcgcctggagttattaggttagtatctaaaatgggttcagtactgtgagtcttattgtttaaaatgaatgagatggtcccctcctaccttcttttctcctcccctgggatgagtggattgaggcaaggcccccagagactagttgaaggaatcctggtgctctgattagttttgttccccagcttaattgtacagcttcctttctctcaccactgatagccaaagtagctctgtgtctcccccaaccttcccttgctttaggaacaagatgatcacaatgcagccttgtgaatcaattttctgtctgtgctgatgaaagtgtaattcattcttaatcaagcagccttgctgctgcaggctccgtgccggaatacatttagttaccctcccatcactttgggaaacgatcccccaaaagggcttttagaggagagctggaaggagagttggccgtgcgcctcatgctgtggttttccagcagggggcactcaggaacgatgctggcggaggctttgtagctggaagccgtctgctgctggcagggcagcaggagaatgtttgtcacaggtgccttccaggcttgctttctccagaccctggggccatttctcagaagtaccctaatgggccacccaaaatcctcaggtagcagtgaggaggaacagttgaagatgcagattgcatgcctgggttagagagtgccggctgggtaccaggttcttttagccagcctcttctgtctttttaagtagacagatgtgtctcctgaatctgaacttgtttagattgggtggatgtgtctgtttttgtcacaccacacacaatttggggagcgtaaggaggcccagctctgccagaatggaactctcctaagttctcccctgccgtctcacagcctgctggctgtcacaaacagctggcagttttatggacaagtgggcaggggaaaagggaccctgccggggctgagtctcgatgttgggcaggaagtaaaagccaggacccaacaagtggatcagaggggggatgtgaagatgaacagtcagatagcaataaagcctcatagatctgccccagagaaagaaaaggaagttcgtctcctcagaatggaattggattagtgacagacttgagcagccggttcagtcgagagagaacttaattcctcctgtgttattcacacggctgattctaatcagatgtgaagagacagctggaggagagcagcgggtcagcccatgcctggtgcggaggcttcatgttcttgtaggcatcttcagggaactggcaggagcgctttgggttggagactctgagcagggcccttgggtttatagcctgcccaaggaactgggcctggctgcgggactcccatggttggaccttgtctagattcagtgaaagttttgaaggacagtgcatgacagacgtcactggtcaggttcaccagagcttggctcacttgtcttcagaaggattcaaaggcagttgaccagacttggcaagtcccagactggtgcagccactgtcctcgagaccctggttgtacaccctgaggtgcttctgcttcattacctgctgaaatttggagacctcttcttcctggataaccttcaagatactcattgtgcatgcgaggaattccccgccctcctggggggactccactccccaggcaggcaaggttgggcaaggggagggctgttgctggattgccaaagggagcatggacatttttgtttggaattcagggtgggaatgggactcaccagagtggcttcagtgctcaactcacagtgcaacataggacaaggtgaaggccttcttgggaggcctcttctggctctagcaagcaggtgttgctgggcagtgtagagggacccaggccggttgctgagcaggaagatgtacctaacactgatgggcctgcacaccttagggtatgagagcatcgcaggggaaccaggaaacttgttagctggttttcatgtgtttaaaaagaagactcggaggcagagtttattttatgaagggctagctttttgccatttcttctgagcttttgccttttcctttatgaatacttcctgcctatgggtgtactgtaaatgtaacagccagtgagctttctagaagcagcagatggtgaaagatccacaggtgaggagcctgcccactggaggggcgagacagtgcccaggcagggcgtgcaggtggcagagctgtttgcatgctccgcggggtggcttcccaagctctctgtagaaaaactgcctgagggcaaatggctccactgagctgctacctgcaggaaagaagctcaagggctctcctcgtctcactgcctgccttcttcacctgctgggaggagggcattgtggtgtctgagataaaggatacccccaaggtggaagcagagccatgggggtggcctccagcagcagggaggagcattgtgcagtaaattctgactccggggctcctgtggggattggaacccataggaattgcacaatgagggtaaaggatggggcggcagcagccaggtctgtctaaggggcgagcagcagtggccgaaggctcccagggccctcgggcagcagcccttgctgaccagtgcagccaggtcgtggctgcctccagctggtgggtctgccttcccctctgaccgcctcagtgccttctggaggactgtggctctctctcctgcccagtggctgtggtgccttcctacttctgtgtgggcagactgatttccctctctacctttacttgtggctgaggcgaagctcctgctcttgcaagataagaggtggggctgaggcgctgcagtgcagctcaggtggggctcaggaagcaccccacccaccccagagcactctgcatcctaataagcacatgctcgagtcactggaatctggtgctgctggcagtgccagaaccctcccctagcacctcgaggggacagccagcatgctcctcgggtggaggatccaggaattcttggagccaacattgcacaaatgggcaggagcctctcaaggcccccacagcctgggctccctgcctggggaagtggccaggcttcataggggcatcacttggcccgcctggtaggcatggaggccagtgccatacgtgaccttgttgttgcctgcaccccttcctaacgagcaccctgctccccactggaaggagaggggccagggctcctccctccccagggaggggagaaacgtgatgttgctattagcaataacagctgccgagttcccaccatgcgccaggtgcagtgttgagtgcatcacacgcggttcccaattcctctgcctgtcaccccacgaggaaggggctgccatcacgcccgcttcacagtgaggaactgaggctagaggggagcaagtgacctgcccagggccacacagctggtcagtggcccagctgggccttgcaccaggcagctgactgtgcctgtatctgactcaaagtggctgttcttttcagaaacctgagcggagatactgggctcacatgctttcatttaaaccctctctcatttttgccccagtagttatctggcagctaaatctcttcctcctttcttccccagtgaccattctggttcccatcatcacagggcacataactcctggcccttctcctctgattacatttagggagaagcccatcctgatgcagctcccttctagagggagttccatttaggcaaaaaagcgctctccattcccatcagaaccgggctttccaaagggctctgaaattggttccactgaagaaggcagctgagctgcctccccacattccgcttgttagtcgggaacttcaaggccaaaagatttggcaggatttaaagagttgctctcaagctgtctcattctgagcacactaatgctgtctgtcttctgatggtgaagtggtgggtttggagtctccctcccctgccctttatggagccgccgatagtaccgaggactcttcacatgcagactcgaggggtccagagaatgggccagaccatcttgcctgccccatggcaacctccagaggaaagaggctcagagaggtcaggggtgtctgcagtgagctgctgatggcagagagtgagctctcggaccttctcagccgggtgtggagctcttgcctctcccgcgaacctcagtttagttatcttcatagcccacgtcctggtcgcttaacaaacattgagctcctgatcggcacataacactaagccagatatttgggggatatgaagatgaatggtacagactccctcccctccacccccgcactcctgtgggaagtcccggagctggaaatggaacacagtcacacccaaggcattgatttcaggagtcagcagagagcagggagtagggagagtgctggctccagatgcttctatccagggagatgctgggaagtggcccagagtcaagggcttaggaggttgcaaacctcactatgccaagagctcggtccctgatccaccccatccccttccacatctccctgactgtccttctttacatttgctgggcagagtgccacctgtgtgcaccagccctccctgcctgcacaagccacactgagaaagccgttgcctccagctcatggagagaaacaccttctcagctgccacgtcatgagcaagtttgcttcgggaccacctgggaaaccaggagtagaaggggtaaactcttcctcatctgccacaggcctgccttgcctcaggccacgtcaccttaccccagccatgttgccagggcatgaggactaagatgcttgccctgccaagcccggaggggatgagcagcctcagctggtgccgccacagacagcacaccacagaggtggctcagggaccttggtagatgggaatgtgagaatctattaaaataggcagggatctccggtcctctgtcaagaggcaatgctgacggctttttcctgctggcgtgcctctgcccaccagccttccccttgcacatcctcatttgtcacctcctaatttgaattattgggcaaatctggccgcttatttgggactgacagccaacttcttgagcatctatttgaacagccttccctttcgctcccagccacctttgaggtgagtccaagtggcaggacaggaccctgtgtgacagagcggaggtcttgtgccctctcagcttcttctctgctttcttacagctcaccttgcagagcgccaagtcccgagtggccttctttgaagagctctagcaggtgacccagccaccccaggacctgccacttctcctgctaccgggaccgcgggatggaccagatatcaagagagccatccatagggagctggctgggggtttccgtgggagctccagaactttccccagctgagtgaagagcccagcccctcttatgtgcaattgccttgaactacgaccctgtagagatttctctcatggcgttctagttctctgacctgagtctttgttttaagaagtatttgtcttcctttgtctaatgtgggattcctgactcccttcgtccaaggcaccggtgtgtgtgtgtcttgcactccagagctgacctccaccgcccagcctgggaagtcattgtagggagtgagacactgaagccctgagaagccagtgccatcatccccaccccgcccagggttccggaacattcattcccccaccggtgaggacctggcatgcagcgaagcagcccagcccggcggatcccaggccagcacgcctgccggcttctcatcgtcagggagcccgcccagagctcgtgacgagcaagtgctgggtccccgccaggcaccccgaggcggcgctctggctggcagctggtggggaataggcagggcagctgtggctggggagagactttaggcagaagctgtgatgcaggctgactgccagccgaggggctgggtagtgccgtgcgggagctgatggtacagggcactcgctgtccccctccggccaccctagaccagggtccgagaggcaggcaggagccactcatgtcttccccattgcccgacgcccatagacgctccttcctgtgtggggctggggtactccctggtcgtactgcagtcagcacccgtaacccggctatgaccagggatctgtaagccctgtggctccacaggtgctgcttctcactggcccagactctgagctccaccggcccagtctgcacggcccatctgcttcaccttccctcccagccacgtgccagtggccacagcccacttcccaacccactgttgtacccaggcctcactttgctgttgcccttgtccctcttcgggccctgaattttctgttccctgggggccagccagggccctttgtgcccctcccagcacaggcctgatgcaggtgtccactcacaggtggcgctcacctaggctgtcacaggacccacctccatgccaggcaacagagggccacagaaccacccccacggctcactccttggtctggggccaccttcttgccctttctttttttttttttttttttttttccgagatggagtctctctctgtcacccaggtgggagtgtggtggcacaatctcggctcactgcaacctccacctcctgagttcaagcaattctcctgcctcagcctcccaagtagctgggactacaggcatgcaccaccacacttggccaatgttctgtatttttaatagggacggggttttgccatgttagctaggctggtctcaaactcacacctgggattacaggcatgagccactgcacccagccccttcttgccctttcttttctccatggctgatgctgctgtggccagccagggcccttgagatccttccagtttggctgttatgcaaagcaggtgatttgtcttaatcagataaaagatagaggctatgggggcctcaagatttttggagagcagaggtggtctctggcaattccatctggttttgagaaacttagcagctcacagagcacagagatcctgccttcttcctactatcaggctgacctaatggggttgggctgctcggcaactgcttgggtcaccttgccccaaggaaaccagccctgggtgccacccagccacttagggtctacagggtgggactccagacctagagcgtaagtatggatgttgtggccctgtgtcttcctagtgtgacccagccaggagcggaagcttcaggcgtttgtaaagtgaggtctggctctgcctcctccgttttttttttttttctgtttctgtttctgttttttttttgagatggagtctcgctctgtcgcccaggctggagtgcagtgtcacgatctcagctcactgcaacctccgcctcccaggtacaagagattctcctgcctcagcctcccgagtagctgggactacaggcgtgtgccaccatgcctggctaatttttgtatttttagtagagatggggtttcgccatgttagccagactggtctcgaactcctgacctcaggtgatcctcccaccccggcttcccaaagttctgggattataggcgtgagccaccatgcccggtctcttctcagtcttgaagcccatccctggatttccaccaggagttactttcctcctgacctgtaaatttgttctttaacaatggctgcaggtgggagcatatggtggtttataaaaacgctgtcgggctttgtttccttctttagctgccgtgtctacttctgaagtctgggaagtgccaagccacgcggcctcaagggagctggctggtgtttgagctgtggcagaagcacctggggctccagggagcaggctgggaactgcaggaccttgctcagccaggagcacttccccctccttgaggcaggaatactgaggtgcctccccacagatggagaaggtggagaggaggatgggcctcaggagcatctcaagccccagtagcaggagaaagaaagaaagagatgcctggttttcacagactggttcctgtggctgggatgactgcatccttttttttttttttttgagacggagtttttgcctttgtcgcccaggctggagtgcaatggcgtgatctcggctcaccgcaacctccgcctcccggattcaagcaattctcctgcctcagcctcccgagtagctgggattacaggcacgcacctccacgtccggctaattttgtatttttagtggagacggggtttctccatgtcggtcaggctggtctcgaactcccgacctcaggtgatctgcccacctcggcctcccaaagtgctgggattacaggcatgagccaccgcgcttggccagactgcgtcctttttaagcgaacattttagggcctgggagtttgtcaagtaaggaagtctcaagcccaaagagcagcgtcctgaccatggtggtttcattacgagcccttctgctggctctcaggcagaagccccacagcaccgggaccattcatgaggtcactgcccagctcatgatgtccgtgaggctgtccttttggccagtagccgtgtgcagctgtgtggcacagatggcttcgttcatcctgatcaaggccccacctcagccacagcagtccccccaacctgtgttgtccaccctattattcatgtacctgccaggccctgctagatagcaccccgtggcattacataacacttcatgagtggctgtgtcttgtaattttggggacaggtttctctctttccctctcttttttttgtcaaaagcccagagactgacaaccagctgcagtgtctaagtgttcctcactgacagggtggggcctcaccacccctggagggagcagcgttggcagggagacagcctggcccagtgaccctgggcccaagccagcccctccagggctttcagggaagcgccatccattttcaaagatgtcaaacgtcacttcttcctgtagggcccgagtcctgcctcctatcagggccagatcatagaaggctattttctattctggggaacgattataacttaaatgattgttttaataaaaattctaagctggaaaa

SEQ ID NO: 201 - DNA, 179822 bp, Homo sapiens
  source 1..179822: mol_type = genomic DNA
acagttcaggaaacttaaaaggatggcatatggaagttgagtgaaggagaaagagagggaagtagaaaagaggagaaaaatgttaagcaaaaaaggtaagaggaagtattgaaacttattgaaaaacctgagacattacggcaatcacgcttgagtttctcttcctattctgatatttactacccatttgactttgggcaaaccttcaacgttctctcattgaaaattgtaacttcattaaagaatgctatgcagataataagcaaagtacctcgcaaatacacaatctattttctattacaaatatcagtttttatgactaaataataagacaatttttaacctctgaatgattaatattctctggttagggtaaagtttatttacatgactcatctgtataatagggaaaaatctgttttctttaaatttgaaataagataatgtatagctgcagaaactcctggagaaaagtatgtaactcaacatcggtgctagagttttaagttaaatagcattcctcaggaccatcaaaaacataaaatattaaaaatatgcccactacaccttggcaggcagagacacttcagtgtgtaagatactgcaccatttctaaaacgtcttaataaaagttatcctaagtattttagtttggccgctcgtctgaaacgttttgctgggtgcaaacattgtaattagtgctctctaaatttagttgtgccactactcctgtagatccatttagtgtcccccttaccgaaaacagcgttctcaattagctgttgttttccacttgtaaggacagtcaaagctgaagtcttaaaaaagtggtagtgcccagaaatgtttcttaggcaagtcttgttttgtcaaggtgttttaagcagtgtggggaaatgtgggcagagattaatcttaggggcttctagtgccactgttaaaattccactctgtggcctaagtctctggcaagcatgagcactgtgtccttgcgcttgaatctatcttggctaaagcctatcagtatttttatgattcattttgaggtgtggccaactgtaaacgtctcagagctaagcaaataccattaaatcccaggagcacattgaaaagaggtttatttgagcaatattgagggaatttcggcacaaatttcatgggctgtgattaaatctaagctatttgtcaaggcctccaaacccctgaatgtgtaacagattgagctaattcattggtgtttgtaaattgagtttggaattaagctcctttgtaaatacaccgtttgagatgcatttcatcttgcaactctttatcgtggttttctcaaacttaaaatgtataaacgaattccatcttacgtgaatttgctgatcaatttctaacagctccacatttctaaattaatttaatccacacactcatctttctaatgatttattcttctccctgcttaatatataaatgccgaatgagatatcagaaggaggataatagtggagagtatataacctggatcttactcagtttcagaagtatttcagagaagcacgcacagtgcttattcacattgacatctggattttaatattgtcagtttttggggggttaaattccttattacaaatttatgtcaaggatcttctcacgcatcatcacaaaaaataattttaactgttgttactatattaattttttgacgtttggagataatattagccctggaatagtatttttgaactcataaatttgcattatttgacttgatccttcgttccttgactatgcagcgtgagtctgagacacgtgtatgtttactgaacacaagaggtgggccccagacacatgaaagatgtgtctcactcacctcttcctcctacctgagatttcattcaactttcccactgaacaatgattttgcacccccagaggggttttctatgatacagtttataagaatttaatgattgtttcattatgtgaattgtcaggtataaggtggagatattacactccacgttccttctgtagagtgacatctgctgggctgtgccccacagtgattttaagcaagtgcctgcttgttttatggggatcaaagctcatttctcccgatgtttaaacatctagtttattgtggtccggagaagtaattttcacttaaacatcaaagtcagttccagagtttaacgagtgtacctgaaagtaatgctggaaaaatacctctgatgtatttctgtagatgtgtggttatggcaatctgttggcataactcagaacagcctctccacatagaattgtcaaataatttcttcgtgtaattatgtttgggagtatggttggggacaacgtactggatatgagtcaacgtggaggggtcaacagaattactgctttcagggcattaaggaaactcaataggaaacaatacccattaaaaggatacacttgtgcaacaagattgtcgtttatcttgacctgttttagaaaacacgcaacagaggcccggcgcggtggctctcggcactttgggcggctgaggcgggcggaccattaggtcaagagatccagaccatcctggccctgtctctactaaaaatacaaaaattagctgggcgtggtggtgggagcctgtagtcccagctattcaggaggctgaggcaggagaatcgcttgaacccgggaggcggaggttgcagtgagccatgatcacaccactgcactgcactccagcctggcgacagagtgagattccctctccaaaaacaaaacaaaaaacaaaaaacaaaaaacaaaaaaaaaacgcagcagaataaggacaaaactcacgtccttttaaaaacgcatctctttgccttaaaaggctgcagtgatccttccctggcaaaaataaaaaaccacaactgctttgcactttgatatttacggccaggcaaagcctgtgtaagtcttcgagagccgccggcaacaaaaaccgtggagcgcacccagcaagttgctcactccgccgcggactgcgaaaggagcagggttgcggagctagggctccagcctgcggccgcgcattcttgcgtctggccagccgcgagctctaagggtcggccccgcccggtccgcccccgcggctccctgccaggctctcgcgggcgcgctcggggtggggcctcgcggctggcggagatgcggccggggctgcgcggtggtgatgcgagcctgcagggcggcgcgccggggcagccggagccgcgcgccgcggcgctgtaatcggacaccaagagcgctcgcccccggcctccggccactttccattcactccgaggtgcttgattgagcgacgcggagaagagctccgggtgccgcggcactgcagcgctgagattcctttacaaagaaactcagaggaccgggaagaaagaatttcacctttgcgacgtgctagaaaataaggtcgtctgggaaaaggactggagacacaagcgcatccaaccccggtagcaaactgatgacttttccgtgctgatttctttcaacctcggtaagctaaattggtcattttccgcattacagatttagcaaagtataacttttttggcctgtatattgatttttcatacattggtatgctcaagcctggacattttcttaagaacacacgcggtttgtcagggaagctttccccttgctgagagccctgctcgagttgtttctttaggcggtgacacctgcggagagtttcaagttgagtattacagtgccttcaaaggcaaaattgctccagaggagataagagaattcttttcttaatgtgttgttagtttgcgatcagcagaagtgaaaacaccaagaggaacgtctgtgtctgagttaaagggaagaagttgtaagatactgttggggaggcgggggtgtatttaagacacttggctttcagtctttcactcctcatcactaggtgggatgtaaatcaaattgccctgtagactatcttcgtttcacctgccattgtatcaccagtattctttgcaattggttgtatatgtacttttgggagaaacatataaggtaagataccaatatgtaaaaaaaatgtgtaaataatatcaacttgctcagtaaacataacaaaggttaggcatattaatagtttttttcttttggctttaactatgaagtcaacagaaccaaggggtaaattactgagggaaagtcacccataaaatcagtttctttctaagttaatttagggatgacagggtgaagaggttgtggaagcaggaagaaactgtttcttttgaaaattaccaacacaaacatctctagagtttcctccatctgtgtggtaaaagaagcgtacaatttcatttctaactctcataacatatgcaccacctaggaaatctacttacaatttttgtttaaaattgcatattccatttaattctttttattctgtattaatgaagctgtctttttcagttgttagtggttcttacaaagaatttaataattttgactatgaaattttaatttgaaaagccaaataatgaagatcagcattgttgtaacctgtaaaaataaatttctttactggactcttgggtcactttattgtgtaattatggtagaagcaaaatgattgtgtttctttaatggtcctgagtttattttacatgatgtagccactagagctcctgtaggtttatggtaacacattatctggtcttccttgggattcagatattagttaatagcatgtaccaattttatatctatagtttgaagcagtgacacctgtctctttgatttatctttgggaattttgacagcccacattctggttgatttatttaaaatatgcattggtggatacatggctcactggattgctcaccactaggtcattggtttgaatttggcactagtccatggttacttcaactgcatcatttaacaactgcctgttggtcatctggataaaatggcagataactgattccagtgacttcagtgatccaggattgagcacacatagatttatgtaaggaaacaccacttccagagacaattactccaaaagagctaatgactattgaagtgagtaggtacacatgaatgctcatgtgagattttgctgctgctgttacgttagtggggggaaagagttctcatccagtaatattcttttagctcaattctattcaagtctttttaatgtaatggatttctagagagaagatccgttaaaatattgggctttcctttgggtatcagtgtttttcttcactgctttgttctgttttgatggtagcatcaatttgctggaagatgaaagtttctcttgttgcaaagacttccagacacaaatgaatcaaatccacattttcacatctgagaagcaaagacacagcacctcctactgtttgcattactgtaaaagttcagatggttcttttgtgaatagggtgttttgtctagattgctgttttttcctactcctaaaatgtgaaatgagatataacaaacatgttgtctctctcttaaaggtattttcccttggatattaacttgcatatctgaagaaatggcattccggacaatttgcgtgttggttggagtatttatttgttctatctgtgtgaaaggatcttcccagccccaagcaagagtttatttaacatttgatggtaagagagttgataaacactctgggaaaaatgttattttaagttttgttatcttccttatccagattcagaaattaagagtataaatattactggatattaattttaaaaatatttactgggctgcgttttggaggacaatagctattttaaatgattggttaatagacaaagatcctctgttggatttgaggtatttatgaaaatgcttataatatatgctgctttttgtaaaataattcttctgtgcttgcctgtgtactcacagaggagatgggcacgagctcaaagcctagcatctttgatcttactgttcacctggtaatgttaagaaattgcccctttgtgctaatcctcagcagcagagagagctatgcaggttcaattactaaaaaattctcccaattaattttttgggcattagtctcaaaactggttactccgtgtgttgttctaatggtgtttcttctttttccacaaggatttcctgagattggcatagtcccctaattaattgaaaaggacctaaaagaataattggaaatatgcttttgatggttgttgtatacaaatgttctcagaagcttagggaaatgggtgtgatttcagattttcacatacataaaaggtgcaaggtcttctgagggaatggtttgcatgagctttaatgtatatagttcaaaggacttacagatgaatgaatttggttagtcaagtaacccatactaattggacagatggagcaagacatggatgaggaacaccatcctgccaatcaaggtcatttataattttattacttctttcaactctgcataaactttagtgtcattgcaagtactttttctttcatttgataaacaatatattctcagacctttctatagcagagtgtctctgaaactttgtctcaaattcctttttttttttttttttttgagacagtgtctcacgctgtcaccaggttggagtgcagtgacacgatctcggctcactgcagtctccacctcccaggttcaagccattctccttcctcagcctacccagtagctgggattacaggtgcgtgccaccacaccgagctaatttttgtatttttagtagagacggagtttcaccatgttggccaggatggtctcgatctcctgaccttgtgatctgcccgcctccgcctcccgaggtgagccaccacgcctggcctcaaatttcaaatagcagaatgactgacacttgccagtcaaatggctgtcctttttttctttttaagtcaccagtgctttccccaaggttgtcataagcaccgaaggagccatatttggaacttagaatgtgtgagcttctaattgcttccttagcctccatgcaaggcatttccccttaaaacccatagctatgcagttaagttgtgaagaatggaaaaacagaccctttgaggtatcctttttagccccttaattactaaagcatcttacagactacccacacttttcctcccaagttagaactatgaaatacgttttcaaataaaagagaaagggcattaagaagtagtgcaatttcccctctattttctatatttctcctagtatatatagagatggagtgacctaatagattagatgtctctacctgctttcttttccattacatgaaaattaatccaaactaatgtaaatatcaacaaaaagtgtgttactagagataatgaaccaattctgtatttgaaaaagcaattgcaattcatattttacagaaggaaattacatagtataatcttttagaaccagacttcagaactgtgtaagacagtgacagctatgctatacagtgactagaagtaatgatgggatttaaaataatatatgcctaatattttaaatgcactcaaacttaaaacagattcttgcagaataagacttgccttgatttgtaacttatgtagaatatgacatgagttgttgatctcaaagttctataattcctgatattttgttcttctcaggtgtattactggtactcttaggaagtgagagaaaaacagagcaaataatcagagagatagaaaatcacttgttttgaatactgtttaaaagagatgtatcaacagtgagaatacatctaataaaattgcacgattggtaactcaataattttaaacattcctacaatgaactacatagacaagttatagggaaagtatcaggcgaaaacagttgtcaaaatgtacaaattttaaaccttggttcaatacagttttcttaggagatttcacagtgtacctgcttgaaatgcctgttcaaatttattattatttaaagtttctcattagtcaaatgatgactcattgactattgtaccaagtaggtttttaagtttcctccaaagtagtttattctcaacatcaaaatatagagctttgtatggggttaatgtatttaagagtatatatttaaatacatgtggcatatacttctagttcgtatttctaaagttctattactgttttccaataaaaaatcagcaactgaaaggtgttttgcagaaattcagatagtttcaagttgtattagacagaggtcatttgcattacttgttttatatctctaagtacctttagattctctcgtaattactttacctactggctcttttgtcttgaattcttctccatcactgtaacttggtcctctgcctgtctctctctgggtggaacttgagaagaaaccactcagtcttgtgttacttccggtgcaataagcatcataggcaatttcaaggtgtgtagagcaatgagtctcttctcccattcatgttccatccctttttcttgtggtgaaataatggagtaataacatttgtaaaacagtgatttacaggtttgccttccctgttgatctagggcaaggtcaaccagatggtcatcagtcctgtgggagaatgtacttcagatgttattaattagttacatttgtgctacttaaatcttctatgttgagacctgtgacttctaatattttcttttgtaattggtctaactcttattttatgccaaatagctttgcaagtgaatataaggttcacacaaatgcttttagtataagtttttccttagttaatattggccaatcttgcagcccatggctgaatttacatttgcatatgcatgacagtggtttaaaaacagaaaactgagtgtgagttttgaattggaaataggtattttatgactaagcactagacttgcataggattacctgttttttcttttccttttttttgagacagagtctcgctctgcctcccaggctggagtgcaatggtgagatcttggctcactgcaacctccacctcctgggttcaagcaattgtcctgcctcagcctcccgagtagctgggattacaggtgtgcgacaccatgcccagctaatttttgtacttttagtagagacagggtttcaccacgttggcccggctggtctcgaactcctgacttcaggtgatccgcctgtctcagcctcccaaattgttgacattacaggcgtgagccactgcgcctggccctgttttatttatttactttgtgattcattttcccttttgtgtgtgctgaatttttagtaataaagctgccaaagtctccaggtctttgatagtatgtaaatgaaagactatggaattttataaaacatcttttaaaatcaccctcaacaaataaaagaatccctgtgaactaatgaactaagccccaaagctgatgaattgttattggacaataaactgaaaataataaattgcctctttatgagctctggtagcattagcattacaaggcacgtttgttgaaatagtttttgttgtggttgcccaagaaatgaaaataaaagcagttgttcttgatttctccgttaatcttggaagatgcttactctgggtgtattgaatcttctcaggtttgtgttactgagaagtatttagttctcaggtgtgtgttatggcattttcttttaagtctccttatgatggtttcaattaaatgtcactgaaatatcttgaagcacacatgagtgttttagtaaacccaaactcaaggggtgctctgtgaataaaaagttccttctactctcccccttgtgagagtttaattgaactcagcaaaggattgatgaattcacttgtgagttggacattacctgaaacatgagtctagaatagagtaacactaaatttgtaaagcagcaaggtaaaaactgttataaaatacaattgcaatggaagatgagaagaattgctaagaaatgtagcctcgtatgtctattttcccctgtaatatgtattgatatagggctctggtaatcaaaataaaataatatttctagtagacttgaattggagggaggaaattttatttcaggtattgcaaagaacatctcttgaaaattttaggataaaaggtgttacattgatatgctgtggatttctcctagagaaaaaattttagaaaaatgtgtaagcctatattttcctgtttaaaaaagtaattactgttccaggtgagtttcatcagattataataagcttgattctgttgccaataaatgatattctgtgttaagccattcagagttacaaggttcctacaattgggagcaaagaaggaatgctttagtgttctgaagttagaagagtgagcttgagtgttttgttaatcggtcatacgaacacagcggttccattaaaaaaaaatgtggtcgagcacgggggctcacgcctgtaatcctagcactttgggaggccaaggcgggtggatcacgaggtcaggagatcaagatcatgctggctatcgtggtgataccccgtctctactaaaaatacaaaaaattagccaggcatggtggtggccacctgtagtcctagctactcgggaggctgaggcaggagaatggcataaactcgggaggcagagcttgcagtgagtcgaggtcgtgccattgtactccagcctgagccattgtactccagcctgagcaagagagtgagactctctttcaaaaaaaaaaaaaaaggtcctattctatgaattaatagacatgcctaaacatgtttactaaattgaactctttatcaaatgaagatggtgcaagtgatcctagatagcttattttaaatttgttcacatgttgatcatatatgttgatatgttgttcacatatattgataaaacgatgttacttagcctttatttgcaattttgattcagaagatatatctagaaccaaagttatacattttcgcattcttcctaggtgtatactactttttgtcttctttgtttctaaaatagttttggcaattaaacactaacattaatactgactttgtggcagccatttctgtagctgccatgagaattagttttaagatccacaaagatcacaatgaaaggaaaaaggaaaagaatttttctcagtaagatattctgtaaacatatcatgttaactatgtcatgctagaattttacattgctcttagaacatcaaacctgcctgaaaatgaaataaaattcattccctatatcatcccaaattccccctttaatttatgattcatcaaggtgaagatgaggggaattacctctctggaacatgtttattttgttgctgtaactgagatctccctttgtgcctatgcgagcaagtcagtgcttagatggataacagtagaaaaaaattattatacactctcctcatttcattatgcaaatttatcaggatgtatctccataaattcactataccttgcactgtcttttaaaacaaaagattcagatgttctttttcatggatatcattcattgcattaaaaaaatggcaccgagacacactcaattttttctttcataaacatcttttatataaggaggttgtaaaaaataacttattttaaataaaaaaactatcactttgctataataaagaactatcactttggttttagttccattactgttaaaaaaaaaaaaaaaaagaacgagcattgggaaatagagctgtgagctttgggcagattccagcacttttttgccttctgcattttcatttatatattactgaagacctctgttgttaaggaaaacacatttaaaggcaaggaacagaaaggtaagatgttctgtagctcagagtatgagttagcaagaagggcacatggaaggtagaactaagtgctgagccatgtgctattttagggtagcactagccatgaaacaatttgctgagctgtaaaagatggcaagtatgttccacgttttaaattgcaggcttttcagaaacaatcatttcaacccatcctccttatccaatgagaatgagctgtctttaagctctcaatagggatatgttacttctgtaaaatgctttttacttttcaaataattcccttattatttaatttattatagaatgcctatgaagtaaattggcatggaggctaaagctcttggttaaggttctacagcttaatggtggcattgacaagactagaagacaaaatggtataagaagagaaaaattaattatgagcagtgcttgtatagaatcagagataccctgcaaatgtatgttacaaaatctgcagaaatgcaaggctattaatatgagtattaacaacttgcttcatgatatttcttctccaagtatgtacaacactgtagctttaacataccttacatttttaattaactgctgattttcagcagtaatttgaggatcattatatatcaggctttaaatctgttcaacaccatattttaagtgcctctcaattctctttgcgaagattgaggcaatacataaataagaataatttatattttcatttatctctaattcatgcaaattaatgaacatactagtcttgtctttccttccccaagttactgctcttgtaatcaagagctcgtttgatgtgctatgtacatcaggattccatattccccttagtcaatccctagaatattccactctgctcatttatgtattgccttagagtgaaaaatccattaaagtaatcttatgttctggtttgaactgatgccactgaaaatgctaaatattcttgccttactcaactttaacgcttgctagcatttaagattcttgataataaaagtataaaacattctacctaattaatttctaaattactaccttagtacaactattttctgataaaaatgatcaggtaccagactttgaattttgaatacaagattgctcttatatttaaccttatttgtaatataatggctaatgtaaagtctctagtctatatggaatagataaactcagggagttacagcaatgtaattttacagaagatttctgttcctcagagaagggagacagaatgttgatccagcagaaagaaaaccttaactctatgtagaattaatagctctgaagaagcaacttctaaattattttaggaaaaacttatttccttatagattttgactttctacagatagaattaattatggagagaggatatatatctgagtaaaaataaatgcagaactctctcacacacacacatacacacactcacatcgtctatgagtaaaattacattatatttgaataccgttttagtctttcctaagtgtatactctcttgtatattcatataacaaaaactgttcagtcagaaaaaagctgttgtattcctggtatcattttaaatgcattatttatatgttttcttattttaaatttatgaataaccacagatttgtaattatataattggatcattagtttggtgaacactttattacttaaaacattattgtaacacttatatagtgacagcttttagtgcaagcaagctgaggaccaggacaagaaactctggtgacttgtgaatttgagccctgtctccctcccatttttctgacagctggtgatagtgagaacaaaatgagttgttgaatagcaacccgcaaaaaggaagtaatccatccctagcacagataacggggatgtaaagggagtcaatggggcacataatatgtaaagcatcaataagataagtacctaaatttgctctctacgcctgcttttctttttttccagccagcgaagtcttgcaacccaagttgctagtgttactatagttagcgtcagttgccaaagagcgagcagaatctcaattatagcatatgaaatgtagtctttaattatgtgcttcagttttccaaaatcctcatttcacaaaagttaaattagaaaagaccttttctcttttgtaaatagacataactttgtacaaactgtgtgaagtacaccaagctggcacttcattcatcgctgaaatttgatagtgaacacaacgggtctgaagattttaagacagcagtaacaaaattagaaactgagagtaaggggagttgaacgtcctagtattcttgcttgaccttccttgtaattgagtcaagtagaaataatatatgtgatcacagtttattttaaatgatacagactattacatgtgaaaagacaattccaatgcaactataattcttaagacagggatctcttgtttaatggaattagtgagtagtagcaaagtggttataaaattggcttgtataaatattatacaaatgatatttttctattgaatttcgttacataattagagtccatgtgtaaacaaactattcaacagcctgaattgaacaacttttaataaagaaacttaacaggatgataaggcatgcagaagtttagatatggtatggtggatacgttggagccttttaaataacatgtctgcccttgtagatagatgtacgctagttatcataactcaagcagaagaaaaaccttatgacttaaattaccccttgatttgaaaagaattatcgaataatttaatttgtgtcagttgccagtcagagccctaagtattctctaaacagtctagttctgtattcacaactaaacattattacatactaatgatgcagttaataggaagagattggagtctcattgccattatataggaatctgacattaaatagaaccacccttatagattgtttataaaaacaatctttctggcatcaaaagcctccaactttgttggtccatccagccagattgtcgctccataaattcaggctcaagggctttttcctttctcctgaacagtaatgctcaaaacattccaagagaccagaacattaagcaggaataaaacaatgagtgtattatcatcaccaaaagagcattttgaattttattagaagaaaccaattaagatgttattttcaagcagagggcttggcatggcttcagaaagttactttccggagtcgggcaggggtttagctggcacagagagcggatctttagcttagagttttgacagctttaatgcacatgcaactggaattttttttctttaagctgattcttttaaaagccatgcttcctgccactgtttcacataattgcatcaattccattttccattagtagtcaaaacctgctgatgtgactggagttttaaaacttttgtgtaaaaatctaattatgtacattttttcagaggaaactgataatgaatatgaactatgcagctgtattttctattttgatatctaaagtacagtaagcaaagggttctatatgctagtattataacctttggttattcatttaattatattgacaacagtggtataatcaattttctatgatagaagaaaaagcattcagtaagctttactttgtggaagaaaaagcagcccctaccgcttggctacagaataatgaaatattctggttttaggtgaaaggaaatgcttgcctctccccttatatctatagtattccttttataatgtttttattttcaacagcttgtctgcatagaatattttataatgatctacactggtatatttcttctgacatctaccttctactcttctgataatgtattcaacacttttaatacgcataattatatgtagacatttcagatactacactagagacttataaaatatactatctagcaattgatctcttgtatttgttttcctttcttccctctcttttttttctcttcttttttactgacatgagaaaaagatgatcaagcttagtctggaattattcatgaaatggtgaaagcttcagagcccaggtgctgatggaatgtgtagcaggaatgtagttaaaggtggccgagagttaagatgtgtcatttatttgtgctatggagatgaaattcagtgccatgagcacttagatgaaattacctctgcaataaccatcttcggtttccaaattttacaatatttgatagtaaagcatagttgcaaccttttctaatattgcttctgggtaaaaagaatattagatttttaataactaaagataaatttgctgaggtcccttaatagcatagacatttttcaagatacatacgtatctgtatgaagttccaacaatagaaattttgttcatcttccagtggaagcaggaaaatctagttagaattgattgttggtgaattatggatcgataagagaaaaaaagcttttaggcccttttgtaaagcttgttatgtccatctgtctctccttcttttgctctctactcacccagcttccttacaaagaggttttattattcagttaaaaaaaaaacaaaacaaaattacattcaattccatgactcttttccagagcctaccttgtacaatgctgtgtgctacatctgtgggtacaaaaagaagtgtggcgtgaatttggtcctcagcaaccacctactctagtaagtggcataagccaaccatgtaaatattacaccaggcaaaccctgctgcataccataaaagaagcatagacacctcacagaaggtgacattttaaaagcaaaaattatcttaaactagtttagagcatcagctttaaacccattgtaggcattaatcattttgctagcagggattagctttatcatagttacaaactgaatggagaggggaattaagctggaatgcccgggatgagcttattgcacttacacttattgcaggagtctcccggcctctggggcaaaatgcttttgctgattttgttttctttacctccaaattcccaacagtgcctgtaactgtgcagagtcattatgactgcctgactgataactgacaaacaggctgacttctaatcgtcaaattaaatccaactgccctgagcatttaaaatcctaaactgtctgtggtggtggtaggggtcttggtgtctctctctctctctctctccacccctccccctctctccccctctctccccctctctccccctctctccccctctctccccctctctctccctctctctccctatctctccctctctctccctctctctccctgtctctccctacctccctcttcccacctcctcaaaaaaaaaaaaaaatggccataattgagggttgcagcaaaggcatgaaagaggctattttaaatatcaggagttcaaaacaacattacctcaagaaatgtctttcttgacagatttcatacccagagttcaaaagcttttttttttctctgtgctttcattttcatcagcagtttgccaccctattatagggccacaaggcttgaagttagaaagttagcgctaagattctgaaaattcaggaaaaagaaactgtaattctgaatttttggaatgactggtaaggttaaacctgagaccctagggcagtgattctcaaccttggctgtacgttacctagaagctttaaaaaatgctgatgccaaggccacaccccagaccaattcagtcactatctctagggatgacactagtgttgtaaaactgtccaggtgactttaacctactgccatatttagaaaccacttcccccaatccctaaaatgcagtttctgttacacaacatgaaagtgtcagggaactccttttaataataaaagagaacactattcaatctagtgttctagcagttttcaggctgcaatcgttactaaaaattaaagtttagcccccttactcaacagttgagattctcaaagccaggtaaatcatcatcagtgtagtggtaacgcagtttgagtggctacaacccattaagagtgaacaaatacccttcacttactctgtgtggaatgtgaagatccatttcaaagccatgatttagaaaattgtgttctattttctatatcctttgtattttgaaacataatgacatatctgtaagaatctcaacaacatgaaaaggtatttaggccaggtgtgacggctcatgcctgtaatcccagcactttggagagctgaggtgggtggatcacttgaggccaggagttcgagaccaacctggccaacatggtgaaatctagtctctactaaaattacaaaaattagccaggcatggtggtgcacggctgtagtcccagctactggagaggctgaggcatgagaatcacttgaacctaggaggtggaggttgcagtgagccgagatcttgctactgcactctagcctggacaacagagcacaactctgtctcaaataaaataaaattaaataggcctttaggttacatcatcaggcctaacatataggggattaaatacaggtttgtgcaatagatgccctctgtgtctaatggtgggataatagactttctaaaagatgaagaagctatagtggtggtaggggtaggggagtggaagtagaagatagggaaggcttcctgtcactcacaaaaatatgtcacttgtggaagtgggaacaggttctggctctttacatttgtttccttgtatatcattttttttagccttttaaatgatgtgtgatacgtagtagatacttaacacactaatgtactgcataatgatgtttccattgagaaggaccacatgtattatggtagtctcataagatttatttttaatttttttgagacagagtcttgctctgtcacccaggctggagtgcagtggcgtgatctcagctcactgcaacctttgcctcctgggttcaagtgattctcctgtctcagcctcctgagtagctggaaatataggcatgtgccaccatgcctggctagtgcttgtatttttagtagagacgggggtttcaccatgttggccaggctggtcctgaactcctgacctcaggtgatctgcctgcctcagcctcccaaagtgctgggattacaggcgtgagccattgtgcctggccccataagattattatactacatttttactgtaccttttctatgtttagatatgtttggatacacaaatgccattgtgttacagttacctacagaattttgtacagtaacgtgctgtacaggtttgtactgaggagcagtaggctatagcatatagcctaggtgtgtagtaagagatccacctaggttggtataagttaaatatatgatgttcgcacaatgacaaaattgcctaatgactcagaacataccttcattgttaagggatgcgtgactgcaaatacttgaaagtgaaagaatgaatgaattttatctgcattaggagggatgggcagaggtagagcagaaagaaccaaaatagtggatcaaaccctgtcagggctctcagttccaggatcataaggtgccagtaattcagcgggcttatgctcttaccgttcttcttagcacataatcttggcttaggtctctgccctttgtactataatcctgctgttttcacgtaggcagaaaagccatgggctaatggctggcagttctgttttggtatactcaacaacacacaaggaaaagtgtaaatacccatgggcctctagaaataaacctgggatttcattgaggaatagtggaaacttcactggagcctggaaatgggaacaagactgcccctgctattatgagttacaaatcatatattattttagtgtgatgttgtgatatcatgacgacatgtgttttggttttaaatgaatcattgatgttagttagtcttaaatacatggatagttgaaaaattggaccatggaaatttatagttgtttatgtgatcaatttaatatttgtgctttttccggaacataatttttctttagctatatgagagattaactttgttttaatatgcacagttagatgctttcatttgcttataaacatagctacatatttacaattgaaaaaatttgtagggaaaaaactgtgtaactgataggaggtagaaataagaagtcttatggacaggtcagtaataaacagaacacaaattgagtacttagggactatgaaaattgtcagtgttggctagaaaggatatgtcatctttacttgttcttattaaaacaacatgaagcccaggtgcagtgactcacacctgtaatcccaaccttttgagaggccaaggtgggcagatagcttgagtccaggagtccaagaccagcctaggtaacatggtaaaatcctttctctacaaaacatacagaaactagttgagtgcggtggtgcacacctgtagtcccaactactcaggaagctgaggtaggaggatcacttgagcctgtgaggcaaagagtgcagtgagctgtgatagcgccactgcactccagcctgggtgacagcgagacagtctcaaaagcaacaacaaaaaaacccaaacaacatgaattgaaaaactttacatggcctttatcaacagcttataacattctttgttttagtgcatcaatataatgtctttcattatagaaaaaaaggaaaaataacttttttgtgggaggtataaatttaataccttataatgtacaatatacctaatatgggcaaagtcagagacacacatgttactcattggatgccctttaggcaagataagaaaattagacaactattttatgaaatgaaacagcagatgatattctaggacattgtgtatttttaaaattgtagtcacagaaaacaaagatactgattccaagcttctacctacaactttactgattgatctttaatggaaagatacattttccctttgaaagaagtgattaaatgtagtgtgcttctactacttagcacttggcggtaagttttgcaaagtatatagatacagtgaagtaactgacaagtaagaaatgcttaggatatagttgcaggtgtaaaatatcaatatctgatttaggaaactgtaagactacaactctctgtgtgtcaaaatgtgagtttcacagctgtggtgcttccctggatggaacaaagaaaaattgttttgcctaatggaaattacttctggacaacactaaaatagccacatcagtaaatcgttgaatcacatagtcaaggatagtttttatttttcacaggatatttacttaattttttgttttagaatattgttgataaaaccaaaattattaattctaactaacttgacaactggaaaaattatttgactttgttataatctttatgttcccaattcatttctggagttcatccaccaaaattagatgcagtaattcgttgtaccaccctgtacaacaggcaaaactgtgactcatttcctccatccagttatgccagaactgtttagtgcaatgtacaaaatgaggtgttatggcacaatatttcccaatttatttttaagccattcaggcaatatatccaacatcttctgttctaaggagcacaccttaaaacacaaattacatattttccatacttcattcttttctctttgttatctcagcagtacacaggaagaaaaggtgatggagtatttatagtgttgtacaataaactagtcatgaaagtgattcatttgttatatagagttactttttagtctgtgcacgatttacaggccagtagtgaatgggccctcccaacctttatctttgccttgttcaaaccaaaatggaaacaattgattcccttctgcacaacctctgctagctgaggcaaatgtagaaagcctaggtcaggctcaggagctgactgcatgagtgtgaaatcttgctttaccacttactagccatgtaactcatggcagttgcctcaacttcctcaactgtttactaggctatacaattaggataatattagttgctacctgataatatcattgtgaatattaaattaggtaatatgtgtaaaacacttatcaagatgtgacacacagtaaaaacatactaaatgtagttgggcatggtggctcatgcctgtaatcccagcactttgggagaccaaggtggatggatcacgaggtcaggagattgagaccatcctagctaacatgttgaaaccccgtctctcctaaaaatacaaaaaattagccaggcgtggtggcgggcacctgtagtcccagctacccgggaggctgaggcgggagaatggcgtgaacccgggaggtggagcttgcaatgagctgagatggtgccactgcactccagcctgggcaacagagcgagactccgtctcaaagaaaaaaaaaaaacatactaaatgtaagattatataaagtgaggaaattaaaagatgactaggaattaatgggtataatgtacactatatgagtgacagttatgtgaaaatcccagacttcaccactttgcagtctgtccatgtaacaaaactgcacctgtatcccttaaatttacacagattttaaaagataactagaatagactccctaccctgaagaaatgtattgtctgggtatattaagaaatattaatatagaagtagaaaacttgtcactagcctagaaaaggatagtcttggttcatataatatttaaaaatgaatcagctgctaacatttaagaattagacttcagttgacagtctttatttctcattttttcttgaaatgtcagaggatctggcaaggactgatgggggctgagaagagcccttcttctagcctggtttcttttactaatttatgttacttgcctgacctcaacaacatggagttttctactcttggtctagagtaaagcacagtgacagataaaaaattaatttatatttaaagcaaaagttcttataagaatgctgtctccagggtggtattgatcaaggcagagaagaaaaaaagtagaactgtttatttcaatgaaaatacaattagaaaaaagttaaagtcataaaacaaggtgtatatcatatctttctaacaatatgtcatatcattttaaaactgaataaaataatgcatttacttttgtctttgtctacgaacatatttgttacgaaaaaataagttgaggccgagcacagtggctcacacctgtaatcccagcactttcggaggccaagatgggcggattacctgaggtcaggagttcgagaccagcctggccaacatggtaaaaccctgtctctactaaaaatacaaaaagtagccgggcgcagtggcacacgcctgtaatcgcagctactcaggaggctgaggcaggagaattgcttgagcccgggcggcggaggttgcagtgagccgagatcatgccactgcacttcagcctggccaacagagcgagactctgtctcaaacaaaaaaaatgttgataaagtagggcacataagaatgtttatttagtgaagggattcaacaatagcattacttcatttttatccatttgtgtacataggtgtgtatgttgaggtttgtatgaagctacaaatcacctataaaccaatttaggccatgttgaaagactttgggatagaattcatcaagccactactatgaccaacagttctcaattttttttttttttttttggtcaaacaaaaattatggacaggctgtggctactaataagacaatgtgggctaatactattttgcataattattgtgaaaaaattattctgtaatttcagtgaaaacctatcctacctttatgcaagtatgtttaaggaaagagattccctacctgcgtgtcctgattctcaatacagagtgattatggaagcctgattcccatgtcctgtgagctgcaggactagtgtgatttggttctgcctatactttgctaaatattaacacaaaaaacattgcttgacacatgcatatttttatacatacaataattcttattaatacaattactctgctatatactcatctttgtttctgttattattatatatggaattcagtgttactcatcttcaataagaattatttcacattttagtacttagatttatatttttctgttgtttgtttgtttgttttgagacaaaatctcgctctgtcacccaggctggagtgcagtggcgcgatctcggctcactgcaacctctgtttcctgggttcaagcgattctcctgccccagcctcccgagtagctgggactacaggcatgtgccaccatgcctggctaatttttgtatttttcgtcggcacgcggggttcagcatgttggccaggctggtctcaaactcctgacctcaggtgatctgcccacctcagcctcccaaagtgctaggattacagggggtgagccaccatgcctggcttatttttctgttttttaatctacgatatattttagaaaaaagaatctggaattgatcaatataaacagcccctaaattatctcgttatcctttaggacaattggcaagagttttaataaggcatgccaggctctaactacaaagaaaacaaccctatatttttaagtttataaacaatttagaaaaatagctttattatgtatttattccaatgtatttaggatccatttttctatattgtctgactgtagtatcaataaagacacttcacaacaaagtaaacaataaaatttatgactaagcaaagctgaacagtagctttaatcttttaaatggtaaatgaagccttctgaatttctatttacttgtttgcttatgccagtatcaaaccttgcagtcaattaaacagcctcaaacttttttttaagcatgttttcctcatctaggttatctttcttctcttcagtttttctaattcttatttctactatccctcttcgtatctgggcactattttctatgtttcctatcatgaacatctcctctcatttttacttatcctttgcttttcttctctggtgttcaagaagggaggtcagaattggccagggcatgtaggcaagtgtggtctgttgactaaagcttacttaaagcagctcttttactactgaatctctcctgtagttcccagcccccaaaagaaggcactacttccctctggagatccacttgttattcaaggaacaaggaaaggatgttgatattttaatgtttttatggcctttttcttagtgttttatggttttatgtttctgtgtttttgatgggaattcccaaatacaatgtttccacatgctgcctcataactcagacagcaaaaatgaatagttttgtctagctctagtttattttagatctttatttttctaataattactaaaagggaaattagagggagaagaattgagtagaattgctaacattccaaaaatgtgtgccagtggttgagtcaggccatgcaagttgctggcccatcccacagccccatgctctccggcgcctacctgcccccacacccctgccacacaagtcttgctaccctgccacacactgtcaccgggtttcctttcttttgagatcggaacacgagacggagcatcaggagagggtgaagaaattgagatacacagggagaaagcagacattggaagctgggtaagggcagaagacttaaggaaaggagaagccccaaggaaaggagaagccccattgaaggggcttctagaaaagttgtctcagaaagaagagaagttaggatgtaggctagctggttcatagcatggcaaggaccagaatagggcccaacagacaattctgagacagcaagttgtgaagaaacaacaaccaggactgatggagggtcacaagagatcctgttaactattagagctaaacagcctattccacctgaggttccagttaagcattaggctgatttaggaggctaagacaacttttctgtttccctttctacgttatctcatatatttaattatctcaaataattgtatattgcatgtaccttatcctgcatatatctaatgcattctctttaaaggtaatctgagatataacttttcttgatagcaggtttatgactaaggcttagctaaataacagcatacagtaatagagaaatgagaaaggactcctagagttggagcaactagagggcagacaacacaagtttttacataactgtgatttaacacaaatggttatatcaactttattttcctgattttactgaggtttgaagcattttcagtttctatacaatggaatcagttattgtaaattaatgaatgaattccatgtttacagttgtagggctattttaaaagacaatcattgattattttggggaaatcgaaaaagcaattttaaaaattcatattgtaatatgaattacaatattagatattaatatcatgcttagactactatggggatattactaagtacaattgataagataaactaaacacaactctcattcacattactgtattatctatattttctttttatttcacaatatttcagaaaatattgtgaaacaaattaaggagcaactacaaattttattcacaggcctaaatatctgtcagatgttaaaggattatagaagaaaacttttaaaatggatgaaataaaggtaattaattgctatagaataaattttgctttagacagccctaaattgaatcatcaccttaatttttacagatcccagagatattttaaaaagtaagtagctgtttgtatctttaacaagattttttaaggcattctcctcattataaagctcataattgtttccacctagataattaatagatgacatgtattcctgagacccttttatgtttaaatttaataatctctgcaacattctaatcattccgtgcacatgtgtagtgtgatgtgtatataaggactgaatttgttttatttttcaaggattcgaattttttgcagatttttaacacctttatgaaagtcattttgttaagtctagagtcaagaaataatttttaaaaattaaaagattgctgcatctgaacattagatgcagtgaacattgccttgcactgtcagtttacataggagaaactaatgaggctgtaaagaaatactatctgttttactagaatttttgaccagtgaaacaaacagctggaaaaacagtggtagtcggctggcttccattttccattgctttctgccctttacattcaaatttcctcttattcatgaccacaggctcaccacacacatactccttggtttgttactttaagccacatggagattaagtgccattagtaaagactagtttaggaacagttttaggtgaaataaatggcactttcaaagagaaggtggatttatggagtttgtgtgtacatgcgcgtgcatgctcacgtgtgtgtggggataaatcagtaaggaagaaatcaggtggtgatagttggatgccattagtgactgggacatgttttattttacagtgttatttctcacagtttaaaagaaacattagaatcatctaatctggccccttatattacagctgagggaggcccaaagagatgaagaatcttggctactaggcagcgtaactagaacttggatatacttattacttgtgcatccatggtgttcccccatcatcactctcttctctacctaaccacttaagaagtaaatggaggaattgagataatgcagtgtgaaggatgataaaaataggttaagagtgggtccaatcaggcattaaaaaaaatagttatgaaaggtaaattaggatcagttgcaagagtttggggacctaaaacaagcaaaaattagttgatttattaaaatatccactgtttgctcttagcatccaaagaaaagaagaaaaagtaataatgtgtagtcatagtcagtcgtctgccttcaaacccccagtgctaatgcatcagactgggttcaaatcccgttaccttggaaacagcttctttggagcaatgtgtgattaaaaaaatttttttgtagaaacatgtggctatgagtgctacattaaaaaaaattcttgtaatattgaaaaactaaatcatgtaaaatttaattccagtgaacattgtattgacatgacaatgtgaaaccattgtgtaacacatcaagaactattaataattcagttattagggaggtacaaagattttatttcctaattacaaatatacagatctaacttactgtgttttctttatattctttaaaaatcgaggtctctacatttaaataagaaaaatggtatactctactttcttatgcacctgctataattaaaattgtaattacagtattcatggatgaattggtagtagtatgtagacagtattatctacaaaagaaagcatttggttgttgtatgataaattggatatttattttttaacgatggcaaagtagattgtttatccttgggaaatagaactagttttcacagcattcatgtgtgtcaagggttaaaattcaagtgagttgtagaaatggtaattaaagtagaggaatgtcttcagttacctttcattcatgatacagcatgaaaactctcataacgttgtaacgttgtttacattttaaaagtgcttgtctgtttcaaaatggctgaagtgtaatttaactgaagtttttataggttggtttttcttttccaggaattatgtatataccttggaaatatccttaatgtattctctgaattatttatgtaacctcagagtctatgtaaatctaggatgacatctaacaccaaatacacagtagcacgtatcaatatgacccctccacccaagccttccaatatatttcccttaaataaaataatttaaaattcttcttgagcacctactgtatttgaggcattgtcttttgtatcgaacagacatcagtaattggtaaatttctttcttgccatgaacttacaatcccataaggagatgatgagaataataactatataacagatgatattattagcaatcagtgttgaaggctagagagataaaggaaaaggggtgtaaaatcttagttgtacctggaaagagtacagtttaagaacatatggtcaggaaagaaggcagagagtgtatctgatagaacaatggtgtagacataaatttcccaatttgttctgcctcgagtctaagacaccatgtcatggatttgaacaatgttgatggtggagactcagacaaatggggctggagaaacctaacctggctcatgaactgtccaaacgatgagacaagttgccctgacagggcagttgtttggaattcaaggtacattaggagaaaaggagggctagataaggaaagcaatataaataagctaatgaaaagggataaatataactaaaaataaataaaaactctgggcttcacattttccacctttcgtcttttagtcatctgctaatgaaggagcttaaggacaagaggttttatgaagttgaagcacaactttaggttgctcaatgtaacacaatccctagcttctatctttatcaatgaagaaagaataagaaaataagaataaccaataccctgtattcccttagaataaaatcacaagaaacacagtcttttgttttccagaaaagattattcttgttagagccatgaaaaatgaaggaaaaaaacatcaaatacaaccacatgttccaacctttaaaagaggaattttttgttcaaagtgggaatttagttagaaacttgagtagacaaagagcaaaatacttacgcctgaatttctagaaatgccttgtaaatacctgttagacaacatgtcttatttaaggaatctatttttgtgaaaaatgatctaatgtcctaacttcaacggaaaaaaatatcagcttttctatagtgtctgttaggtatgaggtactctacattgttgttgttgttgtttttttaaattttcttttggtttcaaagctttttagtataccatattcttacaatgtttaggacctacttttgtttcattttacagacaatatacacacaacttaatcacaggtcttgaataagaagtagagaatcatacaaaaggacgaaaatatcacagatcaccttgcttttagaaaaaaacaaagaaattcctactgactgttaaagtaaataatgatctctctgtaaatacattttaataatctatgctaggtctcccaggaaaatattaatgtgcatttaacttttaattataaaacattatagagaactgcaggataaatgtcaaaatgatcctagtcaatttggcaagtagtagtttattgcctcctgtaaagatactgtacagaagccaatgatttttgtctgtgatcctacaattctaccattatgcaaagagttattgcaaagctgtatctctgaatgaactagcctattagtaatataagaatgaaagattttatggtttataagatatttactatttctactgtttcagattttttggggaagatagtatcctaagcgtatgggtaggtatcttataaaataatgggaaagaaaataaatatttctggttgattattcttgtttgaattataaaactattgctaatgctttttactttaaaaagtaaattttataataatatgacttttctgcttagcatggaaaaacaatcttcatttagggaaattaagatactttatataatctggagaatgaattttagttaagagaacgaaatcactagtcctcatagttttgtaacttttagtttgattttaactattaaattcagcaggaagggttagactattttcccccaggactcaataaaataatttgcatttttcttttttaaaaacatttgaaaatattttttaattaattgatatttcccatgtttttaatcatttaaaacaaagataggtgtgcaaagaaagggcatgtatgtcttcttgtttttccttacttttttttttgttaccattctgattcctatccctccatgtatatttcaaattgtttgaagaattttatgatggataaagttcatttctcagaatttaagggggatggagaagataagctcttcctctaggctgttgctactagggaagcagtagaagtattatgggggagggagggataaggagtgagtggaattgaactcactcagtaacaggttttgcaaagtgaggatggacctatgtcaggagtttggacgcaagacgggatatagacggaagatggcaggagggcttcaatgtctgatgagtttccttctgtttcacttatggacaatcagtaaattaaccaaatatcacaaaatgctgagtgtgtctgaaatttatacggaaaccagtaaaaaggtagacctctattacatggagcagaagcaagtcctctattactaagggcagaagcgagcagactgctataaatcaagaagtgaaacagagaaaagtacagaggaattagacatggaattcctggaaggcttttaattgtgctaggccctggaattgagatctgaaccaatattcattaaatcttattagtacagggaggtcagaggacatgcagataacatgtgcatatgcttctcaaagaaacaagctaaaatacagcactacaaagatcataaattactggctttgtagccagatgatgcatcagtttaaggcacagcacatttgactgttggagatttttcagaaagtgataatatgcaaataatatcatattagctaggacgttattttaaaaaccttgccagaatctaaacttcctttgtaggactatttctctgacatgagctcttcgttcttcttgggtatttttggagctccatgaactttgtagtttatcatgtgtcaagccagttggggaaagttcagccaccactgaacatgtgtatttcagtttccagaccaatagatttaaaaagtagaaagtatataaactcagccaaacctcaagtaaaaagcaactttcatttttgagcctttagatttggttgtttagaagtggtttctaaagtttattttactaagtaccccttcaagattttaagttttttgaatatatttttatttttctttatacacttttaacttagacattagtcttttcattgagttttaaggcctatgttgaaaagggggccacaaccaaagggagaaatatttgggaatgcttgcagcattggaagaccctcagcttccttcagaaaatatttgcctgtatatgtcattgaggagattataaaaacaagctgtctttttttcttgtccttgattgacccatagtaatattttatcaaaaaatgatagcaacagatgtcaaagatttatgtactgaaaatgtgatagattaacttacacaagtgcccagattttcaaaatcaatagaccttttagccacaacatcagtcccttcaatatgttggacttctgaaaacaaatggtttctcttaatgcacatctaatctgatttacttctatacattttaattagttttccaattataagaataatagactacatatcaaacaagcaaacacccagaaacaatagtttgactaatttgcttaaagataccaaaggtataatctgaatgattgatcgcccacatctgactccatctgcctgacttgacttagttatttgtgattctgttactaaaaattatcatggatgaaacaaatttatatcattaggcattatttgggaggatgctataaagaaaaaaagaatcttttttttctttttacaatatatgatgtgtcatcatttattttgtcatatttatgtttgtaataaccacatctctgccttgaaaacatggcactttagaaaagtatataattactttgatttgtatttatgttacccaaaataatctatacttttactaataatgcataatacatctgtaaccatacctctttgaggacaatatattttaaagattaaattataatttagaacctatattacagatatcttaagtctttcacaggaatgtgttgtaatacaacaaagaggataatgacatcttctatattgatagtaaattatgtttaataagtaattatttgaagatttattcataacgcagaaagatgattatatgtaacaaagtttgtatataagattaggaatacagagacctctattctagttttaattttactacatcttattcctgtaaacttcacaatctttacatttattatacctaaaagaatataataataactgccctttctcaaataaggttattgcgaagtcaaatgaaacaaaaaagacattcatatttgtaatataaaattcaaaacatggccgagcgtggtggcttacgcctgtagtcctggcactttgagaggctgaagtgggtggatcacctgaggtggggagttggagaccagcctggccaacatggtaaaaccccatctctactaaaacacaaaaattagctgggcgtggtggcacacgtctctaatcccagctactcgggaggctgaggcaggagaatcacttgaacctgggaggcagaggttgcagtgagcagagatcgcgcccttgcaccccagccagggttcctgagtgagactccatctcaaaagaaaaaaaaattaaaatgcatttcaaataaaagataaaatcaaggtacattttaacattaaattatgggataaaatataccatcttcttagttggactcaatatttttttgttattgtggttataatattttaaatgtctataatgtctataaggaaaactgtatataaaatcttggtataaaaatcttcatacttttgacacaaacagaagtaatgacataaatgaaaattcagacacttgagaacgatagtagaaatgtcttccttgtcctttgttaattacaatgtagatagatattttatgtatgtctcctagatgtttctttgctacattattattggacttaatgttcacgtcaacaaccttgtaagaaccatgtaattattatctatttatttatttatttatttttagacagggtctcactcccatcacctagactgggatgcagtgatgtcatctcagctcactgcagcctctacctccctgggcttaggtgatcctcctgcctcagcctcccaagtggctcattttcctggactcaggtaatcctcctgcctcggcctcccaaataactgggactacaggcacactccaccatgcccggctagttttttgtattttttgtagagatggggttttgccatgttgcccaggatagtctccaactcctgagctcaagggatcctcctgcctcagcctctcaaagtgctgggatttacaggcatgagccaccacacttggccaattatttctttttaagttgcctagagactcaggaatcatttctgagttttcatagtttaaggggaaaaattgccagagacttctttctaaaacattttattttttaatgtaaaaatcactaaatctttaaaacatgtaataagagaccttttcagacaagtagcataaatctacatttctgtccttccagctatattctttatgtagactatttactgttgataaattgaaatcaaaattacaatcagagatgtctaagataatataaaaatcaatattttaaaagcctctatattagactatgtctaacaccagaatattgccttaaagagttgaacgtatttggagtcttttaagattttttcccatgacaggtaattgtcagtatgtatccaatcttagttatgctttttactcaggataagcagctctttcaattcatttaaaaaatctgtgatgtaattaactctaagaaatgtaaagcctgtaaccatcatctaaataactggtttgacagatagatggtaatagtctttaacctttgcctgaaggctactgtattgtttaatactgtaatttgttagacatactaccaatgctttgatttggagattcgattcatccatttaatcttgggtcagggatttgaatcattgatttaatctttctgctttactctaaagttaatatatttactgaagatagaaccatagtgagaggcattcactctcactatgagagaaactcatgagagaaactcacagagaaactcacataaagtttcaataaatcgtgcttttctatttattgacttgtttcctcatactatttctgttataccaaattgaattaattgttttgaatactaaaattggtgagcataatctgtttagatatttaataactgttaaaactttgcagacacttaaaatatttcatgtgagaaaatttaaatgtgcttaatgtattatgccttaaattttggatctgctttgtaaaatggcactgatacattaaaatagaaatcttttaagggaatattttaatttcactccctggtaactatatgtgtatgtcaagaactgagaggctgaaattttagttaatttaatttatataacatattaatgattttatacaaacatgcacacatttcaagactttagtgtttagcattgaaagaaaaattgatcaatatttgttacctagcaataccctaattcttttcttactggtcttgttatttaaaaaaatagacttggtgagattattaactacatatattcggtcatattattcataatttaaggttagaataaatgctggtgacattttagcacaaggttggtttaataattttatgatgcaacatttaactaactccttagatatctgaatttttgctaaccaagcaacttctaagatgatatgtcatgggagagcttgagaatgcaagtcacttttaagaagtttaactggctgggcaaggtggctcatgcctgtaatcccagcactttgggaggctgaggcaggcagatcatgaggtcagtagttcgagaccagcctgaccaacatggtgaaaccccatctgtactaaaaatacaaaaattagctgggtatggtggtgcgtgcctgtaatcccagctactcagaaggctgagacaggagagtcacttgaacccaggaggcggaggttgcagtgagctgagatcacaccactgcactccatcctgggcaacagagcaagactctgtctccaaaaaaaaaaaaaaagtttaatttccagttgtacaacatccagctgagcctgtttcataaatgcacagatatatgaatacatactgcatatatggtatatatttattataccaataccatgtcataaccacattagcagatcttagaaattaaaagtaaaaaaaaaaggtagacttgatatgtgcaataatataaattaatttgctgattggtcttttctattagatagaatcttcaacagtagatgcattcactagtaattaacaatgtctctatttgagttagtttgaatggataatgtgagtatattttagactcagtggaatcttacaaaaaacacagctgtcctaaggtctcaaaggggacaactgaaactaaaaaatcaatatgtcatcagcaggtttgttgtaatagatgcttagcacagcaggtttgtataaactaatgacatactgtgcgatgacaagacagttagattaaaggactgcacaggcacagtcactggcctggagcagcagaggttgcaaatatgtacatgcagtatttttggagcggtggaatgtacatagtttataggtgcctatgctggatattgttttgaaaactgattttaaatataaatttacatcactttgactcatgtgtttaaaacttatattatgaaagagctgttaaagcttttaccttaaacaattgtattttcatgtgaactcaccaacaaccaatatacaggatatttgtttctttgttttttgagatagggtctcactgtgttgctcacgctgaagtgcagtggcgcaatctcagctcactgcagtctctactttgtgggctcaaaggatcctcacacctcagcctcccaagtagctgggactatgggcatgcaccaccatgcctggctaattttttcatttctttgtagagatggggtttgtcatgttggttaggcaggtcttgaactcctgagctcaagcagtccgcccacctcagcctcccaaagtgctaggattacaggtgtaagccaccaagcccagtcatccaggttttttaagaaggcaaaaactattccttaaacaatttacctagggataaaagagggggaaaatgtagagaagagctatcttccaaatgtctgaaaacaaacaaacaaaaaaaggtattagatttcagacatcaggtgatactctgcttcagaaacaatatattgggaaaaatcctgagttgcaaaactattaaaccagttaacacgtttaattataagaattgtctttcttgtctcattctaaagagaaatgtcatcacaaaacgataatcttatgaaagctttcaagtacaaggatttcataaaaagaatgaattctactcaacagtaaaatattttgcttgtactttgtgggaaccaaatatttttagaagattttttaagagcatctaatctgtatttttaaaatgccggtactggccttaatgtttattattctccagttctttacacagtgttcctacaccgtcaacatattatcacaacctggtttttgatttgttatcacaatcttgtgacctttaagcagaaatttatggtgtacatcaaagcagtaataaacacataaagaaattcttctacaaagaaacagtcactttactatttctgctgaacatgtgtttagagtttacatcttggttaccttgcactagcttccatggcagacaaagccgttgtttgtatgagagtgaactgcttacattctcgcatcaacactttccctcaaaagctgaagtttccctctgcttgcctcttctgtttagactgatggaaaatatttgctacttatcttcactacagaattgtcaatacagaagtctgtaaaaagtttcattaatttattcatccttttgaatcataggagtcttttaaaaaaatcggatatatttacagagtatctaatgtttgataagttagttatgagggtctcacatttttgtagcggttaggaagagacaatgtagttaaaagtcctctatgttagagtcaagaaacttgttcttgatgctttcactaagagactcatgattttggactaatctcaattttgagattacctataaaatgtggaaattcagatggatagttatgtcttaaatatttcacatcttttaggagaaacaagttgattgtatgagatttcatttacatctgtctgcatataaaatcgggtaaatttcttgggctttcactttttttataacaataaaatgaaaatgagcttattaatagattagaattaaaattcaaaactaatgcaattcaaagaaaatgtaccatgttaacaagtatttttgccaaaatggaatttctgctcataaagtggccatgacagtgacttaaaccctagatgttaggaaacgacctcttggatttatcacagtgcctcactcttagttcagactcttaaaaacatttcttgtgggaagtaatgactgctaagtaaaaatgaaagttgagcaatgattcttgtgaattatgagttaattaatggtatgactgcattttgttgaagtctcatgatttaaagatgtgctcattttttttgctcatgatttaaagatgtgctttgatactctgaaggaccaaagggcagtgaatcactgtaaagctgcttttgaaacatgccttagggcaaattgtgagccttcatttgtgtccagaatggaaggaacagcaagaagcatgggtgagtcataggacaaaaacacaaaatgtcattccaaagacagggtggtgaccttatgtctgagtatgcaaaaatccaactggggaagtaagaggcctgatcttaaaagttcatgtattaagggaaaacccatacttttatcttaggagattatgattatataattagttttgtttgataattcagatgagttacctctgattcagtttgaaagtatcccagatcaagcacagttcaaacacagacactcctgggactggttctgctttttgtgattggaataaggggtcctgctaaggtgtgtgcttctgtcctcagatttggaacagaatctaaattccatgtgtgacgtaacctgcttagtcacaagcaacattttcagacccctttcctttaattttagaaggaggctgttgatttggtataattatttgttaatgaatgcattttgtgttcattgctaagtataaaaaaagcacatataggatagcttgtggcgtattaacaaatgcttgagagataaaatataaaggtatataacagtaaaacatgaaagaagtcattcaaagcaatttacctaatgaaagagagagaacgtgtttcctcagagattcaggtgtatctcatggcatcctcttttgtatctttcaggtgtatttacctttagtttgttgttgttgttgttgttgttgttatataagagggtttaggtaaatgtcactttctgataggagcctcctcatcaggaccttttcttttttaaattttcatatgtctatttttatgtgaaaactgtccaaataaaatatttatatataaaagttttccacataactctaaaagggttctatttgatgtctttactgtattataggacttacaaaaagaaaagaaaaagaatatatccaattaaaacaagaaagaactcttgaacccagctatgcatacaagaaaaataaattgtttgaagtgagacatgaggtaatcgagactcctcaatggggaaagtcagtgctcatctggcccctagtgtgcctgttgagctgaaatattttattgatgtgagtgcttaacaaatcaccaaatgctcagtgaatacctattatgtgtcatgagctctatgaggtagctttttttcatacagtcgtattttggcaaataaataaataatacgaggcataattgacagtgaaaataccaaaaaaaaaaaaaaaaaaaaaaaaaaagcatcccttacaaattccagaatgtattttgaggtttcactcagcgctatacagtgatcacaaactccttgctatggtttagtctctaagaaaataaaaatgccagaaggtgtgttacatttcaggccaataaaacagacattattaacatctcattttattaattgaggttgagattttgtgtggaggcattttagtggtctgatccacacagtattgagtcagtggcattttgagaatgaggtgtagtgatttgtgctacatttatagtgaccaataagctgtgattgtagttcttttatatgctgatggtaaaatttgtacttcgtggatggacagtgaaggaacgtgggcacttcttgtgtgcgcaaatacttctatatgcaacatctttccttcacttgagatatttatgttttatttaaatataatacattcaaaatatttattattaaatcaacaacgttgcatgagtagtttattttgtgttttgtcccccaatagatgatacttgtatccatacgtggataaacctcctcagccttttatgacactcagcaagctttctctatcacaacaaattttatgtggcttgatattttccccctcacactgtcttcatattaatgcactgcctgtttagaggccctactaatgggttatctccataaggaacaatatgaatctaattctctaaccttacttcaactcattgctgctgctgctatgaagccaattgtaagcacagttaattgttcccatgattactaagacaaatatcacatgtaggagaggtttgattttccatattacaaaagataagctctgggagaattcagcattcagtttcctaatcacttacacatgtaaaatcacttacacccctccagtgatgccagaaattgttcattatttcttgtaagtattgtataaaactcagagtgcactcagaggaagtatcaattctgttttcttagaaactagtgttgctatgttagtgataaaaaacaaaatgacttcaccataaaacacattgcaaatttccatataacttacaggttattttcaggtatatgaaaatgacaaaaaaccagctaagagactataagtagaacaatatttgagattcatttggaagaataatcttattggtcttattgacttcttggttaaaatgattgaaaaactttacatgagagagagtgtgtgtgtgtgtgtgtgtgtgtgtgtgtgtgtgtgtgtgtgtgtttctttctccaggcaacaaaagtaacaggcatgaatttttttggtagaagatcattctttatcagaaacaacatcgtacatccttgcaattaaattaacttcagtagattatcatcagaattgtaattttataagaataattgtgatggaatatttgcaatgtaagagactcccttaaagggtatgatgaggtatttctttctgcgatccgatttacttctgtttttgtttttgttttttgagacagagtgtctctctgtcacccaggctggaatgcagtgatgtgatctcagctcactgcagccttcacctccaggatttaagcgattcttctgtctcagcctcctgagtagctgggactacaggcacctgtcagcacgcccggctaatttttgtgtttttagtagagatggggtttcaccatggtggccaggctgatctggaactcttgaactcaagtggtctgcctgccttgggctcccaaagtactgggattacaggcgtgagccaccactcccagcctgtgatttgcttttgggtaagattatggcgtatacatggagggaagtaaaagtgaacacatttcagttgcatttccccccaggcatagatattttgaaaaatttctgtaaattgtccaacatgtatttctaagataagcaaccactatgatttttaaacatagtgagaatcaccacagcatcaaattcattcattcatttaacagatacttagcactatgtgccagatactgagttagagactcagaatacatctttgaacagaacaagtacttgtactatagtgaatcttatattcttgtggaaggagacagataaaaaacactaaacatgatgaataaattattcactatcttaaacaatgataggtactgtggacaagaaaacacagagtaggttaatggtgttctgcaaggatggggaaagggcagactgtggtattaaatggtagtcagggttcgcctcctggagatgttgagatttgagcaaagatttgaatggaataagggacttaaccaaggggatatctgtgggaagagcattccagacagaggaaaaagccagagcaaaggcccaaaggtgtgatggagaatttctagcatattctgggaagaacgccagcagagtgagtgagagaatgagtagtaggagctaaagtaaaagaggaattgggttgaaaggcacatctcatttcgttggtaccgtgatgggtctcctataaagaagagaactggaaattctataaacgtcacagagaaaccttgtaagattgtttgctccatgtcaccctgaagaggtttggtcacttgttcaaactaattttaaataccacctaacctctgtggtttgcctcctgttatgcttattctatgttggtgttttacactaaaactttagttatatattacctcaacaaaagctaatatatcactaaatataagatattgaatatgatatgaaagctattaagctaaagcttaataagctaagtataagatactaaatatatagctgcaggctgtaacatagactctatagcataactcagggaaatgagtagctaaattccatgaataactgaatgcatggactgaagggagggtttcacagaatgttgtatgttagaatctgtgttccttcccctcccaattcttgtgcagcatcttgagaggacaatcaggtgcctacaaccttactacacccacatctctcttgccccttaccctgctgactgaaaagaatcacatgccccttttgtgaaggttatttcattcctcatgttctggaattcttcatcctttgtctctaaaagaactttgttccatcacttatttgtccctcttgtctacctccaggaagtcctgctcagatgcccatttccattttccattaatgtatgctcagacatctcccattgtttttctttattttttttttaataatccttcctaggttcaattttctagcagttgctgccttctcttgtttggtagcaagcactttggctgcatttctgtatctggtatttgtacatcctctcctcttcattggtttccaggcctctacaattggggttcttcaccactacctcaatgaagggacctctgcatcttcattgccacattagaatactttcaccccttatccgatttgattactgtgtaacatttgacatgggccactgttcttgaaaatactcttttctttagctttaattacagtattctttcacatcatttcctacctctataacaacttttttttctaatatttttgaattcatctttatgtatcttcttaaatatcagtgtctctaggatcacactccacattctgggcaatctcatcactgccaaggcttccatcactatctttatgctgtgatcttttccaggtgtatttctagtccctaattccctcctgaacccaatatttttatatgcaagaaaaatattgtattaggtgtactggacacctaattgaacatccacaagccataggcaccctcagacttaagatatctaacttggatccccactcactcctttcaccaaactcctttctcttccttgttttgtatccagtaaatgacagtcctgtatcccagtgcccaagctaacttcctctctcaccacccccatactttcaattactttgtcctttatagcttataatataaaactttccagattacctcagtgtcccagtgtcagtctttgtgaaattatattcattttttaattcttttttgtttgtttgttttttgagacggagttttgctcttattgcccaggctggagtgcagtggtgcaatctcggctcaccgcaacctccgcctcccaggttcaagcgattctcctgcctcagctttcccaagtagctgggattataggcatgcgccaccaagcccaattaattttgtatttttagtagagatggggtttctccgagtgggtcaggctggtctcaaactcccgacctcaggtgatccgcccacctcagccttccaaagtgctgggattacaggtgtgagccaccgcacccggcctcattttttttattctatgggacttgaaacaagtaagaaattcatgtaaatggaagaggctcaacttacaaagtgtaattaaatttaaatgaaggagataaattttaagttgtcaatacaaaactttaactgaaggtgtgagttgaagtgaagtaataaataagctcaccttgagtgggaattcatgatgtggaatcacctgggaggagttttgccttcttcagtcatattgcttccaactctagtgcatccattctcacacgtcagaaattatctcttccatttcaaaagttatactctgaaaaaaaaattaaaaatataaaatccttattacaatcaattttcttaccactgcataaccaaagactagatgagaaaatattgaattatatggtcactacaactgtgtccacatggacaagaaagggggaaaaccaggtgaatgtattttctttttttccatctttcaactgataagtatattttaaagaaatgtagataaaatactgtttgaagtatagtgaccactattgccaaatggcatgaaaacattaagatgagactacatgagggagtatggtaatttaaatcacacttgagattaatctttacagagattaattttttttttcactataaaggaaagtgtttctgctgaagttagagatcttcaggttacaaagagcttggcagttaaaggagaacgaggcaaagcattccaaatttgaagaattcagtaggcatgactaacaaatgttgtgtctcagaatagataataaattagggcacttgttaaaagtatgtggttgccactgtagaaaaagtgtgtagtgtgattaggagtgatgtatgcatgtttcctgtgatactgtgccttcaattttgtaattctatattatcaatgtgtactcatagtcttgctatgatcttttcccaagataactcttaattgctccagactttacaaggctgactcagaagcaaactgtagaatgtcagaaaagtaatctccaccacttatcgttaactagtgaccatctaacatgacagatggcgccctgcctgtcttcagcagcttgtgggacaaagctgaatgtcaacaccactgggatgtaattattggaatctcttgggtccagtttggcgtgaccctgaaagcaattccccgagaactgctgggagcaatgcagtgatggaaagagcagagaaaggagaggtttgggagaccagcagcattttcaatttactgacaagtgttttcacgctgcttaagaatacgtattttgcatgtgacaaatcagattgacaaattgaagaattcatgggactttcattgtggcctaatttaaatattatcaaagggctttattttataatgcagaggcaactatttaatgatttaagtaattttgaaaaatattttaatgatgagaaagcagtataatttatattttaattgtttcttaaataatttggtaacattctcattatttgggaacacactttgcaaatgttttactacaacttgtttaatctctaaaacaactcagtaaattagatactgttattagttccaattgatagatggggcgaatgaggcacagagaagttagctgtgacacaaaacaaatggtagagcatccagggctcaaaccaagccatctggtgccagagtctctgttcttaatcattgtgcttttccctgtgccatcttatatacctctttaaaacactcaacctgcctgtatagaagagtggcaccatactgaaatacttaagttaaatgcttaagtatgcaaatacttaatatacttaaataagtatatacttaaatacacttattatggagcttgatgctaaaccagataatataagaatatctaaaattctaaagttactaaaaatagattagaggaattattaatacagtagtccctttttatctgcaggggatgtgttccaaagacccccagcagatgcctgagaccgtgcatggtggcaaactcgatttccatcagtaggaatatttttctgttcacatcttccacccacaaatttaataccttctccgtgctaagtagttatcatgcacggtggccataagttttgcagtttgaggtgtgacagcaaaactagcacatttttttttttaacttccttcccagtttcaccgatagaagatgtgttcttactgtaggtcttagcaatctcagcatataatttttttttcttttcttattgtgaagtttcaccttttcacgtgtaagaagcacttacagcttctttttgtcatatccacattgcctgcatcactactcttgcactttggggccattattaagtaaagtacggattactagatcacaaacactgagatacttctgcagtcagtctgatcacccagaaggctgctaagtgagtaataggcgggtagtggatatgctcgacaaaagcatgtttccctagtgtgatggagttggatggagggggattttatgaccttactcagagcagcacataatttaaaacttgtaaattgtttatttttggaatttttcatttaattttttccgattgtgcttgactaagggcgactgaaaccttggaaagccaaactaccaacaaggagggactactccacattaattggttaatcataaatttctcccagaaatgtgtctttaagtaatatatatactgagtgcactgaaactagttttgatactaaaaaattaatatagcaaatggaagtaagcttctatatgccctttagtagggagaactttggaaatgtcacagtttttctgattttgaataatgcagacatagtcattatttcttttgtatgcagggacaagcatctaagaatcatgttgctggtatttgtcacgcaaccatccagttaaaaagacttgaacacttagtatgtacaatctaatttattcctcacctatgaggaaaaaacaacctatgaggaaggtgttttttttttttggttttgttttgtttcctgagacggagtcttgctccatcgcccaggctggagtacagtggcgtgatctctgctcactgcaagctccgcctcccaagttcaagcaattgtcctgtctcagcctcccgagtagctgggactacaggtacctgccaccacacctggcagctaatttttgtatttttactagagttggggtttcatcttgttggtcaggctggtctcgaactcctgacctcacgtgctccacctgcctcagcctctaaagtgctatttttttaaaacaccattttacagatgaagaaactaagagagaagagtaaataacttgctatgggcctgacgcgctggctcatgcctgtaatccctgcactttgggaggccgaggtgggtggattaactgaggtcaggagttcaagaccagcctggtcaacctggtgaaaccctgtctctactaaaaacacaaaaaattaaccaggtgtggtggtggacacctgtaattccaggtacttgggaggctgaggcaggagaatcgcttgaacctgggaggcggaggttgtagtgagccaagatcgtgccattgcactccagcctgggcaacaagagtgaaactccgtctcataaataaataaataaataaataaataaataaataacttgctatggtcttttaaataatgcattgaacatagaaaaggtcgtacccttgctgtaaaaacaattacttatcacatggatataattctgataatttctcaaaaccctgcctaacaaccagtatgcaaaggactttgaaagcctagaccatgtgagaaaagcacctaaggaattggaatgctgtaaacaccactgctaattgttatgatttatcttgttggggttgttaggagcagtcaattctaggagataagagcagttgagttcaggccctcaaggaatttacagtctaatggatgagataacttactgtgaaaagctccaaaaccattgattataagttgttagtataaacaaggagtacagtaaatgcctcaggccaggaacacttggggttttgggacaccttacacctttgtctccactccaaaaaagggctttgaggtgatcttgaaagaagagaaggtaagttgagttgcaagagggaggaagagctttcagcatgggaaaaacaggaacaacaacataactcctaatggtgcaaataaggctaggagaggccagagcacagtgaacatcctaactagagcttctacccttgcccctgtgcacaaactgttttccatgcaacaactggaagtcttctaaaaatggaaatgagagtatcactcccttgcataccacaattcaaagattttctcatttcacttaaaatcaaaaacgaaacactacaaaaggccctcctagaggtctgatgcatacgacaagtttgtgcagtgaggatagtgactttaataagtgacttaggccaagaggaatggcaatgaagagagcttcaactctgaaaatgcaatagggatggtggagactacggcttcctctaatgcactagatgttactcagttctccttgccccacatagaaatgggcctagtattgcctgatgatttgattcgtttaagagaatccagaaatccagatttttaggcaaagtctccacttaaaaattgactcaagtatctcatcgtcatcatcattgtcatcatcatcatcattgtcataaagatagtaataaagcactgtgcaaacaaactcgaaacatctgcaagacagatgtccagattagaaccacaggccactagtttatgacgtttgccctgcacagtctggctgtgcctgctctgcaaccagtttataccacacttttccctgctcaccacagtctcaccacagtggctctcttcaagttctccatttttccagctggtgcctactttgggccctgtacgctttttgctttttatgcctagagttgtttttggtccttccaactcttctgaactcagcttagcttttacttagttttgacccttcacctgccctttgttcccttcttccagtagttctcaaagcgtggtctggggatccctgaagcccccaggatctttcagggggtccacaaggtcaaaactagtttcacaacaaaagtaagatgtggctttcttttttttttttttttttttcactctcattctcatgaatgtatagtggagttttccaaaagctatgtgacaggtgaaattgcaatatactgaacacagaagcaatatgagaattcagcaatcttttttttttttttttttttttttgacagagtctcgctctgttgccaggctggagtgcagtagtgtgatcttggctcactgcaatttccacctcctgggttcaagcgattctcctgtctcagcttctcaagtagctgggactacaggtgcgcaccaccatgctgagctaatttttctatttttagtagagatgggtttcaccatattgaccaggatggtctggatctcttgacctcatgatccgcccccctcgacctcccaaagtgctgggattacaggcgtaagccaccacgcccggccgagaattcagcaatcttctattaaaacagacattaaagagatgtaatccttctaaatataacttctactcacccccctcttgggattacacctgtaatctcagcactttgggaggctgaggtggatggttcacctgaggtcaggagtttgagaccagcctggccaacatggtgaaaacttgtctctactaaaaatagaaaaaaactggctggacacggtggtgcgtgcctgtagtcccagctacttgggaggctgaggctggagaatggcttgaacctgggaggcggaggttgcagtgagccgagattgcgccactgcactccagcctgggtgacagagcgagactctgtctgaaaacaacaacaacaaaaggagattctgagaaaaacgtaaaatattgccactcttctcactaattttgtaaaaatacccttatttttataacattgcatacaaggccgtgaatatgaaactgatcatgcagtcaaattatcatgcagaaaaattaaaggtctctagacagggaagtaacaggattaaaatggtgtattaggttattttgtagtgaaaaaggaaatttttatatttatattactatgtaatgcattttatggttatttttaataaattaatacatatttaaggtttccctcaattttaatttctactatgataaataataaacatagaccaaaaaatagttctttgaggtactcaatttttaataatgcaaataggtcttgagaccgaaatttttgagaactgttgctttataaatacatatcaaacactaaaatgatctcacctattgtttactaaaatataagcaccatgagggcagagacttccaccttaagcatttatgcccagtgttccattattggaacgataagcaggtgggagttatttatatcctactgctcaaggtgatcgccaaggtctgataggaaaaattcaaaaatttgtctggcataaatgggttaatacccttcagcacctcgagcagtgtctgaagcacagtaggtactcagtatacattttagaataagcaaatcaataaattagcataatgtttgaatgggagttatatttagaaggatagggttgagctagctttataggaagctttacatacaaagccatgaatatgaaacagatcatgcagtcaaggcagaaaaattaaaggtctctaggcaaggaagtaacaggattaaaattgtgtattagaaagattattttgtactgaaggttagaggaaataaagttagtttttctttcttttcctgcatatctttaccaactctcctactcgctcccctcttgacttttttattgggcagaaggttttgaaaccttcgtgcatttcttacaactataaatacatatgtgctaatgaatgaggtcacatcaatttaaatggaacactgacagaaaacacaatttagctcattagtaaggcatgacaaatttacagccagaaactctgttgacttttatagaggaacgtaaattaaaggtggccaaatcttgttcagagggccagtattaaggtctaaactcagtcaggcaaaaatacacattcctttaaggcagtcctttcatataaagcagggaggtgtggcatctctggagcgatttgaagggctcaggggagttctttctccctcctagccagaaggcacaagtgtctaaactctacctctagagagactttctttaaagtgtctctttctgctgtgctcatttaaaatacaaatctcagagcaaaacgttaagaatgtgggctctggtgctaaacccccatgcttcattttggttcaatgttatataagctgcatgaccttgggcaaccaactgaatgtctctatgcgtcagtttaagcatttgtaaaataggtgttcctccagatttgatgtgagaattgagtaacacatgtaaaaatacttagaacatctctgatacgtggtacgccctgtctgtgttagtgtttgtcgttatggtagcataggaggctagtttcaaggaggattcgctttgcagctaaatggcagtgagaccccaattaagtcatttagcatgcccaaggtttgatttatctgtttaaaaagagaagcaaaatcttgctttagataaaagggagaaaatctgtttaacaaatggatgtgctgaatataaatgatgacttttttaaaaagtcagtatggttaatatgattcattggtggcatcagacaaggcatggaagagaaaggaacttttcagatggactttggacacatgagaagggtattgtcttcccactcaggtggggcaaggtaattgcagataggggaaagaaggccctgggtaatctgtttgcataatgactaggagtgctcatgtagcacacagtaagaagccgtgcagtggaaacataagatgagagaagttcagacagagcatggaggacagtggaccctaccaattataggcaagacttttaccctgagaaagagacagaaaaagagactgaacatttttgagcatgaagtttttgatcatctgttccataagaagataaactttggtaataaggcaaaggaagaattggtgagcagagaaagtaatgtctggaaaagtagccaggaagtagaagtacctgaagttggagttaaagtcaggaagattccagaatgagtaagagatttccataagacacccagccctttttggtttgaggaatgagggagtaagggttgagggtgatactgaggtctgaaccccagaaactagaaaaatgctgttaaacaaatagtgctctcaggaacaggagaaagaaaatctagcaatacaattttataattctaaacactgacaggaggaaaacatgttaatcaaaaagctattttaggtgcttatggctcttctgattcactttactcctgccacagtgcctggcatggagaatatcaataaatatgaattcctttcccattaaccctgaatggctctgttgtgagttctggaaaagcaaagaagaatgtaagaaacggaaatggggttgggtagacaaacatcacctactacacatttttacttcttctgtgagagttgttatgggctataaatattaaagggcacacagcaaatttgtatctttaacatttaagaaccaatctacgagcaaatagatttacacaccaagaaatccctgcttgtcttgtaatgagatgctgattttccttgctgctaacaaacacgttttcattaacatcttgctagctaattacagctaattatgaacattaaattcataagtgatcacttacaagcactgccaaatctgtgtgtgtggaagaggagtagggaggtattctagttcattcattccagcgactaaaaattgtgctgatttggaacaccaggattttaaataaatcgccacaatcctcattgtagttaaaattgtagttacccataatttattccattacaatatgtaaggcatattatgctcttaaatatatacctaatttaggtttttaggactagtaaataatctttgctgagatgtctaattttaagtatgcattttggtattataatgcagcatttcctttgaaaagaaaacctcgttatgcatttaatgtgggcaagtcctaatttacagataaattgttttctaaaatgtttttggttgtttgccccagttcctttcatgacacctggtatatcctcagtaatgggctgtataaccacacagtaatcagctgtggtttcctgcaatctgctacttgtggaatttctccagactataatccccctcctccccctaccccaaacaacaaattttggtatgaatttcatgaatatttttgcttatagagaaaggaaagtatatggtcatcctctggttacaaacatgattaaataatatattaataatcagcattgtattttggaatataagggaggggccgggtgcagtggctcacacctgtaatcccaaggctttgggaggctgaggcaggcggatcacttgaggtcaggagttcgagaccagcctggccaacatggtgaaactccatctctaccaaaaaatacaaaaattagtcaggtgtggtggctcatgtctacagtcccagttactcgggaggctgagacacaagaatcacttgaacctgggaggtggaggttgcagtgagctgagactgcatcgctgcactccagcctgggtgacagagtaagatcttgtctcagaaaaaaataatgaataaaaataaagtgaaataaaatataagggaaggatatatgaaggaaaggaatatattcttcatgctttctcaagtctgccattatttttgtcttcctgggagagagacatgcaccatactctattccagaagtcagcaatccctgcttacagacatattggcccactgacatgtgtagcttgatctacattgttaaaaacaaggaatttgttgtcaatacttttaaattgcaagatttcataatacaattaagtcatctggttttcttttaaaaattagaaaatctagcagcacaagatactacaatagctaaaaatggccatcctctttagacagagcatatgctttctggtttcaactgtctttgtcatgccctatcatttccctgatgttgagaccaagactcagttccaattgatcatcaatttgtagtctctcctggcttgcttgactcatttgcattacatattttgtctgtaaagattttgagtgtttccttctcatgactttttccacacagagaggttaatgtgtgtgtgtgtgtgtgtgtatgatttatacatatcgatatagaaagaaatgataaactttcacccagcattatatgataccactgtgtgccctgctgttcctccctgactttagtactatggcatgcaccctgcctgtactagcagtttccaaaatttcactgagcatctaggacaagacagggaaacacgaagaggtcaaaggactcagcattgaagaaaaaagaggacagagttaactttacaacatcactacttattagggatttccaaactgtaatattttgaaatattggcactttgctcagtatgtggggcccaatataaagaaatttgttaggccgagagtggtggctcatgcctgtaatcccactactttaggaagctgtggtaggaggatagctttaggtcaggagttctagaccagtctgggcagtatagcaagatcctgtctctaaaaaaaagttaaaaagaaaaaatagaagaaaagaaagaaatctattttatgtatacttcaacatagatattttctgtttgttttaaaaaggtatgttttgattattataaagtctttttctacaaccattaatcagaaaatattattatgaacacccataattgcatgttcaattggtaattttgttgtgtattttgtatatttaaacaaatgctgtccaaatagggattatcccaataggcagtgcaatcgaaactcttccctagaattctctctcacttttctctacctaaaacttgctcaactttcttgactcacaggctccattgtttccacaatttcagcctcgtattgctctctgtattttctgtacgcacatgtagtcagaaaatatgtccgtttttaagctatataggctcaacaacttaccttttatgggaagcttatattcttaattttttcatcagaaaaatcttatggcaaaatggcagtgcctgtaaatgcaaatgaaatgttctatatattttaaatgcccttatgttgaatgatttttttaaaattactattaagttgtaagaagctctgggaatgagctctctcaacaccaagttactatttgcttctttggaatgcatagacagctttcagtcaaaacaaacaccttctccagctattgtggcacctttctggagtgcagattataattatgcatagccgtcattacagatttcattgagaaatcatgccttaaccaagtgacacattacttcttttttttattttttatttatttattttttgccctgtcttatgctgctgagctacttcttaagaaaataaaaatgtgataattaaaagtaaaaattaccgtgttgaaagatttgattctagctctttcattaaactaggaaactcttaaagtatggtttttattgtgtaaatatttttttaatttgaatttttaccataatattatagaagacactggacccctcagaagatagtttgtcttttagtctcaggcctaagtggtaacatctagggatataatcttgacaaattacttaacttccctgagaatcagtttccttatatgcaaattaaatctgtgatttatataatagagttttatgcaaattaattgaaaacacatatctgaaaacactgttggatctttatcctgctctaataagacaagtcatatcattccaatatttacataaaggttatttaaacgatgcttatttaatactttatgcaaaacattgaattaggcactacaagtgatagacaaaagaagaaaactatggtacatcctcttaatatatttactgttgttaactataatgtaaggaattatcttctgaaagatcaaatgccacaaaataaatataaacaaaatattctggtcattgaagaaagaaaccaagaattctttcattagaatgttggtatttgatatgcattcttttttattttatttttttctgagatggagtctcgcccttttgtctagactggagtgcaatggcgcgatctctgctcactgtaaccccccctcccgggttcaagtgattctcctgtctcagcctcccgaatagctgatattacaggtgcccactaccacacccggctaatttttttttcttgcatttttagtagagacggggtttcgccatgttggccaggctgcttttgaactcctgacctcaagtgatccacctgccttggcctcccaaagtgctaggattacaggcgtgagccaccgcacccggacttgatatgcattcttaaagatggaaagatgattgagaaaggatattccagataaatgagacagtaaaaacagagacataaggatacaatgattggaatatattagtagaatagtaagtagtttaataggccagtaccatttaggggtgtcatggaggatatggctacagatgttagctaagtgttattaagtctaattgtatatttaatatacataggagtgaagctttaaaaaaaagtttctgtatctctgacagatacagaatcgttgagttttaaagaacaaggagattttagataccattttacttccatacatttatttctcagagctttaagtgacctttttaagaccacaaagctaactataaaggaggatttaaagaaactcattttagaaaaattaatactgcaccagagtgtatgtaaatgccacaaatgattaagattggttagtaaaaacatttaagaaatcatttcaagtgataaaacaaaccgtttaatatgtgatgtagggtaataagaaatgcaacaaaaaagatgtgaggagagctggaaaaacaatgagaggaagtgaaagatgttgaccagggtgtctgggaaaattaaggtaccttctgcaggagaaggcagacaaggcaaagagctgatctgaagttgaattagtaagttctggtcaacatatgcaaagttggagtgaaactttgaaaaatcaagaagaggtattgagtaggcatttgggaaaatgagaatttcatagctcaggagagatggagaatctagagtgatatgttaggaatcatctgcatctatgtgaatctatgggagtaagttgagttttatctaattgtcatattttggaagctcttgtaagagcctccttacaacacctttcttgtaaggtgttggtgaggggcttttgtttttctttatttttttcttctacattgtgtcctatttttcttaatatattttccctattactagctaatttaagattactttagtaacaacataataacccttgtgttaagttaaatattgaataaaaactctaaggaaagagatacattgtttttatcttctttattttacttttttatattttttattttttcataagttattgcggtacaggtgatatttggttatatgagtaaattctttagtggtgatttgcgagattctggtgcacccatcacctgagcattgtacactgcaccatacttgcagtcttttatccctcacccgctctcactcttccccccaagtccccaaagtccattgtctcattcttaacgcctttgcatcctcatagcttagctcccacatatcactaacagcatacaaagtttggttttccattcctgtgttacttcacttagaatagtagtctccagtctcatccaggttgctgccaatgctgttaattcattcgtttttatggctgagtagtagtctgtcatttatatatatgtgatatatatgtgatatacatgcgatatatatgtgatatacatgtgatatatgtgatatatatgtgatatacatgtgatatacatattatatatgtgatatatatgatatatatgtgatatatatgtaatatatgtgtgatatatatgtgatacatatatatgtgatacatatgtatgtgatatgtgatatatatatcacatatcacatatatatgtatcacatatatatcagatggaatactactatatatatgatggaatactactatatatatgatggaatactactatatatgtgatatatatatctgtgatatatatatcacatatatatgtgtgtgtatatatatgtgtgtatatatatatatgtgatatatatataccacagtttctttatctactcgttgattgacgagcatttgggttggttccccaattttgcaattgcgaattgtgctgctataagcatgcctgtgcaagtaccttttttctataacgaattcttttcctcctggtagatacccagtagtgggattgctggatcagatggtagtcctactttcagttctttaaggaatctctacactgttttccatagcggctgtactagtttgcattcttaccagtagtgtagaagtgttgcctgttcaccacatccacaccaacatctactgtttttttttttttttaatattttgattatggccattcttgcaggagtaaggtggtattccattgtggttttgatttgcatttccctgatcattagtgatgttgagctattttttttttttttttaagatggagtctcgctctgtcaccaggctggagtgcaatggcacgatcttggctcactgcaacctctgcctcccaggttcaagcaattctccagcttcagctgttccttttgctgtgcaaaaccctttagcttaattaagtcccaactatttatctttatttttattgaatttgctttttgggttctgggtcatgaaattcttgccttagtctagaagggttttccagtgttctcttttagaatttttatagtttcaggtcttaggtttaagtcattaatccatcttgagtagatttttgtataagaagagagatgaggatccagtttcattctcctccatgtggctagccaattatcccagcaccatttgttgaaaaggatgtcctttccccactttatgttttagtttgctatgttgaagatcagttgactgtaagtatttgggtttatttctgggttctctattctgttccagtggtctgtgtgcctattttataccagtaccacgctgttttggtgactatggccttatagtatagtttgaaatcaggtagagtgattcctcaagatttgttctttttgcttagtcttgctttggctatacaggctcttttttgattccatgtgaattttagaattgtgttttttctaattatgtgaagaatgatggtggtattttgatggggattgcattgaatttgtagattgcttttggtagtatggtcattttcacaatattgattctacccatccatgagcatgggatgtgtttccatttgttggtgttgtctgtgatttctttgagcagtgatttgtagttttccttgtagaggtcttttgactccttggttaggtatattcctaagtattttattgtttttttgcagctattgaaaaagtggttgagttcttggtttgattctctgcatggtcgctgttggtacacaagctactactgacttgtgtatcttagtcttgtatctggaaactttgctgaattcttttatcagttctaggagctttctggagtctttagggttttcaaggtaaatggtcctatcatcagcaaacagtgacagtatgacttcctctttacctatttggatgccctttatttctttctcttgtctgattgctctggctaggacttccagtactatgttgaagaggagtggtaagagtgtgcattcttgtctctttccatttcttagatggcatggtttcagcttttccccattcagtgttatgttggctgtgggtttgtcataaatgacttttattatattgaggtaggtaccttgtatgtcgattttgctgagagttttaatcataaagggatgctggattttgtcaaatgctttttctgcatctgttgagatgatcgtgtgattttggttttaaaatctgtttatgtgatgtatcacatttattgacttgcatatgttaaaccagacttgcatgtgttaaatcatctgagatgcattgtttaattcaacactgtattcttagagcctagtacaatggttggtgaagaatacttacgcaaaaatattctttgaaataacaaatgttgcaatttaaatcatagttgcattctataacctttgagatcagtcttctaaaggctttaaatgtttaaattcatagctatttaatttgtgtgaacagtgctcagttttgttttaaatctaccttgttatatgtttgacttgacatattgccacaaataacctcttattaaatgtgatttagatatacaatgaagtaacttctaaaatttggacattttatggactatttaaaggaaggtctagaatattgaaaaccatggcaagcaaatatgtaatatcatgctattaagtggcaaatttaactgaaacatattatatattataaataactgaatcattttgtaatatatatagtaagttttcagaactagttgatctagaagctgttgccctgtgaaaatactctatatgtataaaaaatatgtatttcttttcaataatagataaactgatgctttaggaataattcttaataatcgaagtttttctgaacaggggagaaaacatttttttcatgcgttttatactgaaagtctgccctgtagtgctgttgtgagggaacaggatggcaaaggaatgttcatattggtatgttctcattttctcatgtttgatcaactggataaaggcctttgttaattaagtgaaaatccatattatttctttcaatatgcctttgatttaaagtcacacataaactatgtcaacattactggcactcaataaacaaacatgagttaaagaagaattgttgaaagtatgcttcgaaggtaactacagaagaaaagcactcaccaagcagtaggtctccccaaacagaatttttcaaaccccacacctgtctttatggtatcctatgaaaaggacctcatgagcaaacagatgtttgtgtgggtggcctcgtcttcgctgttcatgccttttgattgaatgcacttatccgttctgtttctgtcactgctagaagagtaatgaccatgggcccttgaccttggcagtttgggatctcaaacctcaactctgaatttttacccattaagcttagatcttgctctctgattgagatcactttaactctatcaaatggaaacaggataatgtctctgtaatactcagcttggtgagcagagctcaggctatagtttttactatgttaagtcagttttctctaccacattgccgctgtgttttaaggggtgcagttggatctattgtatgtccagagccacatgttaatggaaatatgatggtgctgcactgtgaaaggagacatgatagacatggtaatgtgtcttgaggaagaaataaaagtatcatcaaaatattaaggcagaaattcaaaaatagttggccattaggagaaggtttataatcttttattaaaaatatttttatgattataaatttataccattaaaccatggtcatagtttacttatagtcataggtatagtttactttaatcataaaaactaaccaatagttcatttattcttggaaatagtattattgctgaataagtaggataaaaacactagtctatacgtatttgctaagcatacatattactaaaaggattattttagaagaactaagatatttgaataaaagctaagtggtcgttctatagtcttttatattttatgcctattattaattagaatattgtttcccaagtttaaatgagtttatagcacacagatgagacatttttgaaacccgattattttaaaaaaaaaaatagtgtctagcagacttacaaagggactcctaaaccaaaacacatgtgaaaggtgttagagattgctaaatttcagttcagttcagaaacattttctgtgccagccagccagccagccactgagctgtcatcaccaaataaggcctcgtggcttgcctcagagaggagcttaccatgcagtggactcaaaagacagctaaatggaggctgtcagcagactgtggcaacaggagggtgctaagtttgaaaatgtgtgccgccaaactattgttaatatagaatacacatacagaaatcagctaaactttgcgtttgacttaaatcttttctttttgttttcaacatatggaattcagtttatgcagttgtctcgaagtgattaagagaactagttgctgtcctgacttagagaggctcttctgagcatttgtgagcttactggatcacctgacacttggtagaaatctttaggatgaacttgaaaatgatagagcagaacaggtatcctctctagggagctcatcgggtactttttcaatacaaccacaagctgtaagacaggcataacaaaacttgataatatacttgttctaaacagaaggaaatgatttctacatctaaaggcattaaggaaaacaaaaagttatataaatatgtatgtatgcataaacatataactaggataaaccattacagtggctcatctctataggaaaaataaatatgcttctttgcacctacacacacacaaacacacatacacacacacaccgttcttttttttcttgagttttcaccactttatttttttttggatttatggtctaagaactaaggtatgatgaatgcctgtttcacgagggagtttcaaaggtttcaaacgataggaaaagatcaaggaaagaaaagaaaagcctgaaaagttgaaaactcttgtaaagtctgagtgttataataaagaggacaaatgatgcacctctaaccgaggggcccaaactttatcctttttaagataccattctgttctacacatcttgggttcagttattcatatggagaattacctcgaattcatacttgctctatttaaagtgggaactagtctgggccaaagtacatttgctgtaattaaacactccaaggtcacaaaggaggatgtgaaaagcatggcctctaatatgtatgcattttgaatgactcaacctgatataactcaagctttttgtttctgtttatcttaggtattttaaaaatagccttttcattttgtgcactctcatttgagcatgtgtgatttgtaaacacacaaaactaatgcctattatttatttaataatttcctcatctttaaaaataggaactggaattcctcctcaaaatgtctgtggttttacaaatttacaacctaaaactctaatctcaaactatcttaagagcagtactctagcttattgtaaattattcacagtttttttcagtttggaatatatctggacatctgtataactaaacattttcctctgggatctggtatctggtcatcagttaaaccaaatggaagccatacaggcaaacatatttggtctgtcatgatgtatatcagtgcttctcaaacctgcttgaacctcagtatcatacgggagattttttaaagtatgcattttgagccgcacccaaagaaactgtgatctagtagtttagagtacctgtttttgtaaaactcacctgaaagccttcctccttatacaaataactaggagtataagccatcttggatagcaaatacctaatatttattttcaatatgtcaatgctagaagtgtgattgagtcttttagacacataaaaatattaaggtaaattttaagccatatcataacataacaggattccccatattataatctgatatctgaatattatagaagttttggtatggaaaaaaaaggtctatttgaatgagttttccactttatgaacatagaatatatttgcctatatttagaaacatcacatacaataacaaaacattaataagcatgacatgcaactaagacactgtaagtctttttagcaaaattttgagctagtaaaaattcttggtttgtttagttagcaaagaatatttagctcttttacaaattcttcataccaattctaacttgtaactaatatgatcaaactattttccccaatattactctccttttatcaagggtctagagaaatgaaatagctgactgtgctacctagaaaataagttttgatcgatttaaatgcttataaagatattctattaattttttacaaagtatttttgaatggggagagacccctttgtagcactttatggctactaattaaaacaaaatcctgataagcaattttcaaaaattaacatatctgaagcaaatattttgtctaatgataagcaattctgagatgtcctggctgaattagcagtgaatcatataatttatacattggattttgttttttctcgtttttgtaatttcttgcctttttaaaactttattttaactgctaaattcttacacagtattaatttggggaggtttaagaatatgtggcatatgagcacatcctgaaaattcaaatttccttcattaaagggcccgtgtcactgatgccaaaacctgcatgagagtgtttatgtgctcttcttgggaaaattgtgcaaatcatgaatttgaccctgttaaggaacacatatacacatataacaaggcaaataaaacacatttaattcgggaattaatgaaaggcaaaggtggaggtcatgagacacttttaaaaaatagatattggtgatgaaatttgtgaggttaggaccgtagtgactggtcctcccattatgcagtcgcatgtggttgttagaatgaaataagagggaggaagaagggaggaaggggaggatggggataatgttgattttcacttcaaggttaatcctgagaactgtaattttcattccaaatcatgggggaggcaaatggaatgtccatttaggatgatagcaccttgaatttcagccatacttggtggcacagggggcagaatctacccttgttctcccaagtcaggacctttaggcccagatttaagattaggtccagtttcttttcagcctagctcatcagcagcagagatgtttgtagtggatgagttttatctaggagcagaagtgttggtaagataatgaaataatgtttataacattttttttccagaaaagagtttatattcgcaaagctcatttgtttattaatcctttaaactccaagcctgaggtgtaaggattttttttttttttcagcataaattcctattccaacctagtttttttttttttttttttttccttaaccaatgcagaattgtgtacactttgaaaatctctggctgggctgtcaccatgatgttgaatgctgtgctgcatggcagtgccagcctttctctgcttgtgctaatcttcattcctaccgggttatcatttcgttagttcacagttatttcatattcatgttgcttttttgttcagatgtggatgtattattatatataagaagtggacgtggtttgcctgcctgctacatgtagaagagaatgaacagaaaacatcaaatgttctaaaatgtatcctcaaaggggtcatttaaaaaaattcagataatctgtcaaatccattgttatcctgatatctttacagaattggaagaacagtgaatttttacctgcatatttatggtgagcccttcaaaaaaataataaaaatttaaaaatactccaaaaaatttgataactatgtttaataaaaaattcctttgctaatgtgtgaaatactattaaaaacgatgttatctccttatatttaatagatgtgaccttttttaggaagcaagaaatacattcacaaaagctcatctttttcatgaattcatgattctgagactgctaactccttgccgagtctagttaaaacgtaacatgaatgattgagggacgttatttttttaaagagctgcatgttgaagtgaaatctaaacacaagcaaaaaagttaactccccagctcaaactagtgttaggagtgaatatttcaaagaaggcaaattattaaaattgtcatctccttttattgtcactactagttgccttgtgttttgtatcatgttgactccactagagtcatccagccttgagattcagaagagagattctgaactcagactgccagggagccagccctgattctgccgtgaatgtgggcacattattgaaacatttctgccctagtttcctcagattaggataaaataattttcatggggccagacgtagtggtttaccttgtaatcccagtgctgtgggaggccaaggcaggaggattgcttgaattcaagagttctagaccagcctgggcaacatagcgagacctgtctctatgaaaaatttaaaaattacccaggaatggtagtgctcacctgtagtcctggctactccagaggctgaattgggagttcaagactgcagtgagctatgatcatgtcactgcactccagcatgggaagcagagtgagacactgtctcaataataataaaatgacaataataataattttcatatgtggaatgaccatccattatagttttccaaggacagtccctgtttgtgccaattgtcctgaagtaattactgctagctttctcctttcactttaaaatatgttccattttggataataacttatagtcttttcatttacatagctattgtgaatgttaaatgagatgatccgtaatcatggaaagggcttagagaaatattgcttatgaatataagattattatattgtatattattctaatatcaataaaagaattgacaagggaaatccaaagagcatgcatgctttaaatagcatggccttccaagatagcttcaaaatgtctgttggcaaaaatctggttacatcttatctaatatctaaatacagaaacaatgttgttccatttgtggatccacattccaaaagtttcaaaccactatagtaatgaaatgcaaacatagaaaacaatgttattggtagaaataggtataaaagttgttcttggtctttcaggcaaatattttaggtgaacagtaagttaggtattagtcataagctaactggatttcgttgttggataaataccctctccataaagatgtaaaagagcccagatggccgctcattaatataatggatgcaggtcttgtacccaactgataggcaccggtatacctgtactaatattaaaatattggaaaaccccaggtgactctcacaataattacctcagccctacccaaaaaccttggtctcacccaggatctaacaactaagaagttcagttgtgagcccagtagtgaggctccagaactgagttctagtttaagactgtcgtctttctaatgggaggtatacctatgctgtttacctatgctgttaagcacctccacttggcaagagggagttgttgctttccaaagcatgctcagttaaaggaacagcgagcctccccttttcctgtaccttcatgagctgccatttagtgcaagttcatatggagtctgatctaaatgtctctgggcaaagaagaacaaatggagatccttgaaaaggctttttgtcattttctttgagagcatctttttggggtacatagagtcttccagatttatgagaatatttttatcaataaccttacctaaaacacataatgtatttttcagggtcattgtgatgtctcacttataaacatactatattaattagagcaaaataatttttacatttctcaatgacctgagttttatttatggagcttataacaataactttgtttctttttttttctgtgaaatgatgtccaaaatgaatctcctttttacattttttttatttttaatattcatgggtacatagcaggtgtgtatacacacacacacacacacacacacatatatatggggtacataagatattttgatacaggtatgcaatgtgtagttatcacatcaggataaatggggtatccattgtctcaaggattaatcctttttgttacagacagtccaattagtctcttttagttatttttaaatgtacaataaattattgttgactgtagttagcctgttgtgctatcgaatactccatcctatttattctaactgtatttttctgcccatcagccatctccacttcctctccaacccctcctgccactaccctcccagcttctggtgaccatcattctattgtctatctccctgagttcaattgcttttatttttagctcccataaatgagtgagaacacataagtttgtgtttctgtgcctggttaatttaagttgacataatatcttcccgtttcaaccatgttgtgcaaatgacaggatcgcattctttttaatggctgaatagttctccattgtgtatatgtaccacattttctttatctgtttgtctgtggatggacacttggattcctttcaaatcttggctgatgtgaataatgctgctgtatacatgggagtgcagatgactctttaacatactgatttcctttcttttgcatatgtacccagcaatgggattgctggatcttacggttgttctattgttagttttttgaggagcctccaagctgttctccatagtggctgtactaatttacattctcatcaatagtatggaaagattccctctccacatcctcgccagcattcgttagtgtctgttttttggataaaagccattttaactggggtgagataatatcttattgtagttttgatgatcagtgatgttgaacacctttatgtatatctgtttaccatttgtttgtcttcttttgaaaaatgtctattcagtccaggcacggtggctcatgcctgtaatcccagcactttgggaggccgaggcgggcggatcacgaggtcaggagatcgagaccatcctggctaacatggtgaaaccccgtctctaccaaaagtacaaaaaattggccaggcgtggtggtgggcacctgtagtcccagctactcgggaggctgaggcaggagaatggcatgaacccaggaggcggagcttgcagtgagccaagattgcgccactgcactctagcctgggcaacagtgtaagactctgtctcaaaaaaaaaaaaaaaaaaatgtctattcagctttgctcactttaaaattggattattaggtattttcctattgagttgtttgagctccttatatattctggtaattaatcctttattatgtgtatagtctgcaaatattttctcccattctgtgggttttctcttcactttgttgattgtttcctttgcgtgcagaaacttttaaacttgagatgatcccgtttttgcttagtgctcatggggtactactcaaaaaatccttgcctagaccagtgtcctgagagtttccctaatgttttattttagtagtttcatagtttgaatcttttcttttgaagagacaagtgaataacaagtgacaccggctactgtatcaaggggataaccatgcatttcaaactagtaacatgaataaggtcagggttgaagctgctacaagtagcagtaatgtgaaaagcagtgtatgagagagtgtcctgactctccatagggatttctgtcagatacctactgaggggatataataaaggggttcgtctgcttccaaccaaatgtgtccaagagtcttctagttccagagtggtgatgaaatgcctcatctgtggcaacactctgtcattgtttgcattagcagcctgagtaactctgtataagagtaacaagctcaggcatttagagaagatcaagggtttcagaagtgtggaaaaacaaaccaaaacaaacgtttttcatgatattctccttccatcatatttttatcatattaaaattaatatctttacttttatagtttctaatgtaaatacaactaaaattaacattgtcttctttcatgaaaatgtaccacattttaggcaggtatatttcaatttgtttttactagtagtggattatattcaactttttttttctttatcacttgacatcatttgtggccattttgtgctgtgactgcctatcgctgtctacgtgttatgataccattatccataaaaggcagtttttcccctcctgcttaatgatgccctctcagctgattctggcactcagttaggtcttgctcctttgaaaccatagttagtattgtcagtcatactctgtggtaggctaagtaatggccccatgaatgatgtgctcatcctaatctttagaaactatgaatgtctttttttttttttttttttttttttttaaagacaagagtcttgctctgtcacccagctggagcgcagtggcacgacctcggctcactgcaacctccgcttcccaggttcaagcaattctccttcctcagcctcctgagtagctgggattataggtgcctgccccacgcctggctaatttttgtatttttagtagagatggggtttcaccatgttggtcaggctggtctcgatctcctgaccttgtgatctacccaccatggcctccaaaagtgctgagtttacaggcatgagacaccgtgccaggccgaatgtcatcttacatggcaaaattgactttgcagatgtgaataaatttaagctcttgagatgggagaattatcctggattatctgggtgagccctaaatggaatcacaagtgtacttatcaagagagaggctgagaaactgacacagaagagaacgaaaagacaacatgaccacagagggagagatcggagggaggtggtctcaagccaagaaatgaatagaagctggaagaagcaagaaacagatccccaaagcctccagagggactgcagcccacctcaacttcagtgttaactgattttatactcctggtctctagaagtgtgagagaaaaaattttgtgttttaagtcaccacgcctgtagtaattagttacaacaatcacagaaaactaatatacactgattcagagattatgcatgcatcgatttaatactctttcttttagaaaatataattatcaacaaatgagcatagatacagaaaaagtacaaaaatcttcagtatgtatgacataccacactagttagcaaaagataccatacttgtctaactaccgtgcaggctgaaaaatatgtctagaccctttttgtcactccggtgaccgtctcctcccttctccctgaatataaccaccaggattacttctatgaccatagattacttttgcctttttttgaactttatgtaaatggaattgcatagtatatgttattttgtgtatgacttattttgcttaatgtcttgagagattcactggcatttttatatgtagaagtaattaattcttttttattgcattgtaagaaaaatgcaataatttatttacccagtcccctgttgatggacattcataccatttccgttttagaactatcatgaataagactgctgttaacattttacacacatcttttggtatataactagaaattgaattgtggggtcattggtatatatacattcaaattgagtagataaagccaaaccattttccaaaatggttatagaaatttatattccttccaaaagtatatgataattctagttgttctgtgtctttgataaatcttggaaataaacagctttcttttttaccattatttaaaaacaaagtttgagccggtcatgtaactatagagtagtgtatcatagttttcgtttatattctctggattatatttgaacacttttcagtttgttggtcatttaaatatcttgtaagacatttatttgaagcattgcccattttattttagtttgtatttttttaaattagtttctaggagtttgttacacattctcagtatgagccctttatagattatatgtgcttagaaatcttttctcattatttgtattgctttttcaccatataatggtagtgttatataaatgaatattctaaattgtaatgtattctaacaaatcattcttttctttatgatttgtacttctttgccctatttaagaaacatttggctatcacaagaccacaaagattgtctcctatttaattctccaagagttttgctgtataactttatacttaaacttctgatagacttgccttccagaaacaatatgccaatttatatttgcaccaaccaagaatatctgttactctgtaccctcacttatagtgtttattttctttctttttgatccttcagttatgaaaaggtgcatcattatctaatatattcattaatgcccgtctttaagaacatgtatttttatgcatatacatttgtatgcatgaaatagagataatgataaaagaaacttatagttgatcagtttaaaaacaaaatattaaggatttacaattaaggaaaagtattttgtcagcaatggtgattttctttttatgtagctgtctactcagcaaaagcatcggagttttactaatggccactgttgctaaaacttagtgttgctacttgttgggtttgaaattgtaggtggaaagctgtgtgtaaattatataaaatgaagtcaaagtatatattcttgtattctttttatgcagaacagtaaagaagattactgtagaagattaagcaattatccactcatggtagaattaggtagacatacttaaggctaaatttagaaacttagctgcaaaatgatgttttgtatgacattcaaaagctggattaaaaggcagtaaaatctcttgcgttaagaaacgtgttgctgtgaaacttgaggagggaaagggtgttgaagtgggtttataagagatcttatcatctctccatgttagagtctgcgttcgatttaaaagagggcatccaaagtgagaaaaagaatttttctatctaaattttataacaaaatcaccatgaataaaaccaccgtaaattgaaaaataaaacgaaaacatagactgagaagactagcttctataaaatacatagtttgcataaataatatgtaggaaagaaacactaaattaaaatgagatgaaagaatggagagaaagatgctctcaagaaaattttggactggactgttttgcttatgttttctaaaaatacttgctggagaaacagagtataaatcctttgaagaataaaaacatcaaaaactggaagagggatgggactaataattgttttatccttttataaagaaggctaactttattttttcaaatgttgctaggagaagaaatgtttagcagggtggaacatggggcaccatgacgtgaccttcagtgttattcaatgtccagcatatgtaggcatgaaggtggtcaagttatcgtctagtagatagtatttttccattgccagattttatttactgttttgtactagatagaggaggcaattatttactattgcactatttttgtaggtagaggactacaatcaagagagtatgtgactttcctaaggtcaaaaattagagcttgcagttcagttgtgagactaaaaggagggagcatagtcccagtcagaatctcaagggagacatgacttggaatagttttctctttattgtcctgaactttagttattggtgctgattttcattctgaatatctaattacagcaaactagacatactcaaattcagatgtagttaagtttacatgcttaaccattattcagaaattgcgtaactaactctgagacactagaattagttgcatgtatagcaaaggaaatatcaggaaagaaggagcagcatattatacgtaaaatctgaaagcattcaaagtttatgttggggtaggagttagaggtagttttagaaaatcttgaaatcagaaaagaccaatgctggaaacgatcttactgattatttagttcaaccccttcatttgcagatgctaaatttgaggctgaatgagatgatctgcctcagagtaaaaagctgattgtatgaacaaggttgttgttgtgccccctctctgtctagcgtatgctttctacaatgacaccttgcttgtttgtagccccagtggctcttaacaccagttgccacagtcagccctatatagatttcttattactggaagatttgctgacaaattatattgtggattcattgtctgtcctaaatgcttcaaaagcaaaatgaggatgccaagcgagtttgttacgtttggaaaggggaaaaaaaaacctactcaatgccaatgttgtttaagtatgttcctctgtagctggcagagagtgccaacagtaattaccagtccataatacaataaatgtggaaaatgatagtgtatctttaggacatgtatagcaatttgacaaagtaatatctaccaaatctaatgttaagaaatttgggcttgtatttgcgtggctgaattaatgtttatttacctggaaatttactcttattgtatactacagtaacaaaacgaagacacagaaacacttcttcaccactgagcattcgagagtgatctataccattctttcatcaaatttgctctgtggtgagtgacaaatacccaaaatatggcagcactaaatgctgagatgaataatccattctctccttgtttctgtctccctcatccaaactgggtagaaaattgaaggtcttagccaggtcaacctaaacagttttctttgaacaggcacagccttccagtctctctaaactattctgaagtttcctgaaataaataataaattttgtccagcacactcagacttgtggggtaaattagtctgaggttgtatctaaagtgtgtaagaatggacatgtactcagtatacaaaaggagtactggagggaggtgttaccgtggaaagaactttagagttcagctttctggagttctaatcctggctctgctgctcttcagctataattgatcaacacatacttaactcctcttaagtgtagtttctttatgtataagatatgaaatacagtgtatgcacgtcatagtgctgttgcaaagtttaaatgtatgtaattacaattagttatcttggcaccagtaaaatagtgtattattaaataaaggtgagccattttcgtcatttctcacaggagaatcaggacagtctttatatagatagtagtatcaattaagccttaaaaacatggaaaaggggctgggcacggtggctcacacctgtaatctcagcactttgggaggctgatatggaaggattacttgaggccaagagttctagaccagctgagcaaataaacaaaaattggccaggcatggtgttgtgtgcccgtagtcctaggtactcaggaggctgaggcgggatgatcccctgagcccaggagttagaggttacagtgaactgtgatcgtgcaactgcattccagcctgggtgacagagtgagaccttgtctcaaaaacaaacaaacatacaaacaacgaaaagttagcaaagcaaaaaaggcacagcagactagtatgaatatggctgagaagcatgacatagcatgatgttttccaaacaatacagatagctctattgtaggtgcataaagatcaaggaaaaaataccaggcatcaggctgaggaggtagcaagggtcaggtcatgaagggctgtgtttaacatatttgtaggcatgaaattttccctttagatgagacatttttctcctaggcacatagactacccttatgggatacttgaatgaatttcagaatatcagtgacaccctgaatttgcatgaaatattttatgactatgacctatatgaaatttttgagaaaaagaaagtccattgcatttgctactttcttaaagtaggcatgacttctcagaactattggttaaaaaacaggaagtcattgaattgatttcaaatgggacagagtgaaaatgtgtgaaagcatggtcatgtttagtgtttgggtggtaaattaattcagatagaagcacgaagctgatgtgagaattccacatgccttgtagggtagggtcctagtcattgtactcccagcacacagactgcccctagtgcccatggttttccaccattcaataaatatttgaacaaagaaggaaactaaagacaggaagagcaagtagaaggctcatgccattttccatcagagatgactagaattgatatgtgtctagaattgagtgataatagaaatggagagaaaatgacagatatgagagacattttagaggtaaaatcagcaaggctcagcagctgattggtaggctgggagggaggaatggagcatgattttattgtttgtaggttgaatatggatgctggtgccattcgctgcttgtctttacaggcatttatcatatactgccttgtattctagtgttgtgagtatgctgtctctctccttgaagatggttttatttttaaaaagtcttaataccctccatagcagttggcttactgatgtccacctaagaagtactcaggaaatgcacgtttcaaaaaaagtgaaagatgacacagagggtgtgatcaacttcccagtatctacagaaatgtttaccttttgtctcccatttccaaatttcctgtcagttttagcctcacaatagttttcagtctgcgtgagggaacagtagggttctgggaacttttcttagattgagtaaaaagctgagccatgtggctaccctttgtaaacagtggagggggagaggtcgtatcaacagggttggggaggccctgctggagattcaacaagagcggtttctcactgatgagttcacacttctggattctgctttcatttggaaaattctcctcaagcggcgagatcatgaaccccctgacaaaggaaagacatttcacaaagatacaaagatttagaaggacacttccatggtgcttgtgttacacaccttgaaaactactgcagcaatgtgctaactccttagcacatttcatgcattttctcaaaaagacatggttcattgatggtcgagtttgcactgacagagtagaaaggtgatgtattgtgttggaaagggcagtagttctagagccagaaacacatcattttaattttctcccactggccatttttacttgtgtgaccttgagaaagatagatctgacctctctgaggaatattattattattccttaaatatgagaataatgatcacagtcaatattttctgagcaatgtaatgtacctggaactgctctgctttaatttattaatttactttatcttaattaggaacccatgagattgataatatcattacccccattttacaagtaagtaaactgaggttccaaggaattaagtaactttgctagatgataaaacaagtaagtgtcaagctcagggcccacactctgaaccactgtataccaggtaggactgtaatgaggataaatgttaatttatgtaaaatcttagaaaatattattggacaaatgtttgattcaatataatcattagtaatattaatatgacaattggtcagataggttttgctgggagaactgttggatctcagtttatagcataacactggcactgtccaatacgtttatttttaataagcaacttacatatttcgtatgtgcattaaaatttgaagactgcagctatactcatgaaaagtgatggagaccaagtgcctcagctgagcatattctcatcctccatggggacaggagagtgtggacactggcacttaaattcaaaatgtgggaaaggtacccatgattcatctgcagtattcttatatatttaatggagaaaataataaaacttggttaataacatttttgtagagagtaaatgaggtagtgcttgtaaactcttcttagacactttataggtactttgtatgttctcagtaggaattaggtagtgtgtggtaacttaaattaggcagactgggtaaagagtaagaaaacttttcctctcatttacttttgtgttgtaataaaaattatttttcttagaatcttgagatatcataatggtttttattggtgcactcattatatttcaatacaaattaatattaattcaatagatttttatttagcaggattaatttagaaaataactctggagtaatgccctaaagctagtgtacaattatcctgtttaaaattgaaactcttgtctttgcatggctagactaccagttgtgagtgatagctattatgctccaggtgtttcacacttactttctcattcaattagcacaatggtcccatgagataggtatttttttcttcatgcatgtgggaacacttaggcactaataatttaagtaagttgcctaaagccacacagctagtcagatgcagtgccaagattttagaatagatttgtcttcaaaagccagactttgttccaggaaaatgcattaagctaaaaaaaacaacacaaagaaaaagagtctcattttaatttttaatttgtgctttaattgatagataatacatagagtacatgtgatattttgtcacatgcatagaatgtgtaatgatagagtcaggttatttggaatatccattatcttgagtacttatcatttgaatgtgttggaaacgattcaggtcctctcttctagctactttgaaatatgtaatacattgttgttaactacagtcatcctactcttctatagagcattagaacttattacttctatctaactctatgtttgtatccattaaccaacttctctttatctgcacccccacccacacgcccctcctaacctctaatttcatgttttaggctaaattgatttttggactggaaatgtactaacttgaattaattttacacctggatgtgaaaatataattttgttcttttcatattcattgtcgatgaagtaacaaagcttgcagagttttaaaattagggaatacagtttatatgtctctgatgaaaagaaacagaaagacagattctgcactagaaccctgtttatttgctcttctgattgtatggcataatgtggcttgtttgacttaatcttgtaaagttacttaaattgtttaatgttcagtccctcaaataacaccaccccagctatctataactcattttgcctagtaaaatgtgttgctttttgagattcaggaatgaaaatgtctgtaagtcagtgaagtgaagcttccctctgcattaaaaaggtgaccatgagctgttaatacttaggtcaaactggatttctcatggtttctcatttcctcttttaagtgcgccttatttccaccaaaagattttactgaaaattaaaaagaaagtcatggctaatgtttgtctcaatggggtagcagcattttgtaaaataaataaactttgagtctcatattctgctattcttcttgaagtacatgcaagaatgataaatattatgtttccagagcaaaaacagcaaagtgcaacactgatctcttttgaaagcttgagtgatgccatctccaaataccatcacgtgaaatttggaaacaaatggtttcgcagtctagcacaaaggaaagagaaatgtcttggatatacattgaaaagccattgtgtatatgataagtcttgggctttcaaagctgcaggaaacatggttgcatcctttgtgcttctcttgaaaagaattaaagggtggctctattactatgtagaagcccactcccaaggactgtttaaatctctgctccagccgctgagcactgcagagtcactgaccttgtattttagacagtgtcagagggagagagacaagaaaaaaggagaaaagggagcttctgcgtagaatgactgacaaatgtgtttaaagttaaatgaacatgtcttcactgtcctctgcagttctgcagacttgtttttttgttttgaagccaaatgtagtaacttggctaaacaatgagtcacattgaaataaataatatttagataaagtagctgtctttttaggaaaacatctccccatctctttgttcataaagtctgggcctttaaatttgaggttttatggtatatagtttataatatttttcctgtgttcaaaagaaaatgagtttaagaatgcatcaagtgaaagcatagttcaagaatttttgctggtggggagagctgagtttttaaatatcaaatagtttgtcttactgaaagctgtgggtggtcctccatcattctgaaggaatctagagatggggattttttgccaacatatagctgttttccagttagatgctgatgtttctgtcattgcctagttcagcattttattaggtgcagtgcagctagactcctgtataagaatatatgtaaattacagtggtctgcaaggaaagtttgcatagcctgattcttgatcaaagggtaattacagtccttttaactgacagggcattgaaatgagcccccaggattatgagaatatgtataagttgcatttttgtcaagacttttttctacatttatttattactatgcaggcacacaatagtttaagaatacaaaatatttttattctgctttactcacttaatattgtatcatgaagcaatcttgctctcaagaactcttcattaagcagaattatctttctagcaaacttgtatgtgatcatggcgggtacttgctcggatttgtttcattggcatctgaagtgacttgggaaaaattcaacccctatggtttgacagtcaagaaatttggatctttctgtgttggttggctccttgtttctgctgagaaaaccccactccattccgcttcttgatcaaccctgagacttctaatcatcctttgaatctcccacctgagggtttctacgcaaactttttctactccctggaaaatgcttatttctttattagctcaactttatccttcaggtcaaagtttacatgattgtttccacagccatgatgtaaagcccttgtcttaaacacttaccctcccttttactatactttgtgcatttattactgtgattttagtataatattgagtggcttagttaatatttattgaatggagaaacaagatcaagtacttccttctgtctaatatttttctgttatttccaggaagacttaattcttcattctttaatgctcctcaatttttggagtcatctttttacactgcagttgctcgtgtacctccactttagactctcctgtttgaaagagagaccaaatttttgcatatttttacctagctcctggcatttaccatcgcgctctctctctctcgctctttttttttttttttttttttttttcctggagacaggtgctctgtcacctaggctggagtgcagtggtgcaatcacagctcgctgcagcttctacctcccatgctcaagtgatcctcctacctcagtctcctgagtagctgggactacaggtgcatgccaccaagcctgcagatttttgtattttttgtagagacatggtcttgccatgttgcccaggctagtctctaattcctggggtcaagtgattcacccgctattgcctcccataatgttcggattacaggcatgagctaccacacctggcctttttaccatctattgaatgaatgaataaatatatgtctcaaagaatatttctgttttgtatacagcctgctgtgttatgtataaacacaagcagtatgtcatagagagctgtgggctgtgttatgtataaacacaagcattgtgttatagagagctatgggctgtgttcagaactttatgagggtgagagggacaagagacttcactaagcacataggatctcctattcttgctataattaagtgtgctgactaaaagtacccactggaagcccacaatatggtcaagggagttttattgaaagcatccaaatccagcaaatagtataaattttgtgaaagactagtgttaaatgttgctttaagactctttccatatgtggttccagtgtggtcacttaagggatgtgcttggggaatggcgtctattagattctcggtgttctggggttttgctgacatgatataccatgtcaggtcatcatccttccccaatgcacacacattggtctgaaatattgactgtctttatatttctgtcccaccatccaaggactttgctataaatgttttaaaatatatccctacaagtcttattgtttgtgaatgacctttaacacttgtttccatattgaatatagcctgcttttatgactttagcacatgagaaaatgttttccgtatcttaacatttttacacaaaaaaaatttttaatgacagtgtaatagtttatttagcagaggtacacttatttaccctgagctccagctgataccacatttctcttctgtgcccacttttttctctgtctgttgtcaggtatctgcttttgttttgttaaccatcctggaaccactgttcttgaacaccttgcctcaaagtaaagctttttcagaagtgccaagaggtctagaaagcaggtgtcagatgaagtgtttcctcctctacaagtttatctgccttgtttatatctcaagtggacactctgaaactgaggccttcctagaagtatgaatatcattgatactgatagctcatctgtgttgtccttatatagattagtgataagttcagattttattctactttttagaagtaagttactgccagttcagtctctcatgacatctgagatattccctaattgtgtattcttcctaccctgagatagaatccagacagtacttaccatacaaggaacaaaagattggccatgtcttccaagtgagcttagagaaagggaagtcagagtttagaattctctatttaattgaattacacaacacaagtaaaatatgttttttgtaggtgataaggtgtggctctgtgtccccactgaaatctcatctcagttgtaatcatcacgtgtcaagggagagaactggtgggaggtaattggatcatgggggcggttttgctcatgctattctcagtgagggggttctcaggaaagctgatggttttaagtgttgcactttcttgctctttctctttctcttgccaccatgtaagaggagctttgctttccctttgccattcaccatgattgtaagtttcctgaggcctccacagccatgtgaaactgtgagacaattaaacctcttgtatatgaattgcccagtcccaagtactatctttgtagcagtgtgaaaatggactaatatagtaggggaacaagatagccttgcttttggtttagcttcatttttctagaaaatacacagttgtattactgtggctatgtttctaagattggtttttacatagacccctttttcctacaagatgtatagtaatatgaaggattacattagctttacagatatcccacaacaatagataatatgtgtaagcagtgaaaaaggaattatttttatagacattttgttgctatacagaacattagagattattctggttccaaaatattctcattctttttttatattgtagatgcaggacctaaggggagtgctctggagggtggtgttggggtaaaccctgtaccagcaaaaggtgaaactaaaaatttaaccttggtctactatttccaaagccaagccttttgccttccccagccatacacaccctactttttaatagtgataaagtattaatatttcatgtaaaccatgattttctgaaatttgatggcattttttccatttgattggtttatgctcatatttttaattcaccatgattaaaaataataaaaatcaatatagcaaacaaaaaaatggtagaatgtgaatgaacaaagacctgtgtttcatgtttagagtcaatttccacttgaaaactgtacagaaacaaggtaggtttcagcaagtcatagtgtagtcccctaccccacaatccaggacattgtagaccatttcagatgaccttccaggcagccttcaagagaaaagaaaaccaaggagggaaaggagcaaatttatcagcgaacctgagacctgactttgtctaaaggatcgagaaagcttttatgagacagccctgtttaaattacatcaaaactattggtcacattataagtaggaattagaaaaaggcaggaagaattttataagcaagaggaacaacatgtacaaaggtcctgaggccaaaaaggagcaaggcaagtttgaagttttaaaaagaaggccagcagagcaagaacaaagaataggccaacagtgatgattaagatttgtggtaaggtaatctggaactagatcataggaggcctggagggccatgttaaccctttcctgtttgccccaataatccttgcagctgcagcatttaccccaaggtaactttgccacaaaatatctcgctttcattattattttcgcatcactctagtatatcgacttaggaaacaaaagacttattctatttatagtattctgtttttagtagtggtatttcaattcacaaaatacggtaattctcgattcctgaaaatgtcaaatcccagaaaacttagcattcctatgtgttaacatcttcttgaacagttgttggccaaagattgatttgattaatccgacgtttgtgaaatagatgattctgaagattcagatgattctgatgctagttctgtgtagaaataactgcaagaacagttttatattttatttcatagtgaaaatcagtcagacttgcttcagccccaaacagtgcgtttatgaaaaattaaaggagcactgacagcatgctccactttttgttctaaatgggaaagggttaaaattttgaaatttttactaaaactaatagaaaaccattcaaggtaattaagaggttgcttaaaagtagagcagccatataatttaacttccaaaacatgaatcttttgagaatgaaagagggcactagtgataattatgctggggaaatgggcacaatctggggctgtctggggcaaaccagggcgagaatcattgtttcaagacacctgtgcatttgcaaatcttccctctgatgcaatgcgtgggagatacattctgtgttcactgctgtctgtctgtttttgtttgtttgtttgtttgtttgtttgtttgtttttgagatggagtctccctctgttgctcagcttggaatgcagtggcatgatctctgctctctgcaatctccgcctcacaggttcaagcaattctcctgcctcagcctcccgagtagctgggattacagatgcctgccaccatgcccggctaatttttgtatttttggtagagatggggtttcaccatgttggccaggcttgtctcaaactcctgacctcaggtgatccacctgtctcagcctcccaaagtgctgggattacaggcgtgagccaccgcgcccagcactgctgtcattctttagctgggttccctgcgtatagttgtttcctcattccttctttaatccatttggcattttgcttccatttatcccatcatgcctgtcaaaaagcaaagaaaaggggaaccttctgtcttctacatgaagctgtgtctgtgcccttgatgaagctatgtctgataccattttcatgctgcctctcacaccttttttaatgctttagtgagaagagcatcactgagatgttgatagttctcgagttgtttagagtatggtatctactcgtccccgactggcaaagaaaatttgggaagctgaggcatttcttatactacatttgatactatgcagacccatgtccagagcaagaacatgaaagaaacccaactagtaactgtcgaagttgtcagtctgattagaaaagcaagaggtcatctgattgagttcacagattaaggactggctttgctttgaatcctgaaatcttgcctcttttagtctttactgtgtgatcttgggtagattgctcaaatttgctcaattttaattcctttgtgtgtgggactagagtaatattagaaccgaatgcaaagactttgaatggaaattgtgtgaactaagtttataaagcacctagaacacttgctgctactggtaagcccacaagtggctgctatttggggctattatttttgagcaaatatggttttaataacatgccctctggtctctattgtctttgttcacattaggaattagtagctgtagtttcagtccgctgaagtttcactgctctttatttttttttctaaacagacaggtgaaattcactttctaatccagtttcaaaacaataagcctcagggagaggatgggtcacttgagcccactctgcttaaaattcttctgagataagacattcaaaagaggaaattatcctgtcagtagcaatatctctgaagtaaaagatatcctacagatttactttgaaatctgtagatgtgcattctgcctgagatctgaggtttatgatgagaagaatgttttgatggactagccaaacagaataacagaatgttaggtaagcagtgaaatagtaattaggacatggtatcttcgttatttctatcctcttatttcagcaaagtgtctagcctgctgggataagggctcaataaatgtatattgaacaaattaataacacatcatgaattttaaattcatgagtagttactgcatatgcttctaatctagggactcctgggaattgattttcaatcaaggagtcttttacctatttttgaattttataaaaggctgaagacaatgtagtattctgaatgaatgagttaccctactgtgtagtttgacaggtatacaattggcactctgaattgtaggtatcacatccatggattcagccaaccactgatgagaaatattcagaaaaaaataaaaaataacaatactacagtaaaaataatacacattttaaaagcaatacagtataacaactatttacatagcattaacattgtattgggtattttatgtaatctggagatgatttaaagtatagggaggatgtgggtaggttatatgcaaatactctggccttttgaagcagagatttgagcatcctggattttgctatctgtagggtatcctggaaccaatcttccacagatgccaagggacaactataaaataaaaccctaaactctctaccttcctttatcaagttcacatttttgagtgcatgaatgagattcttcgtgacttagttaactcaaaaatattaagatcactgactggcttaacagagaacaaacgtttgttcttatatgaatagtaatagagtgttattgatggacataatatgttactgtattttgaactatattataattgctgtaacaatatattgactatacttaggtagctccagaagcttctgttggcagggcttagattttggggaaacctattgttcttccagctttggttaaattctcaaagcttcacagtggtttctattacaaagaaaagttcatgtagatacatgaattttaggtaagcatattgtgcagcaaattttaccccagggaacattggcatagaagacattacagtaattttccatcatggagctctacaataatgtagattgtagaaaacaaacatgcataattttttttaatgctgtttcctgggagattttcccaggggccaggagacctatgctgccctttgtggagccactgcattttctaatactacatactctcagccagagtcccttattcgttaattgagcatgtcctgagaaacaacacaaatagctgtacctcatatgcttcaaaaaggatgacatcattgtgaggttaaaggaatgacaatgccattctttgccttgtttagatgatggactagtaattgtaatgtttttctctcactgtagccaaatcattacatcagtcactttctataaccgtggccaattcactggatcattcatttacttaaattggatctatgtgaaaccaaatgatagattcttgggtcattctttttataaataaaattctcattgctttgagctcatctctatgttctaaaaaaaaaaaatggtcgtttctctccccaagtcgtatagttcaattatgactactaacagcaatttaaatagcattttaacaaaatagcctaggctttttacaacaagggcacttctgaagtaaatctccctggttaacagctgtcaactatcagtaagccataggtaattaaatttgaagatgctttatggctcggaaaactagataaaaatccctggaccagaaaggtcttaagttgatgtagctattgctccctgcagtatttgaattaatgcgatagattgacgattttcttttcttttctttctttcttttttttttagacagagtctcactctgtcaccccaggctggagtgcaatggcgtgatcttggctcactgcaacctccgcctcccaggttcaagtgattctcctgcctctgcaggagaattgaggctgtcctgccttagcctcctgagtagctgggattacatgcgtctgccaccatgcccagctaatttttgtatttttagtagagatggggtttcaccatgttggtcagtgtagtctcgatctcctgacctcgtgatccacctgcctctgcctcccaaagtgctgggattacaggcatgagccaccgtgccaggcctggattgacgattttctaatgaaacaggcaaggaggagaactgcaattgtttgcttgttacttgcacataaaatttagttgagcctattttcccagctaagatcacactcttggttttatttcagtacagattagaaaaagaaagggaaaagaaaaaaataatggtttggaaaaaacatcaaaactaaactttcttcatgatagaaagtgtgagaaagtcgtgatgggggtttgtggaccctcaaaagataatatcagttagtatttatttctacagcagaaaaagaaaacctcaattcaaggtgcctaaaaactgcaaggatttctttttatttcatataacagaatattccagtaataatggagttccggttaattcagtaactcaatgatttcttaaaagatccagatttttttctacatttctgcttgccattctcagcaaggaactttcttggtagatgcaattgctgcaatcatcatgtgctcacataccaatgtccagaggcagaaaaagaaatcacctcttcttttgtgtgtgccagtttttaagactcaataagcctttttcagtagccgtgcagaaggcctccctccagagttcactggctaaagttgttcatatggccgtatttaaaacactcactggctagaagaatggggccagtatggttgtcattgaacagccctgtcaaggtggaagaaaagaatagtatctaattagatagataatctacagtgtctcctcatgaaaggagcatatattgatcctctactgtgggctggtggaacatactttgagttcagtattattattgccaatgtatagatgaggaaattaaaacagaaatgagctagttttcccaaaataatatacttagtaagtgatgaaactgaaattcaactcagaactgtgacaccagttgagtactctcttcacaatgtcaaactgtttcctatacatcatgaatcaccttctggctccctttttgtttctaacaaccaagtcatctctatgctttgctttgctttgctttttagatatactcttccccagagagtgtatctactctcagaattccatataatcatccatgaaaataactgaacatctctacctgaagatttgctacttctaatgacaaaattaaattaattatctaattctacattcttgtggaacatttctgctttgatttgaatgtaatttaatctgtccatacctaagtactttctctaccaaatatatctccttttcagatctcccaaaagtagtaagggcatattcatttctcctatacttagcttacaatgttaaggggaatttacgccaatctttcctctacccctagccaaaacctacataaaatcattccaaattctttgttttaggcatttctcacatcaatttttcttttccattttagcatatcaggtgttcatcaatatactatctcaactactagaacaatgtcttttagtcttttcagcttatatactttaaaaattaccctgcatactcaaattattttccttaacaatgccttattttattattgtgttctcctgattaatttgagtagatgctacttgtaaaaaaattgaatatattaatattaactctaaattaggcattctagtcatttttatcctccctgcataagaaattgttctgactttgcttgctgaagattgatgtcttgccccaagttataataataggtaacccatgtaaccagcatcagtatagctccgggactcttttaaaaactttatgtatattaaacttgacaacagtttaaacttcacaacaacccaatgaggtagatgctattattatactgattttaaagataaggacactagagttcagagagataaaggcccttgccaagtacatctagaagtgaaatggtagagccagaatccagactccagtggttgaaccccagaggccatgaactcagttatattttactgcgctagtctgtgtatgtcactccacaattatttattaagaggtatttgttgaatgtgtattccagcagcccaagcaatatcttacccctggtgttttacagaagacttacacaaccatgaatcatagccctgagataaaagtaagcgttataaaacacctggattttagacagaatcaaggcagtctgtgtcctctccaacctttgagtgatacttgctttgattctatattctctcccatgttctcagctcttggatttttttctattagccctaacctctagtctggcatgggctgattttttcctgaaagacttccctctccccttacgtgctctcctcatgaaggaagctgtttcagtttttgggctgtggcaccacctgccagctgtgtcacctctctgtccatgattcctagggagactcagtaactggaaggttatcaggctgcaccatgctcagcacccaagccccctgtttccaaagacctttcacccaggcccttgttattaatgacctgtcttttgttcttgtatgctgtcatgatcttacattttaagattcttctgaaatatttttctaacctcttgattgttttttccaacataaaaaatcctgtattttactattgttgtatgaacagtaaatttgaggctataagattatgtcctaataattttagggatttagctccctaaattttaaaaagtaggaaaacatacatctattttatctaaattcatgtttttcttaaaaatcatgatccaaacttaataacagtaattagaatttattgaatactatctcttgtcactcatttcacgtatttatatgtgtcaattaaattgatttccatgggaactcttggcagaagttactattattgttgcattttacaaatgaggaaattaaagcacagagaggttaagtaacttgttcagtttcacaggaagtttggcaacagaacctggtttcattatcactctgcttcttccagggcattttcagattattggctgaaactacttgcaggatattatggcagacattctgaacaaatgtgcccagaaaataggttaaatttgtgacttctgtatcttctcatatgggctatggcccaagtactcatggaatatagtccatgacttcctataagaatttgtatcattttgatttcggtttaagtcaaactacagctctatcagaatttttagaaatgtgtttgtcattcaatgcctaaaaatctagaaacagttcatcatggaagcagtcatcccagaaagcagactctttcttagagtttgtcattcttcagattataatcaaaagaacaaataaatcctgaaccatttgaatagaaaagtctaaagttatgctccttgagaggagcattttgaccagagaatgtatcatgaatgtcacgatacgttgattgtcttcaaaggccagccatacaggcagttaggcaatgtggaagaagttaaatgagtgtgagtcactaacctctgaggatcctggaaatatgaacatttagatacctgaaaattcatatattttccttagatatatgaatagttatgctgctaaaaataacattgcctcctgaaaatacgtctactttcaagtaatttatagaaaaataagtcggactaattagaattacgttgggaagcaaggcaaatatttgtagtaggaaataacaatcctaaaatgatgaataaatagagtccaaaaataaaacattaatagaggataagaagacaatcacactgctgttggttttgttttctgttcaatctgctcactgtattttttttggtttatttattttaacttgttttgagctgatgatgtccagtaataaaacagagttgagattattgcaaacgtgactgattttgtaatcacatactattaccataaactttaacattgcacttagtggtttatgttttacttcagtacaaatataaattaaaatgcccattaacataacttttttttttgaggcagtgtctcgttctgttgccagagctggcgtgcagtagcatgatcatagctcactgtaacctcaatttcctaggctcaagagatcctcccacctcagcctccaaagtatctgggactaaagacacataccaccatgcccagttaattttctaaaacaatttttgttgagacaaggtctcactatgttgctcaggctggccttgaacccctggcttcaggtgaccatcatacctttgcctcccaaagtgctgagattacagggaactagcccataactctattttaaaattaatttcttactgtagaagaaaatgtaccttgacattttttggaatatttgcataatagtttttattaaaataatagaattatagaaccaggatactgtatctacacttgtgctgttcactctttcagaacttcgagaaaccaagacctctgaatacttcagcctttcccaccatcctttagactacaggattttattaatggatgaagatcaggaccggatatatgtgggaagcaaagatcacattctttccctgaatattaacaatataagtcaagaagctttgagtgtaagtttatcactttcacgaggacagtgtccaccttttcaatgtctcttttttaaaaaaaataaataagtaaaaaataatatgcattttattagaacaatagaaaatactggtcccatgttactatgaaagttagtacttatttcatggactgaaaaggtattaagttcagttctcatcgtctagttccatagtttttaacaattcaaaacctggagctaactgaaaaaatactacctgtgtataaatatataaagaaaaaagggattatagggtagtgcatgaaagaaatggtcagagaaaaggaagatctactttgtcatctctgtgtaaccagtgaagggcctgaaaggaaaacagctattaaatacgctgttacttgatccagtatggcctatatttatcattccatttcacaaggaaataaaattgagcttcactgtagtgaaaaaaatacatgtagattaattataaatttattacaacaaggagacttctgcatttgcagaagtgttaacacaggcaatggactgacaactaaaaaaaattaatgattattgccaaactggacccaaggctgcaactacttagagtactagcacagtatttcagagagagggaatctcttggttttcatccaagttattttagctattgaagtacccaggggcccatcttatgtaaatctactagcctggttgtgtgatttaccaaaaataatactaactgagaaagatatgtaagtgtagatttattgtcatataagcagttgggaaaagtgtactatgtcaaaaggagtgaaaaattgtattgttcacatttatgttaataatgatcttattttaatatacaattagtaaatgaacatatgttattgaaaagcatttgtgaaaggaaacactgttggaagaaataaaaataattgtaattgttaaaataatagaatctttattaatgaattgataaaaaagaaagaattttaaagtcttagtgtaagatcaccttaaataaatctgttaacaaaaagtaaatgaagagcactgggctgtcatatgtccaggtgagattatgcaacctttatttttctttctgagcaggttttctggccagcatctacaatcaaagttgaagaatgcaaaatggctggcaaagatcccacagtaagtgttaaaaaaaaaaaaaaaaaaaaaaacactaacttaaatatttggttttcgaatccatgtactttgagggaagccaaaaatgagacaaggatggtggtgttttaaatttttgctggacacaggctaaaaacctaaaccttgaggagactggaactcttgggctctctgtaacttcagaattcctaactgggtaaaaattgcttgccttgctttcattatttcattcagatacatttcatgatggatttcattaataacctctgttcctagtggattcaacctgcagaattctcagcaggctcctgaaacgatgataatgcaagtgtctggagcagctcccagataccctgtgggcttttccaaacaaagattcttggcaaaagggtagtggttagccagcaaattccataaatacaaatcaccagtgataaatggtacctttgttaattaaaaatagccacagaaacagcaatagaggcagatataagtatcaatatatgttcagtatgcaatacctgtgcaaattgtattcctctaggtgagattcaaaataatcaaggaagaaatctatattgatttctacaaatgacttgctgaaagtaatacattgccattcttgaatattctaaaacaaatacgtggagcagatctttaatgtgtacacgtcatttaatgtttataatggagcacataagtcatctcaccattttgcctcaaataatgaaaatgtaatacagccaagcatcaaaatcaccctgtctttcaaaaatagtttggtaaagaggttcctttcttcattcattccttccattatttgctcaataaatactgattcagcacctgttatatatctagcatggagctggttgccaaagacataattggtgcaaagacagaaacagttctgactccagtcaactttattaccttgttagaaaagtctgccataatcaaatgagcatagatatacaaactaatttagaaataagctggaaatatggtaattgggtggacagacgagtcaacacgtacacatacattcaggtctcaggtcataacaagtaatagaccaccttagtgttaaaaaatgttgtctaagcatttattttgtggtagggtcaagagatgctgatttcaggagtgaagactgccctgagtcttggaagtagagatggatcagacaagaccgaacatgggaaaaatactaatcctgtggaaagtggaaatatgggattgaggaaatgaaacatttattttcattgactcctaacagccccaggtgtaaagttgcaaaagtttttggctcaaggcagggccatggaagactctggagggtaggatctctggccttgctagagggttcttggagtgatttatccaataaaaaaatttaaaagtgggcaggagaaatttgcaggggcatatttgctatccaagggatctgttagaccacaatcttgggggaaaaaatccagaaaaatgtagaagaaacacttaaacaaatacattacaatgacattccaggaaaccaatggtagaatgaagtataatgttgcagagaatgatgttttgttccttattattttaataattgtggatgaattaaactgttttcttttattctctaatgagatttttttcccattgatgtgtgtctgatcatgccttgccttttgccacaataatatcccgtggctatactgaattgcattgtcctttgttcaaaaggatttgcatttctcattcatatgaactgccataggcagaatgtgcagaatttaggtacctttgtacattctatttccaaaaattgctgccgagtttctgaagaatcttagacaagtcatttggtttcttacttcctttgtcaaagtagaaaccctctggggtttttgttttgctttctgacaattaaacgttattagataaaaatcttcaatacatgctgacattttcccatagttttgtcatgctgtaatttgtggatattttaaattctactatatggccagttatacacaagggaaatatctaatggagtgctctttcctatgtatttttaggactcggctggacaggttttgtttgtccatacaacattgttgagtgctgggaaatactaatcaaaaaatacatgtttggtctgtgcaagaaaagaatgtctgacaaatccatcccatttcatacatgtgaaatacttatagaagtgtcctttacttaggctatgggaaaaaaaagtcctgtagcagaaaaataatgtgaaatagatctttgaaagttgtacagaacaacctatccttcttacatttctcaatgaaacgacatacttaagaacttcttaaaagttggaataaatactatctaataacctaatatttttaaaatacaggaattctttcaatttgcacaaattagttgttgtgaagaaactggaggtgaattagatggagtccttacatttaagtctttacaatgtgctagatatggtgagacatatatacactgatattcagaaaaaatacccaacatttaatggaacacgccaggtcctgttctaagtgctttattttaatcctcataacaatactgcaaggtggacattattgtcaccacctgtatttctaagataaaataactgcattactaagaaagtgagaaacttaagctgtgctgctgtgaagtgggatggtctttgtctgattaagtcacatacagctctggattctgtacccttagccactaaaacatgctatccctccagagagaaaatgataaatgctaagggacacacacaaagcacagctgggttatttaagaaaggtttgatagattttgtagtaatcatattagaacttctgttaaccttttatttcaatgatactgaaattcgaaaaagttgtaccctctctctcttccagcctttggtatgtgctgcatgcaattgattctcttttccttcaattatcttccggtgttttcagcctgggaaatatctactcaccccttcaggtcacagtgcatacaagcacgtgaactcgttccaactgattgtcagggcttgcgggtaggacacagtagatgatgagtttattaatgcttttagattaattatgtttgtagtgcatttattatatatatattttagaagtatattttcattaagctaaaactttctgcttttagctctgttaatcatctaagcaaaacataaagtgttagcaattaaaatccatactgctataacaactgaaagcaaaaataaaacagagttaagcatcccttaatccttcagattttttggttgtatcaaattttaattgacgttataacaagataacaattataagaagaaaatttaatgtgatttaaaatttggtcttaggtagtaatacagcataattctgtaataaactaacgtttttaaagaaaataaattttcatggtcggattttctgccttggctaaaaagaatataacctactccccatttctctctctgcccctatgtactcacattcctacatgctccatttatttctaaatgttaatattttattcatactctaaataaattgagcttaaacaatagcacatgctgtcaaacatatccatgaaatagggcttaatggatgtactatgtaaatactataggagacggttgaaaaattaagtaggattatatatatttagatatatatacattacatgcacatggtgtcaaacttgatttattaattgtagaatatcagtttccctatttctgtgaccatacaaccctaagctcctaaaaaatatattttctttttcaaaataccttgattcatttccctagatcaaggaggtatagaccaagaagaagaaagtatgaagtatttttgtgtcattgcagattatggaccataatgagtcaatatttttaaaggcctattcacctgtgctccaggatatattttttaaacatctatttttatattataaaagtaatatattttcaatacaacaatctttgaagacttagaaaagtacatagaaagcaacagaaaataaaccatctcttattagctcttcgaccttggagacttaaactttctgtacatcttggttttcttatctgtgaaatgtgctaatccgtagcacttaaccttattgggttgttaagaggattgatgagttaatatttgcagagagcttagagcagtgcatagtacacagttaatgctatatcgctgttaaagaaagtaaattgcactactgaaacataatcactcttaacaatttagggtatattcttccagggttttgttatatagacataaatgtgtataaaaatagaattttattatatgctgtataatgttagcagctttatatttcactaacattgtgccaggaaatcattttgaaagagaattaaacaatgaaaagaaagcatgcatcatatttatttccgctgaagtctctaaggcttcattcatactccaaactttttgtggatttttactgtggtcaggacctgcactaagctctatgcaggacagatgccctgaccatttcaccgggtttagagacaatgtcaattttaaaatgcaaataaaacaaatctaatattggacagttggatgtgtgtattattttccagatatgatttctactgctttattaatatattgtccatgacaagtattaccattgccattttaggaatgcaaagattgaagcatccagaggccaagtaactgtcttcagttctgaaagctagtaaaagatgaagccaaggtttaaacctaggtcatctggctctgagacctgcatacttaaatctactctgtcttctctgcaatattctctattgcctatctgaagactatggtaggatggcagaccaactgtaattacctctctgatttcatcacacagttatcctctaacccttctaggcactagtccccaagtaaatcctgcactctcatgtctgtgtttctgttcatgctgttttttttttatttttatttatttatttttatttatttatttttttttgctgaaatgttctttccttatgcttttgcctgtgaaaatctctaaattattctgcaagactcagctcaaatgtcacctctactcaaatctttacccctagatcagcattacttaatgcctttctttccttctacggtacatttaaaaatacagtcctattgcagtatctaccacagcctgatacattatgctctcctttctttaaaagcaggcattgattgagtctattcattccactgttgctagtaccatatgtagtgcctcgcatagaatgacttcagcacatatttgcaggatggaattgacactattgcagtagtctaggtcagaaacgaaggcagcacaatggaaatggaaagaacctggataatcattttcaatagttaactcagctgaattgtttttccttttgtggtcttgtgtgtggggaggggcagggagcacattgagcaacagatagtgtgggaatctgctcattgctaatcagaatcttatagaaaagctgcacagtggagagtggccatggttcaagtcccagtttagttacttattaaaactagaactctttatttaacctctctgggactcaaatttcctcatcactaaaatggagtattgataaattggagcactgttatgagaattaagcaatcgacatcaaaggattaagagctctgtgaatattaataaatgttacaaaaactaaaaagttatatcagtattaacttataaaaacaactgtgcatcctggctaacatgatgaaaccccgtctctactaaaaatacaaaaaattagccgggcgtggtggcacatgcctgtagtcccagctactcgggaggctgaggcaggagaatttcttgaacccgggaagcggaggttgcagtgagcagagatcgcaccactgcactccagcctgggtagcagagcgacactctgtcgcccacccccccaaaaaaaaacaactgtggacttctcgtccaatgacaaattataaagcagctaaaagtacaggattcaatgttagagacgtatgtgtttgtaaatctgctttagttactacctatatggtctcaaacaggttatttttttaaaaaactcaagtttatttttctaaaagggactgagttatggtaaaaacctgaatgaatatgtgtaaagtgcctaagtagcatacagtaagtgttaaataaatgtcagctataaaggtaaaaatcaaactttctagaggtaaaaataaaaggtaaaatatacaatatgattatttcacagtctaggatgtaataaactctaaataaatattagtcataataagcagatagatatatacatgaaatgagtatagttggcatttgaaatataaacgagatgttattgacttctttcattttaccaataccagtaattcatgaaagtacattgacatccataagacccaagatgagagagacataacctgttattaaaggaattggattgaattatttatatcttatggggaaatattgtatacagaatcccagaatgactaaacttgaatgtgaaaaaaatatgcatgtgtctcattcctcatagattccctttacatagacatattataaacacacatatctcatctgtgtgttttcttcagaaacatgttatcatctgtagttatgtaatcaatttccaggtacctctataaacaggtgtcaagataaaatgacactgtgtatttaacaaaaatccttaatgtcttaaaaataaagtgtatggtctggtctataaggattaatttctttgactagagttaatgattgattatttaataataaaaatctatcatagaaacatctgtataaaattactgcataaataaaagtatatatttgctggcaagtaataatgaatataaaaggaaaaaatgatggaaaatgtaaaataatattgactttaattttaacttctattttagcaacatttattttgttttagttttaaataatataaataatagatatggtttataaaaaaataggagaggccaggcatggtggctcacacctgtaatcccagcactttgggaggccgaggcgggtggttcatgaggtcaggagatcgagaccatcctggctaacacagtgaaaccccgtctctactaaaaatacaaaaaaaaattagctgggtatggtggcacatgcctgtaatcccagctacttgggaggctgaggcaggagaatcacttgaacccaggaggcagaggttgcagtgagctgagatcacgccacagcacaccagcctgggcaacagagcaagactctgtctctaaaaaaaaaaaaaaaaaaaaggagcatacatggtacctagcagggggaaaagcaacatatattttctgaccacccagggaaaaattactgttaacttttgatgtctttctttatagttttttataaaaatgctgtctctaatatacaatcattttattaatgttctttgagagaatgacttcatgaagtcattcaatctcaggcttgattgaattatagtcagcaaaggatagtgaagctagtaactgtggaacatttggtggttaatttggtcacagagatctgcatctagggctgactgtttctgtgctccagcaaggtcacagtcaattgagaattacaataattattctgtttcattgggtgaataaatgacagccttgcctttacttgaactgggagcaagtgagaaaggagtttctacaagagaagaaaggagtattttaggagatccagggcaaagagattgattatgtcattcctcatagaaggcaatcattatgctggcattttgttggagattagttttatttgccaattcttaaggtgaatagtgtctgccattgtgcactaatggtaatatggaacttgtataggcacaggtgcattcagaacatgtttgtataatgtgtgtgtgttcaatgttttaaggaaaacttaaggaaaaataacttctgtgtgttaatttgtaaactttctcaggtaaagaatacatttataaagtttcaggatgtaaaaatttagacagtgttgtaatacaagaataatgaaatatagcattttacttactatctgcggtggattatatttctcttgaaataaatcagtggaataagccatgttgttttaatatttctggaaacacgtcttttaacaataaaaaaatggagcagaaaggaaaatgtatagcaaagtattgccaaataatatttgcattgatatgtataaatttgagagcattttcaaatgaagtattagaattagtccagattaaaacagaaatagaaaaagcagggcatgtatgacaactctgttcaattgcattctacaagggtagagatttttgtgtttttctcagtaaggatgcccagagaatttgactataccctggcaaatagtaggtaatcagtaaatgtttgttgactgactgtttctgtaataatgttttgactattcctgagccactgtttttcttaatatttgatttgttacttctacaagttagataagtactctcaaattacctttaagaggtgcaaatatactaatagttccccaaagatatggcctaatacaaacttgtccaacctgtggcccaagggcctcatgcaacccaggacagctttgaatgtggcccagcacaaattcgtaaactttttaaaaacatgagatttttggggggatttttatttttatttttatttttttagctcatcagctattgttagtgttagcgtattttatgtgtggcccaagacaattcttcttccagtgtggcctagggaagccaaaagattggacgcccctggactaatacatcaaaagtttatgtcacctcattgttacttatcatacaagatctcaggttaacatagctaactgaaataacaatgaaagtcattgagttactaactgcttatttactgattcttttagcacggctgtgggaactttgtccgtgtaattcagactttcaatcgcacacatttgtatgtctgtgggagtggcgctttcagtcctgtctgtacttacttgaacagagggaggagatcagaggtaagtataactatttaacattcttagttttgatattagtgtcaaggatttttgaaactgtattttagagtaaaaacttggacatatcaatattcataaaatattttcatgccctttaaatacaaactatattacattttttcctgtctgccaagttacttgaagtatcaccttttgccttcagctaaaaaagtatatatatttttatgtgtattatatgtgtgtgtgtgtgtgtgtgtgtatacttttagttggaggcaactatatagttttagtgtatatgtatatatttttagtatatctattttatttgtaaagctgtaaaagatgaaagaaaaatgttataatttcaagattacttgaatgtaatacagtaataatatttgctccaaattatagaaatattgtagcataaacttaaccttctcaaatctagtgtaatttcttgtctttcaaattcaataaaattttataaatatatatctgtaaaagatgtataaagtgggatgccaagtgtctgctgaaaagaacttgatgtaattaacaaatcatacttttatcttagaccaacatcatcctacattaggctattccagccttattcttaaattagttaaggtgatatgcggcattatggtatgatgtttgctaaacactagtcaaatatatagctaatgtatagtcaaatatgaggctggttgaacttcacctgtgctacttaagcctgtctttgttatcccagtccacagctgttgactaaggaaagtacattacaccaagagagttactactcattcttttagtcaaacatgttgttttacttaacataattattttaaaaactgaattttcaaacttggtttggttttattatgcaacttaaatatagaaagtccagtttttaaataatattttaatttgattttagagattagaattttgaaaaaaataaatatgtctactgatctaaagcttattttcctttaacaaggattaatctattttagttctaatatgactgaacaatgtttttttaagttgtttttcagacatgtaatttatacataagtatcttttaatgaataaaaagtcatttaaaaataactaattataatttgaccccaaaatgagacattttttaatgtggttcaagatgctatgaaatattacaattcttacaggaaaagtaaagttatgctttttggaagaatacagttggctgcattgagcttgtcattaaaaccacatgcctgtgatcaattgattaagtaaactactgccttagacgtctgcaatctgtcagacacttccctgaagtctgtgcagtcactgtacaggccaacaatagcatagccattttcagagcacagatttcaaataaaattattttcccatgtacgaattgcccactatgcacttcaaagcttaattggaaattctgtccaaaaaaataatctcctttggaaaaccagcatggaatacattttaatcactttgctaaatatgaactactttagtctcacttcaaaagatacgtttcaaaggagaagcagtttcattaatgaatctctgaaataatacgtgaacatcttaagagccaatttaggtatgaacagggttatgatttttaagctttataaaatgtagtccttgatagttcactctagtcggagagtttcaccataacatcacttttatatatttgtagtataaaagccatattgtaaatatagaactacacagtttaatcaatcttacaatggatttgttttcttttagtttaggataaaagatctcctagcataaaatgaccacgtgatgcagaaagttttattttgagagaattcttctctatcactaagattgtattttgtaatgaccatgggtgatacttactgctgaccctcttgtattattattaagagatgacatttttcatctattcaaacctaattttgaatagaaggtgaaccaagttaggttggcagagttactttaattattcagttttatatctgggacattacctaccatccttcattggtctgtgttcatagatattcattggttctaggggaatatttgatgagcctacttcgtgtttggagcatcacatgcttttgttataccccatttctcttctattatttgcgagactgattcagagctttctgagatttcaacagtactcactcacctaaagagcctggaatccttgctacatgaagacctaaccacggttcttctcctgtgtctactatctttactccttgtcttctgttcctggaaaaagataaagcaatacaagtgaatcatgactttaaatgaatgaataaaacatcaacaaaaatggtgattggttaattttgcaacaaattcttggaatattaccacatcttatctttgatttcatcagatgttttcataacatctgtttcaacacccagataccaattaagctcccctgaccctgacccttatcaagcagataactttaccttagactgaccaagaatatcacaggtgaccaagagtgtcataggtatcaaaattatcccctatgctttttgaatgaaatttgccaccaatctagtctgtttcagtatctttttgtaggattttttctgtttcagaagaaaaattatacattttctgtattaagttctttgataaataaccttcatcactctgttttatatcttcattccctttcctctacatttactttttttttttttttttttgcccatttaaagaaaggattgggtttctttcccttaaaatcctttttttggttctgtgacttcttttttctaattttctcctttctcttttacttcattactaagcttctcagagtaggaggctgaatttccagcttttgtgctcctaatctctatgcctttattcatcctttctaatatttcactcctacacattaactaaaactgtttaattaatggcagattcctcagtgaccaaattgactccctcattttgtatcccttctcctagaacgatctgtgacattaaattccaccattcatgctctgtatttttcattgcctttattgacgtctgtgaccataggacactttgctatgcctactttttaatttttcaccacctactctctattattttctctcattgttcaatccagaaatattcatttaatgagaataaaagcagaatcaaaatcatgttgaagctactttaaagctttaaagaccttaaaagctttaaaggctacttatatgtcaacagagaagtaaattggaacaatcttcagcagaaaatggcaggaacagaattgtgttgtcacttatgtgttaggtaacagatgatttgtggcacggtgcgtggggggtggaaaagttgtaggagattagtttgagagttgacatagaagaccacaaaagagatcgttgtactcaggtgatagcaatggtgacagagagtataaaatggtatgaagtataaaatagtatagatgatgttgatggatttggataaggaaaaggaaatgatataaatgctgacacttttcttgtttgttattttcagcctctttaattgtgtagttgccatgaactgagatgagaatgaagagaccatgtatagggtaaagattataagcctgagtttggtctgttgaatgagagatcccatggaaagatccaattagtgatatcaagtaggccgttaaatataagactgagtatatacacgtgtgagtcattgttttataagagtaactggagcccaagaaaagtgtggatttaattatgcagagagggagttagagtaaaaagaaaagaatgacggtggttgagacttgagggtctcctaactttaatggccaattagaggaacatgaacttacaaacaagcctaaaaagaacaggcagggctgggcgcggtggctcacgcctgtaatcacagcacttagggaggccgaggcgggcagatcatgacgtcaggagatcaagaccatcctggctaacatggtgaaatcccatctctactaaaaatacaaaaaattagctgggcgtggtggcaggtacctgtagtcccagctacttgggaggctggcaggagaatggcgtgaacccgggaggcggagctcgccagtgagctgagatcgtggccactgaactccagcctgggcgacagagcgagactctgtcttaaataaaaaaaaaaagaaaaaagaaaaaaaaaaggaacagagaaagaggggtggggaaaaaaagactatgttggttctgggaaataaaaataagtcattgtaaaaacatagaagttttcaactattccaagcgccattgagaatccaagtaaaatgaggtctaaaaaataagcactgagttttgtaccataattgtcattaaagatcttatcaataagtgtttcaatgcaataattgacgttagacgctgaattaaagtggattgaaaataaaatgacaagtcagaaaatggtggtgaggatgtacgtaattccctgagaagtgtggtttataaggagaatggtatatgggagctgaaggggttgtttaaataatggcataaagcctccaattattaagatgaaagtatgtatcaaagaaacacaaggaataatggaaatctaaggtgcctaaaaagacgagataagatgaaatccaaagcaatgaaatccaaagaattggcctcaaagtaagagaactagtctcatgtattagtggatatatcaatataatattacattactaaatatgatatttgtgtgtttagtagtgaggagttgaagatatatcatttaagggctttgctttctctgcaaagtagcaataatgtgagttgagaataagttaggggatcagaaaaatcaggatttggctttagtggcaaaggcctgaaatttttgatgacagaaccagttgtgataagagaatctttgaaaggccactgtacattgtaggggatccacttgtggttggtgatcacaaatctgtaatgtattgaatttacttttttaggttgccttctacaaaatgtttagtagtttggaggcaagtatggagaatgtagatagatgtattcctttagggtgtggatgcaatgaaaaaagtcatacattcaaggaatcgaatgttgtgtcaaaatttattgaaattaaaaaatttattgaaattaaaaatggaatctggccaggcacagtggctcatgtctgtaatcccagcactttgggaggccaaggcgggcagatcacttgagcccaggggttttagaccagcccggggaacatggcgaaagccccgtctctattaaaaaaaaaaaaaaaaaaaaaaaatacaaaaaatagccaggcgtggtggtgcttccctgtagtcctagccactccagagcctgaggcatgagaatcgcttgaacctgggatgtggaggttgccgtaagccgagatcgcaccactgcacttcagcccaggtgacagagctagaccctgtctttaaaagacaaacaaacaacaacaacaacaaaaacatgcaatcaaagtcaaaaagagaaaagcctaacgaactggggagaaacagagaagatttctcaggagacaagttttaggaattatttcagggtgcttgagatagttattaggtagaccacatctgctcctggtgggggtgatctagatctagagtgctgtgcaatgtaggagtaggtcagttgagagcaaatggtacctaaacaaccttaccaattcctgcaagacgaactctcacttatttggtcaaatcagtctccagctctagaaccgcaacaaggcttactattttttttgttgtttgtttttcttctggtttatgattattgatttagtttagtggttacatgaatgaagatcttttggaaatcggattcactaggagtcaggagactgaattcaaattgtgctattatcagcctttaactacgtggtcttctggacaagtcatattttttcatcacctgtagagtgacttcattgatgaagatcttaggatgctcagaaagaacctttttaggctggaggactgtgattctttttaggctctattattctctattatgtttagggaggtcctgcagtagtatagaaactcaaacaactatgtattagctttattttttcaaggagtcaaaactttagaatcatctttgttttcctgagtatgatcaattagaaattggttgtgattgattatcacaaatatatagttgtttggatttacctttttaggttaccttttacaaaacagtagtttggaggcatgtacagagaatgtaatagatgtatcctttcaggatgtggaggcaatgtgaaaaggacaacaagtacaatgaaattagaaccactgaattataactgatgcccacctctgttgattgcgactatataaattttcttacatctctgctgctcttaccttgaccactgaaaacatgccatgtcagattattacctcctaatctctggactcttgtaataggaaactaaccaattttcctgaatgcagtgcctgtttttatacatttcattcccaatctccttaaagctcaagataaagtccaactttctagggcaaggttttgatctttccatttccacactcaaaaatattattgacttcatatttctttcaggataactttcaaaaatcttagcttgataattaagattccttatcatcttatttgaccttattaaaatggtcattttttttttactttgaattttggtagggggcttgtactaactttatgtaagaaaaaggtacatatttatactgacaagatatttcttcttggtgaggctaaaaccattgaatctattgcccccaatctatagtcttctctcttcccttttcctgcttaactttccttctcagtagcaagcactatctaacatattccatatttccatattttaattatttattacctttcttactaggttataaattacttgaggacaaagattttagtgtattttgtttgcaatatccccagtgtttagtcagtttctggtacatggcagatgctcagtgaatttttgttaaataaagtcatgagtaaatgacacattttaaatatgaattatgaattattttgttgaatcttgtacaatgctttatatgataaaattaaacagtaacataaaatgctatttttaaaaaaatcttaattattttgaaaatagtatagtccttacatagattgttcctctgtggacagttttcttcttttggctgatgttcaacgcatctagttgagatttataataatacttggttttcaagtgatttttgctgatgttgatttgaggagaacgacttcttggatcagctctctggggagtgcaatagaaagagggctagccctgctgaggttagcttgtaattacagatcgattcttctcatagtttgagtaaatcttaatgtagtaaattggaaggcataataagcaaccaactagaaagcatattaattttaatgatgctttgttttactaatgaacaattgtcttcactaaataagttatcattgccacattttaaattttatctacaataaaggaccaagttttcatgattgactccaagtgtgaatctggaaaaggacgctgctctttcaaccccaacgtgaacacggtgtctgttatgatcagtaagtagacaacgaaagagggaggattaaacataaaataacatggaaaattagcttgacatggtatacctattcttgatggttgtgtggatgatagtatgtgagtaaaataatatgaagaaagttgtgagctgagaaatagagagttcagtttctcatttgtaagaatatttatgattaaataataagcatgtaacttatgacagttttgtcattcccagagtaggccaagcattttttataagtgtgtatatgtatacttatatattatcataaagtagttttcagtgttttctgtaattgtttgtagtattaactacacccactttttctcatgttttagtatttttttctttacctttcattattttttatttgtttttagttgacaaataataattgtatatatttataggatacaatgtggtgttttgatctatgtatacataatggaagaattcagtcaagccaattgacatatccattacctcgcccacgtatttttttgtggtgagaatgttaaaaatctatttttaagcaattcggaaatatgcaataaattttatttactgtcaccatggtcactgtgcagtatagtagatcactaaaactgattccttggataaacatctttttttttgcccctccctctgtcctccagcccctgataattaacctttctaccctctgtttctatgagatcaacttttttagattccacatgtaagtgagatcacaccttatttgtctttctgtgcctggcttatttcccttagtgtaatgtcctccagttccatccatgttgtcataagtgacaaaatttcattcttttttaaggctgtatagtattccatcgtgtatatatgtaccatgtttttaaaaatccattcatatgttgatgaacacttaggttgcttccatgtcttagcttttgtgaataatgctgaaatgaacatgggagtatagacaatgaaataccacctcacacctgtttgaatggctgttatcaaaaatacaaatgataacaagcattgggaaggatatggagaagaggaaattgtgtacattgttggtgggaatgtaaattagtacagctattttgggaaatggtatgaacattcccccaaaaactaaaagtagaatcaccatatgatccagcatttcctcttctgggtatatatccaaaggaattgaaaccagtatgtcaaagagttgtctgcactcctgtgttttagtaatcttttagaaatggttaaaggggtgttttttcaaaggaaagatgaacaaagtgcacgtgttagccaagttcattctctgtggattgtctaaaaattgctatgccaaaaaggagatggtaataaagctattttttcattttttcactttacacaaaatatcagttaagcagcgggcctaattgcttaatgatccacacattgacaagacgatttttaaacctcagtcattgaatacctatgactcacttaaacaacattctcttttgattgagacactttaaaaatatgtctgagttagccgggcacagtggttcatgcctgtaatcccagcactttgggaggccgaggtgggtgaatcaccgaaggctggaagttcgagaccagcctgaccaacatggagaaattctgtctctactaaaaatacaaaaaaatgagccgggcgtggtggcgtgcacctgtaatcccagctactcaggaggctgaggcaggagaatcacttgaacctgggaggcagaggttgtggtgagccgagatcacgacattacactccagcctgggcaacaagagtgaaactctgtctctgagttgtcatgtgttgaccaagtaacaaatgttggattttagtatgtcatacgtatagtagacgtcttttcctctttgcttttttttaatgtattgccagcattaaaatttcatctttcaaccatagaacaggtaaaaaataattattgtgttcaaaatgcttgctttggttcatttaaatagataactcatctttctttctcatatctggaaattacattaagacaggtaaaccttggaagttattcagtgaattgcttgaatatcggcattcaagtcggacagggaggagccaaaagtatatcatttaggacataaagttagctttgaaactacaaagttatccaattatgacctatgcaaggcatgtttccaaatatttaatagaagcagtgttttggaaattcttttctccattaggaaggaaactttattcaccttcagaaaccatgtggtgtgtttgatagtaattaaatatatatatagttttcatttgtttccttttaaatgctgcaaaaataaacctcaaggatctgttcacatagctgctactggagttttatctcattgaatattctttagaataataaggattagaacaaggcattataaattttcttgctaaattatcttaagtcatttaatagtcttgcccttagagaattggatttgtttccaaaataggagttagacattggccttctttgtttttcaaggacctgagagttgaattcctatgctcatgttcctatactacttttaacatttgagtaactttacattttgtaatcaaatgaaagtcactaaacaatttgcttgccttgaaaactgacagtaaaaagaacaaaaagctttataagattgtagttatcattttattcatccaattgattatccctctcaaattatctcctgtgatttctgtggtcatctcccttaaccatgtaatagtactttatcatttccattcaagcgcagtgtgctaataaaagcacagattgcttaagatatttatatctattaaatgaccagaaacctgaagaattagaattccaaatttcatgatgtagttttgcaagttcagtgtgcttttgctattttcagtcactgctgtaggcaacaacgaagtcagatgttatcttttaaagagcctacataactttatgaagtttttctagtcagtagaaatacagttggaaagcaaaatgtttttgaaataaagctaaaaggcacaagtttatttctgcataaggtcatgcaaaaaatcctctcaagattgttaccaaagtgacatttatcaaaaatttcttattgatataaaatgaagcagaaagttccttacttgctgttaaaattactgcgaatttaagataggaaatgaagccaattagatgtgcaggcttatgtaatgtttgagacatgactaataaggtggtatgaagtaggattagaattagccctctctgccatacactaacttcttagtatctttttttctttttctgcttgaaaacagatatgacaattgatagctgtgccaatcaatctgttgaacagcaggaatgtataatccacagtttaatggttaattgaatatacaaaaatgtgaaataattatttacaaagttgccacaatttaatagctagatctgtgtgtatataagcctcacaaatgttcttagaattttaaagaagctaaaatggtaaagaaaaaaaaaagccttcatacacatttttgttatctccctataatctgtttccctgggcctagaacccctactaggaagcagagctgagcaacaaaatgcccgccacaccagcttgctaactggtaggggtccagttcataacctggcgagcacatattagatacattccattctccattcaatgctgggccgactggtactgcttattactaaacagtgagcttagagtactttgaaatgttccaatcctgccaaaatgaccacggtctgaaggtagcccagggagtaatcctagaacaacagtcaaggaacgcagctgcatggcagttcagtgggccaggctgataaatttcatgctttttataatagatatttagctactgttttatactcaggggtcacgtttgttaccaattcaatgcttactgctccttactagatgaaaagtaatatggatcttcaaacaataaggtaaatgttgaatgttatgtatatatagattaatacatctgattctgttaatagtgaaaatttatttaattttaagtatcttttctttcttatcgtattctatttttatggctgagttgcagttgaaaaagtagcactttgtttaccttaccaggaaacttctagcactaaagatcaaaatatgtacttttagtgattacattttttagtcactgataatgttttgacagttataatgtggcctccttgtcatgtcataataataattcttaaaactattatattcaatccatttaggatgatcttagaaattttaatatgtgttaagaacttttaagatcataatctaattcccatacattgtagattagaaggttgagactctagatgttcaatagcttagcactagttcccagcttgttagggattaccaaagttagaaaccatgttttctgactcttacagtgtttttcttttaaatgtattataggtaaacagttaagctattttgttatctattatacgtctgccatttctgatagactctatataaaaattaatatatagtataattaagtacaggtagaggaactctcacttttacatagaataaagttgttttgaggtttgattttttaaaaaacatagtaattatcattcaggcaataatgagaaaagattaaaatttataaaatttattgatttgctggacaatgcaaaccaattaatatttgttataaccaattatcataacactgtaatacctgtggtgatctcctaataaataaactcacctagaatttcaaaatagctttaaaaatttacatttcattgatattttctttttcatagatgaggagcttttctctggaatgtatatagatttcatggggacagatgctgctatttttcgaagtttaaccaagaggaatgcggtcagaactgatcaacataattccaaatggctaagtggtaagaaagcatttgatgcatttattttttagtatcgtgttaaactaacttatttaattctatcctaacaactagggaaaatggttaaaaactaaaatagcaggctattacatgaataatggtaattctgtaccctatgatttaaaatattcggggaaaataaacaattgaatagctcatagtccatatttcgattctttatttctattaatcatcctacagttatcatatgaatatgaataaataaaagtgacagtgataatttatatttcagtacccaagcatcttctccagttgtttaattgtaacatattgcaattaaatatgctttttacttcatttaatctgcttgtatgttttaacaataccaaatctaaaaattatcccaaatgtatgacattgagatgcaatgaacagagtatagccggggcctcctctctttttgttttatacttagattctaaaattacaaaactggtatgtattttctcataaatggactaatattcagtagaaatcataggaatgataactatgattatccatattcagttgcctccagctcttggagtcatatggaattcacatcaaaaaaggtgctcatttggtttaccgtattattccaatcaattgctgttgtttagagcaattaaaaaaacaaaaacaaaaacaaaaaacgaagattcttgtcatttcaccctggagaaaatttttagctgaccctaaatgtggcaattcatttaacattgcagagttaagcatgaatcaccacagtgaagcatcctatttcgctgataggccagcacaagaaagcattgattgttcatttacttattcagattattcctccagtacatctggaaatagaatattctaaaagttgttttgttcttgaaataaggaaaccctgtatgtctccaaatgactaatgacgctgtttttccttgaaaagtttccccttcatttcgtatgttgcattttaagaaaagtcatgtttttcagagtttggacttccaactcctcattctgcttcaacaaatttgagtttatatgtgctagattgaaaaacatactttgaaaaataaatattttttttcaataaaatagccatcagattccttaggaaataactggtagaaaagtttttcaattttttgaaactcattggtgcacaaataattttcacatttcctgcacttcctgtggtactcgacattccaaatgtggcatggtgtgtgaatgcaattactgcttttagaaatgtgcctgtaaatgttgaattgtttttttctaccaaagatggggaaggcatctgcctgtggtctacttggatgacagaagatggattttcataatgaatatatacctagtcttttacctttttttctagaacctatgtttgtagatgcacatgtcatcccagatggtactgatccaaatgatgctaaggtgtacttcttcttcaaagaaaaactgactgacaataacaggagcacgaaacagattcattccatgattgctcgaatatgtcctgtaagtattaatgctgttccgatttgaagaaagaccaagaaattcaaattatggtttatctccgtgcttttattatcaaccattacaaataaataaaatattgagggaagcatttaatgtaacatttattcatcatcattattatatttaatattcatcattttatattgaatatagtgtttataaccccaacccaaattctaaccctcaataagttatatgagataaacataccctattttagtaaaaatcttaattcaagaaaatattttgtttttgttcttgaacaaataaacacttctgacaaatttttgcatattcatttaatgcattggtattcaaaccaatagctaaattgcatattacctaaagaaactgattgttgtcaataaaatacagtaaatatctcagtaagagatgattattaaggaaccatttataaatagtgaaaattaagaaaagctttaataaaattctaattaaaaacagtaaccaaaatgctcttgtgtagaaacaataagtatacatagcaacacaagaaaatttgtgatgtcctttctataatagagttttacagacttatcctgacttatttatgattagcatcctttgtgaaaaaatgtttcttaaagtgcttagtgtttaaaatagtttatatattataatactccactgatcatggagctcaactgtttctcagtcatttgcaacaaggcagcgaagtcagcagaaggggtaaaaggcctttggacacaggaagaaaatgtcttcactggagactatttgtgaatgatccaaatgccatttctccttataatgtataattaggcatcagattagaaatactgaaaattatgtgataatttggataaatgaaggagtgaatgtaaaactgttggggaccattttgtgtaaagatataatcactctcctgaccacaatctgcaaaactcactgtgtataataatttatgttcaaattgaagacaataaattatcaaggaaaggcagattaaatgatctattttctataacattatataaatacttccattgtacatcgttaaaattagaaataattatgtcacacatttatcaaataaatgtattttcagctgacatcatgctataagagaataatagtataactattgtataaaatactataagtcataaatattcctctttgacaactgatgtgcagaagtggttaacatatccattcttcagattttcatcctccaagcaactagagtacaagtcgaatttttaatgtgcttcaatatttacttaagcaatctgaattatgtttacaaaatggttttagaatgacactggtggactgcgtagccttgtcaacaagtggaccactttcttaaaggcgaggctggtgtgctcggtaacagatgaagacggcccagaaacacactttgatgaattaggtacatacatatgagattgaaaaatgcttctgaaagaaggcttgtaaagtttatatatttaaataaggtctcaaaagaagatgtactttccatattttcagcataaataatatgctaatttaaaataattatctagatactgttcataaattttcttaagtattttgtaatctgttacgcccatgagtgcactgctgaaacatttagctcattgaattcaccataatatatgaatgaatgtgtgtgtttgggggtgtaacttgtataatgtgtgtataggtaatgatatgtttgtgtttttataaatgaatatttatttcatgtatattagaatatctaatattctgattttgtgtgaaaatacagctatatatttttactattgtagctaatggacaggatagagtttggatggaaaaaagtgtcagagtagaaatttggagacttgtgttcccttcttagttctgcttggtgactctgagattagatattctcaatgtgacatgaggaggcttacactttccaggtcgaataaggactgacagtctgattccctctgccaaggaacagtttttttatttttttaatctgaatatcccagggcacatcatatttactaaatgtcatttgtaaatgacttttctttcaccttaattcattagaaggtaaaataatggtcattctcagattttgagacaggtgataagttataaatctgtgttaccatgtggaaaaaatttactgattctaatagtaatgaactatatcgttcttctgatcaaaaaccattatgttgattatggaacaaaagtttctagataagcttttctagagaaaagttctaagtatcattttgtgaaacaggctacttgctcattctactcccctgaatgtttgggaatatattttatgtttcagtctttcttttttttttagggagagctagacattgtcagcctttattcacatatggaaggactagtgattgttaatttgttgtttgagtggttataaatttattgcttatgaggtcatttaaattcatttttaatttaaaataaatacatatttctttgtgtttctcagtaataattctgttagcaagattgtcactatgtctgggcctttcatataatcatggcaattgattattaattggagttttctatcagaaatctactttcatattctgttatttatcacttcactgtgcatacttttgtttttgccttactacactttaaacatctttttgttagaggagctatcattaaataaaagtatcactagcaattttgaccatatgccacaaaaagttctatttgatggtaagatgagttaccgtgaaaaagttttattccatcttccagctcctaagattagatcaaaaagaaattgagatttgtaatttttttaattaaaacagtaatatattaacattaaaggatatttagaaagaagcaccagaatatttctacagctttgcctcttgtaacactcactgttaatcttattcttatattctgatggatatttttaaggttaatatggttctagtccatattatgtaatatatcattgtactttttccccataatattattttactagcatggttttcacaaggatacaaaattttcataaattccattagtatctgtattaatttaatttaatttagtgtttctatcattatttgtttccaaattaccataatggtacaggaatatctttttgcagagtacttttcagagttgaaattattttcttagggtaaatttttcaaaacaaagaagttaatatttagaaactttaaaagaatattttcctttttatagaggatgtgtttctgctggaaactgataacccgaggacaacactagtgtatggcatttttacaacatcaaggtaattattcaacagttacattttatgagttaaacaataaacttcatggagtaacagtaattattataaaagcattcttctctgcaacttttaattttacatgtcatttgggatgtaatccttccattttatttacttttgcctgattaccaaaatatattggagctaaactaatgctttccaaatacttttgtagagagtatttgtaatgattgcatgatatttttatcaaacaaatcaaaataatgaattataatgtaggaaaaaatacgtgattttttcaataaaataatttgagcacttgtgagcaaataaaacttttggcatttttttggttgctgttatcagaggtaataaatgtttatcacctggattgtagtgacagtaacacaagtgtatacatatgtctgaacttacgacattgtatacattaattaattgtgtacagtatttttttgtataccaattataccttaggaaagctggaaacaattacgcatttcagtaaaaatactttttacttctgaagtaaagtgatgactatttaggacctgacaaaacactgaaccaatgttctttttctgtcttttttttttttttttttgagatggagtctcgctctgttgcccaggctggagtgcagtggtgcgatctcggctcactgcaagctccgcctctggggttcatgccgttctcctgcctcagcctcccaagtagctgggactacaggcgcccgccaccacgcctggctaattttttgtatttttagtagaggtggggttacaccatgttcaaggcaggatggtcttgatctcctgacctcgtgatccgccagcctcagcctcccaaagtgttgggattacaggcatgagccactgcgcccggccatttttttttttttttaagattgggtctcgctctgctgcccaggctggagtgcaatggcatgatctcagctcactgcaacctccgcctcctggattcaaacagttcttctgcctcggtcgcctaagtagctgggattacaggcatgtgccaccagacccagctaatttttctatttatttatttatttttagtagagacagggtttcaccatgttggtcaggctggtctcaaactcctgatctcgtgatccgcctgacttgggcctcccaatgtgctgggattacaggcatgagccaccgtgcctggccaattttcttattctatgtgagattattttatgtatttgaaaattagtttaatgttttctcacttctctgggatgcccaagctaattaaagtacgtatttcaagataaaaaatcttttttttaatcttgctcatatttttctttattaattttatagtaggcatattccttagagttaagctgtaactcagccactgtggaagataatgggtccctttgattagacaatcaactacaaagcaaaaatctaaaggttttagctgttttttttctttaatgggaaaacatagtataattgtaaactgcaatgagctattcaaagaaaaagaaatttacaagtaagttgtttttaaatatttgcagttgccccacaagatgtctaaaaagatgtctttaaggatgagtttaactcctgttctaagtagtcttgatttaactcacaaagaattgaacaaagaaaaaaaatcaaattcttaagaaaatgttgttttcaataaaacgatttttcttgttttgttttttccagtacctgtaactttaatatcaaaaaattcaaaatcatcattctgcctattgatactaatgattaacaatgtatcttacttgtttttatgggaatgcaccttttttcattagacgtctaatttgaaataaatatgtgagtcagagaaatactgatttcagccaacctgccataggacaatggaaatatttcttactaaagattcaaacaaattttatgaggtgtcattgactaaagatggtttaatgaattttttttgggcccctattttttgttctgtgaccaacaggggaagtacctaaaccgtgacaacatagacttctccaactagtattcaggataccatgtgagaacactctcatattaaaataatcataacacaaaaagatatggtgttcaattattaatgagattcatctctttgagttaaattgtgataggttatattgatagtgatttggaattcaaattcatatttttaaataaaatcatcagtatactttcttgctgctaagatgaactagttagaaacttttttgagttgtcctgtattttggaaacattgaaaaggactttactataacttattgtctactgactccatggatgaattgagtattgtaatgctttatgtatcaataccttttttcaaagtttttcagcttttcacatgtgttcgataacatttaacttttctatggtggattatattaactttttatcataaattttaccatatattttttaaattgtattttaattttaaaaatttgaaaatgcctttttctgttttcttttttagctcagttttcaaaggatcagccgtgtgtgtgtatcatttatctgatatacagactgtgtttaatgggccttttgcccacaaagaagggcccaatcatcagctgatttcctatcagggcagaattccatatcctcgccctggaactgtaagtatccagggaaaattctttgttatgatgctttataaaaactcatttaacaggtaatgaatatctgtggggttttttggggtttttttttgagacggagtctcactctgttgcccagggtggaatgtagtggtgcaatctcagctcacctcaccctccgcctcccgggttcaagcgattctcctgcctcagcctcctaagtaactgggattacaagcatgcaccaccatgcccggctaatttttgtgtttttagtagagacagggtttcaccatgttggtcaggctggtctcgaactcctgacctcgtgatccgcccgccttggcctcccaaagtgcttggattacaggcgtgagccaccgcacccggcctgaatatctgttttaattaaggaataaccatgtgagaaataatttagagatacttcacatagagatagttccatttctaggaatctatttagatagaaattgtgttacatatatctcataggaagaaaatgtatgtgtaagcaaataattacaacaaatgagatgtaatttttaaaataaaatatttgtaactgaagtaacacagattagaactatttaactataggcagctttctaattaggaatggtctgaactagaagtactgttattaaagctggtagctatatccatatcatgcaatattagtagtattaggaatacattgaaaactcagttttccagctgaagatacagacagtgcactggaatattagaaccggaatttttctaagggtccattgataacagtcctactctttctttctcatctggcctataataatgctgccttctagaatgttgattagtttttttttctaaaatgtcagacagtacaccgagagatgttatataattgaacattaagagaaatataatcttatatctctgtatttcataaaatagggctataattataaaatggataaatatgaacaatgaatttattttaaaaatcaaaagatacatttatgtaaacaaggtgttccttttttcttgaatttgaaattatctttgctaatattcttccaaataattatcccatataatttttactaattgttgattcattttatttttcttattagagtttatttgcaatattgtttgctcctttattttcttcttaaattataccaatgttaattttttgaaaattgaagatacagtttgctaagcctttaaagagcatattttattccaaaaattttaaagcttaagttttgttcctggctaggaagctcaaagtttaatcatttatatgtattttgtgtggaacaattgatctttaattaactttggaaaaattatgagaattgcttcttattcataaaaagattaaatttttaggtcattcttaattataagtgacaacaaagtcctgtcacagaatttatattatcctttaagatgatctctctttgatgttcgcagctctaaagaagatggacagaacattaatcttgtataaaacagggaaaagcatcagcagatacagccgttttaagattggggaatcctggtgtggtggtgggcgcctgtagtcccagctacttgggaggctgaggcaggagaatggcgtgaacccgggaggggagcttgcagtgagctgagatcacaccactgcactccagcctgggcgacaaagcgagactcttgtctccaaaaacaaaaacaaaaaaagactggggagtgctggataagaagcagagattatttaagagaaaaggaaggggaggctgaacaactttcaaattccgttatatatcaaaggctgttattattttactcaacatattttatgcattttcagagaaaaatatacttttgagagtgacttgctatttgaaattgacctagtcatagactcatcttaatatggaaaattaagaggtggttgtgattacgtgtgctttcatcagtgattcttttgagcagcatataaatggggttagtacaggagcagttgatttgcaaactaaacaaaattctgttccccctaaaaaaacttaagagaaacccttcaaataaagatattaaaaagataaaagagagccatgctgcttgaatcagggtttgaggcctcagagcctcatgcagtctgtgctggagccagcatggacccaggttacaagagcagataatgtacacctcttctcaattaagaacattagagtggtaacttgaaatcagccatcatggaactatctacaccatggaaattgtcaaatgctacaaatcagggagattttttttttcctcatgcaaagtgacctctgaccttacctctcatcaggctcttcacccacgtgacaacttaaaaggcaccttaacaggtgtatagaactcagagcatcactgtgagaaaaccattcatgtcaggcagcaattgttctacataaaatgtaggaatactaaaccctttttagtaaaacagaataaaccaatgctaaattagaaaattctgctaacagtcccacttttcactgttttttagctctcaagaatgaccatttgtttcctgttccaaagcagtgtagagtaagccagggttagcaacacacatctgcaacagactccgtgaaaaaagggagtagtcaggatttgagaaatatttctataatgtggtttcttacatctggtgttgagaccagagcagctcctttaaatcaaaaaattgtcagatgagtgatccttagagaataaaagaggcagggtaggagtgacctttggaactcctcctggaaaagcgtacctccctgaagattctgtccctccacccttcaaccagcaaaacaccatgaagtcagctctctgactcaagagtggcagtgtctgtctcttcgttgcacttccagggtttaatatcgtctcatgtagccgaaccacctgcagccaagtaatccaaagtattctctcttctctaaggttaagaatgttgcttctgaagtcctcccaatgaaggatcaactgtgattttcctactttatttccccctacagtagtatggttgcccagtcaaccccataaatatatggctgtgttcttaaagaaatgagactggcagaaatctcataccctcgttctaatgttccctgtaggtgcttcttttaaaacacggttggtagctctgttagcaaacgaccccaccagcaagcccaagtcagtaggaagaagcctgccaattgtgtcattatatttttccgtaagtaattcaagtttgtggaagaaacaagacacttttggtatgttgcaaagggcagccaaagaatgaaaactctgtggccgagcaaacatattacattattctgctgcaacatgtataaagcttctgcaggagattgtttgtatagttgtatatcctgttaaagcagaacttaatgaaagtgttcaactttaacatctctttataagtataacagagtcatgtgcttccatcatcatgccttggacaggtcgggtacatgcaaaggatcacagaaaattgatgagccacatagtcagtagtggcaaggatacgagaagttcattgttggcagttttgttgattacatacgtcttctggttgtgcttacattagagtatttctctttctcttagatgtttgaaaacattcagttaggaatgtttctaagaaaattgaatgcataagacatagacatgaaaaattaattacatcgtctcacatcattattcaaaacgtgaataaaatttttaaaataaatattattaaagtttagaggagagagagattgtagtaaaacagtctgatttgaaaagggattaaaaaatgtgagattgagcttgccctagggtgattggacgtggataaattgagtaaggaaggaaggggttttcagatgaagggtacagcatacactacaagacacagatggaaatgaataagtgatttttcgaagctctgtgtgggttagtaggactggagcagtgggcttttatatgtaggggaggcaaatataaggaagatgagggtcagctaatacataagcacaagtcttcaactatgtaatttttttggcttcagacaaagggcttggattaccaaggttgaaacataaaatgagtttttctcagtatacaaatttcatagaccagtactagaaataagcatagattctagagtgccaccaagaccctttatttatctatataccactcatcccccacgtgttaggttaagatcccctcgaccgtgctagtcactctttctcagcctagttttgcatttattttctgcaatctgtcttcagcctcacctcctacctccttccttcactttgggctccatgatccagccatgccctacgaattacagttctctaaatactctaaattttgttttatcatccctaaacctcttcactgaccttggcagctgtaagttctccactgttataaacttgttttaaaaatattgcctcttgagtatgtagggaaattgatcctaaaccaaaattgattgtttatcttacatttgtttcaaattattactttttgtcataatattgttattttgctttgaatatgtctatctttcttactagaatacttgtgtctgaagataacagtaattttttattcttgtgtcccctactgggcacatcaaagtgctttttggataaaatatgctcaagtaatggatacgtatattaacatataagtatattctgaaaactgacctaatggacgtgaagattaagagaacatttagaaacttcagaaggcagcagatatttatgaatacctgagtataggaagcaagtttggtaaggacaattgctgttactttcctaacatggcattcttattgttcctagcatttcatatcacactttagtaatcagagcacttgaaatgtctttactcaaaaaaggagggcttatcactgcttgataaacaaatagctggaagaactgaggaaaaacatttaaaggagaagtttaaccaaaattacttaatgactatttgcagagtaaaattaatgttctaaagaatgaaacaccagcctagttagtggacaaatattttacgttagcacatagatgttatgttatcttgaagtttcaataaacatgttttattattttgcaaggtgagagaaaagttaatcacatctgatttattcttggcagtatgacactgagcaaactcagtgcagacagagtctacaaagggcaatcaatttgtgtttgtgttacattattagcactcattgtctgtcttatcagcagagttgatggcatgaatcaatagaataattattatcaaaaagaattgtttggtaagtttgaacatatactaggagacacttgtttctaggtgataaattcatgggagtattaaaaaaagtcttgtggagaatattttaatgaatgcaaagtaacttatttgatttgtttagattacctatttaataactatggttttgagcaaccttgacataattgttaacctggatttcatttaccattaagtaaaagccagagactaggcactggtcatttaataagcttgtctcacatcaaactgtactaactggaaattatgtaaattgtttagtaatatatgctaactttgatttttccagaactcagaaacgagaatgcttgcaaatacttaaggagacatttcagtttagcaagccatcattagcggtgttttataaagttctggaactatttaaattacccatgcattgctctttccatgttttcatgcagtgagcaatgtatttccctttttccactttgtgtgaagattgaggctagaaaacacccataattctatattttgcagaagtatggaacacgttcatcagcttagaacaacctcaaattaaattttttgtcctcattttggtctttgttgtgagcagtttgtaaatgtgtatttaaatataatactttttaaaaaataaaaacatatgaactccagatgaaagtctagttaatggaataaagaatgagaggtttcgttttattacttgtctcattactgctactcttttaagtcatttaattgctccttgtacctttctacaaaaagggaactatatttatcagatctgtaaaaagttctagtctggtaatgttaactggtcaaagtaagtctcaatattgcactcatgatgctgcagtctaaatgagtgagataatattagtaatctgctgagatctagctgcacgtggaggcctgcctgacaacattggcccaaaggcactaatactgttggacagctgttgcagggatttaacctggagattgtcatattttgtttggccccccatgttgctgttctttttttactgagtcaacattaaacacttggcagattttacataaaattccacattctatcttctgctgaggtctggaagcacgaggattttattcctgcttagaagcagtcagctggataagtgttcattgccatctttggataacacgtaactccccagtttgtcacagtccccattgcatcctgctatttatgactgatgctgtgcctattgctatcaaacaggcagcttgctttgttactttccttttatcacatacctctctaaagaggataaatgaaaaccaacacgatagtgctgtgtgtttcaagaaaaatatagtgtttttgtttctggaagtagagatatcgacaggaatttaatattgacaggtatttaataacattattaatagtaataatgtttgtatgtattaaaatattatacccaatggtttttctcatataacttaacactcagatccaattagtgagtgagtttgagttctggcttcagcagttcccagcctacccttaagtttggccttaggtgccctacgaatggaatcttctcctcagaagccctgtcaggttcccttgccagaactgctgacgctgttcagcagtcctttctccagatctcgttcttgttttctgcctgcccccttggactcagtgctctgaaacttttccctcctggccagaattgaggcccctgtttcatacagacccggcaccaaaattgcaggccagatacaatcaatgatataatgcattcattcaggccagatacaatcaatgatataatgcattcattcaactactctttggtgattatctactaaccagctctgttataagtctgatggcaaaacaataacaaaatagacccagttacagtcagcacaagcttacattctatagggagaaacaggcagttctagagggagaaacagacaataaagatgcaagcaactgatacataatatactgttaggtaaatagggctgtgaagaaaaatagcaggccaaggagacagaaagtaaagatggagaaggggagctacttttatatgtcatcactttcaagaagcaacttttgaactgagaactgaatgtgaggtaacagaaatggggtgttctggagaggagtatgccggacagggaagagcaggtgctaagatcctggaggggaagtatgcttgaggctcaggagcagcaagacctacagtaggaggggctggctcaggccagatcatgcagaggcctgtaggccattctaaggtgttggtattttattctaaggataatgaatgggatctttgatagaggggagttaccagatttaatttaacacatccaatctaagctgtcttcttccttcttcttcttctcttcttctctcctccccttctccttcctcctcctcctttctcctcctcctcctccttttttctcttcttcttcctttttttatagaggtgggatttcactctgttgcccaggctagagtgcagtggtttcatcacagttcacagcagcctcagattcctgggctcaagagatcctcctgcctcagtttcccaaggagttgggatcgcaggcatgcacagccacacctagctaatttttaacttttttcccagagatgaaattttgctatgttgcccaggctggtcttgaacccctggcttcaacatcctctcatctcagcctcccaaagtgctaggattacaggcctgagccacctaagcccctaagctccaatttctgagctctcttttgggagggcagatcagatgaaataaaacttttacatgtcagagtttgactgaatttaatgataataatataatttattttaacaagtggcagcattagattgtgtccactagtttttgttttctgaacaaaatggtgtctgggacaaaataaatagaaaagtggtgagtgagaagggtgaagagttatctcatatacaagatggcatcagctcttctctgaaaacagaataacatacaatgacttagcctgattcaaaattaatacacactgtactaatcatctacagatagtaaaacataatcatgttatttcttttcacttccataggtagcagatatacttaaaacaactggagcttctaagtgatttcaaaagtagagagtttttgattattactagaacaagacaactattttattaacttggttctttaaaactttctttctagtgtccaggaggagcatttacacccaatatgcgaaccaccaaggagttcccagatgatgttgtcacttttattcggaaccatcctctcatgtacaattccatctacccaatccacaaaaggcctttgattgttcgtattggcactgactacaagtatacaaagatagctgtggatcgagtgaacgctgctgatgggagataccatgtcctgtttctcggaacaggtaaatatttgagcccaagatatgctttaatgtgtagtaaaagaatgtactaaatataggtagtaggtaagggccatgatcttgaaactagaaaaactccaataattacgtctgtctagcccttagtgagatatttaatctctttttgcctcagtttcacatctgtaaaatgaagctaataaagtaaattatagagttcttgtgaggaatatatatagagatatatacattatataatatatatatgtaggtagggctatatgattttcttggcaatttgtcattacaagatatttgtatgatttctctgctgcactttccatccaaactggaaatgaaccagctttgtgaaaaacttcttcttgtctcaatggaaaaagaaaaaagcaatgattaagtactagagttgcatctagacataaccgaagctggtttagcccttatttaataagccatggaggtaagtgttcctttcaactgaaacagactctgtgacttcttaatcaatacatgaagccattttctaaggataatgataatgacagataacatactcaatataacatttggaagtgaatgtgactcaaatatagacaggttttttgaaaatattgatggcactcttttaatacatctacaaattctatcagtttactctgatagaagttgaatgaaaatgtgcttgtttatagacccacatgatagggaataactagcattgtatgttatagagcagtggttctcaaagtgtggtccctggaccagtaatatcagtatcactgagaacttgttggaaatacaaattctgaggtgcttcttccaaaattctagggatgaaacccactcatctgtgttttcgcaagccctctaagtaattctgatgcacgctaaagttaggaaccactactcacgtctttcacaccctggcttgtcggtcgggcagtaatttaaaatgtattttcaaacatccctaactaccttataggaactgatgaaatctcttcacttacaataacactctttacaataacgtcttgttgtaatcttagaaatactttatgaaattaggtagtttattaggaaagagacaacacgtctgtaaaagtcattataaaatatggcagtggtggaatatgtgttctggatcaagggataaattgcactcgtacttcaatcagtttaagatgtgggtactttttcttggctaaataaaatttccaaagtgtgctaagataaggtttttattttatcctttttttattcttgaaaaccccatatctgaatgtttcattttcatataatttcagctttatggtctgagactgagaatcttctaaaatgtgctactacatttgttatcctttttggcatcctaggttggcatcctttcccacgggttggacatatctgagttttcactattcctctctttgcctgcctgacatctgaggaataatccttccttcccagaataactgttcctcactctgctctcaatttatatctcatcctaccatctccaggacttttgttatcaattatattcttactcacttgattcttccatttcatcctccactgaatcctcaacttagaagccttgccaggttatgaaactaaatatccatcttcacccactgccacctctgctgtattgcagattttgtcaaggtcttacatggtctcatgataagaaaaatataggcttttaaccactgaaatacctctctctcctatttgcatcagttggcattggagaatctcactttacctattgcttcagtcatgtgtcagaggattctcctctcctcctagtggttccctcttagctggcttcctcctgcccatgaatgtgggtattccctgagggtctgtctattgtcccccacctttttttttttttttttttttttttaaacggagtcttgctctatcacccaggctggagtgcagtggcacgatctcggctcactgcaacctctgcctcccgggttcaagatattctcctgcttcagcctcccaagttgctgggattacaagcgcatgccaccatgcccagctaatttttgtatttttaatagagacagggtttcaccatgttggccaggatggtctcaatctcttgatcacgtgatccacccaccttggcctcccaaagtgctgggattacaggcatgaacctctgtgcctggccttatggtccccttttttaagatactccatgtccatctcattcattcacttggctttaattatccattctgtgcaaacaaatcccaaatgtatattgttattccttaccatttcctatgctcagtgttttcatgtacagttgactgttggataacacacattgtataacccattaacatttcaaacatcatgcttcaaactcagtttatcctctttgaaaactctccaccgagcagttaatccaatctcccatatttgtattcattactgcacatttctctcaaagttcaatctctctttgctatataatttctctctaggcatatcacagtacctgataaactcaataaatatttgtcaagataaattgaaaatcataactatgtccattgttactcgtgtaatatgaattcataaatgtgactgtaaaagctaatcttcatttgcatataaagtttgttctctacagatacagccttcatgtaagtgactacaaagatttgcttttagccttagctcagatcattcaacttagagtttgtgttagaaaaacagttttctttttcctgaggctacgtgttaatttggaatattacctctccacagtgtctcatattacccagaaaagatgactgttttctcttttttttcttgtgaagcctgtcttaaaggtggactttgatgccacagccaagttggttggtttttttttttttcatgaaaatctacatgaaatatgtgtattttctccataaaagatgtagagttcatgggtggaattttaagccattatgaactgttcagcagtatttattcatagaagacagtaagaagcatacttttgcacaaattctttggcttttcttaccacataagtttctggcaccatttcatagaatttttattttggtatttaaacacttgtgtcattttcaaaaacaatatttaggcatatgtttttaattgtagtggaagctgcactgatgattgcttacaaagccacaggagtctcttgaggatcccatcctaataggaaagtgtgtgctgtgacactgcccctgccaacagcatcttactgaagagatggtagcgcgcttagccactggaccttattgtcataaccggctgcattataatttttaaacaatgatttcaatttacctgagtctctaacaaccagtatattggtataaaatatttactgtggccaggcacagtggctcacgcctgtaatcccagcactttgggaggccaaggccagcagatcacctgaggtcgggagtttgagaccagcctgaccagcatggagaaaccccatctctactaaaaatacaaaattatcccggcatggtggcgcatgcctgtaatcccagctactcgggaggctgaggcttgaacccgagaggtggaggttgtggtgagtgaagattgcgccattgcactccagcctgggcaacaagagtgaaactctggtgaaatttctcccaaagagagttctctcttcctgtttgttactaaaagggacaaaatagcttttttaggggagaatcacaggtcattgtcccaggatttcctagcattatatatctaactgtcttgggaaggagaaaacatttcttgggtgtttccaggtcccctagtgtcagacagcccttcagctgttataaatgaatgatgatgctccagttattggcacagtgaagcaagtttctcttttggcttttcttctgtatcatcatggaaaattcaggggaactcaatgaagatattatttgtcaaagaagatgccataggggaaacttatgtgacagttcattggaatgcaaataggatttcatgtaatgatattcactttgaatattatgaatgattttgtagcttacagaatctccatggtagttgtgtgggctccgtgcctggtaactgttacagttagcccaataccattatcgtgtacaactctggctgaatttgagatactgaccttctactcccatcaaactgcatcagattattttttgtgttaccagatatcaagcaaaattaattattaattaatttaaaaagaaaaggaaaaaatggagggaggaagggaaagaggaagtaaggaaggaaaagtgagcgttgtcctctgaccttttatttcttatggttttcattactggtatctagtctatgggttggcaaactaataatataacctatggcccaaatctagcccaccatatgttctgtatggtacatacactaataatgttgttttgtatttttaagtggttgaaaaagtaaaaagcagaatatctcatgagcagtgaagattatatgatttttagatttcagtgtccatagagaaagttttattaaaatatagccacacccattcatttacatttcatctgtggctgcctttgtactacagaagcagagttgattagttgccacagagaccttttagccagccaagccagaaatatatatattttggccttttacagaaaaagtttgcttgtcactgttttggttgataattgtaaattttttaaaaaattaatacttcttcaagaagctattttctaatatgtagatataatacagtaattcattatgttgcccaaaattaatatttcttcttttatcttgagtaaaaaaaaatgctgctactttgttaaaatttaagctggaaactacatttatttattttcccacccattcctgatactactgtctataaaaaaaaaatcacaggttgaaaaaatgtattttaaaatcagcacttggttttattctgtagcattagggctctaggtgtttttatgttctttatctctcttttttttttttaatcttgaggaagggctataaaacagcaggcaagggttctcataggattaacatttctattttaactttgccacctactgcttacatccaggctgtttgttcaaagcagactgtgtaacacagtcaagagatttttgccagttttccttttgcttctggagttatgaaaatatttaagtgtctaggtcaggttcagagacattctgtaaaatttatatttttagcattatacatgaatcagaatgacgtggtttttgatgaaagagtgagagtattcttatgaatgggtgttagaggtttaagatgatttaatgctattatgattttttagtgtagggtcaatacatgtgttctgctaacattcttatatagtgtatactgtttcatgcttcttattagcttccgtttaactggaggagtactaagttggaacattggttccaggaagtcctctgaaagtgtggagttttgaagtgtgtgtcacatatgtgaataaagctttaaaatgcttgccttgtagcattagaggataactgccttcatagtaactaaccagttctggcagttgcatctcttggaatggcacacttaatgaactgcagagccaggaattttgatttttaaagaactccttaaaataccccatgtaaaatttgatagctggagcagtgcatgtgagttcagaaacgatgactgtcagctagaagttgtgtgtgaatgtcactctgaggatgtctagacgtctcctttgctttggcgtaaggaaaaaaccctttgtaagttactgatttttaataacatcgtgggtcactgctttccaaagcagaatgtggaaacttctgagagtttaccatagattctacagggattttcacagcaggaaatactaatggaacagagtggaacgatggctgaattgatgggagatagatgataagtcacggtgtcatgactacttgatcatgtagaagagtagcaaagagaggtatgtgaagagacagggaaagaaaagaacatagccctgagtgaatgctaatctagaggcaaatgttgtcatttacattttactctaaaaagagaacttattaaaaataaaaatacagctcattgctgaaaaaatttgtttcaaaaagcagcattatttttctttaagctactcttcagagacctgttattttaaggacaacgtaaaatctcatgtaatgattgtataaagatatagacatataatgtgtcatatatatgttaatatatatgataattggttctagtctgctcaaattacccatttactatttagtattctggcttaggcaaataaatatatatttacagatttctaaaatattttattactattataatgatgctaattaaatttatctgcagtgcttatctttttccagtaatgctaaataaattatttcatccaacccttataaatatcatatgaagaattgtaacaatgtaggtgccatggagggcagggatatgggtttgattgatttattgctgtatccttagtacctagactagtgcatcactcagagtgtgcactcaagaggtattatttgaatgaatgagttgcatttattatttgtcattgtttttgggcagaatcacagataagttaatatcatagagatagcagttaatatataatacaaccagaatataaacccatgctgtctgatttcatatattgagcatttattctcttcacatttttacctcatttaccataactactttacattttttccttaaatgaagttcatttcatttatattttctcattttactatgaattaaatgtttcatccacatatatcatgataatatccctgatgtgttgacagtcagcgttagcattggcattgctttgtttgagtgatagcactcattttaacccatccatatgttactaccaagtcttacatgtgaacaagattaatcttgaacaaggtgacagagaagacttggacgaactgcaccttggaaccgactgaatttttgtgtgtgaattaacttatgtgctcgaatttaacctgtgaatttgatatgtttatgtcagttacattatgcctaggaagaaaggagataaaaattgggggtgagaggggaagatgtggaaagggagtagaactttaccttcatttttgatgtatcactaaatttttgcccatttaaaatttgttttaaattgggactcatatctatattcaaaatgtcttgcatgctcaccaaaacacccatcaaactctttggcatttttttttcttaattaaaatggattctgcatatatttggagagtttggaatatcatgcaaggacctagtggctctcagcaggaggacagagggcagtgattcactttgcaccactggctcatttactactgaatccctgatgtttctctagatgacttgaaaacaattacagtcagaccacatccctgagtgttgcccctatttaaccctctggtgataggaatgtaaggaaaattttctagcctgaagacattaaatgatgcagtctattgtctgtgtgtcaagaataaacagccacactaagtttttgttcttgatgtgctgccaagtttccctgaggcagacttggcaggctttgtcccaaggagaagaattcacagcctgctgctgagccaggccaggccttccctatgtgaatatccataggaaggctatagctgccagttgtggtggcggtttttgcagaaagctggcttttaaaattttttattgaacttgggaaagttcaaattctagaaaatagaaggaaatgtttcattatagaatgcgaaatatagtttaagttggaatgaaaagatctgaaaacagagtttctgaggaagtctgtggtattagagtcgtatgtgttgcaatgagttgcattcttattcttctcttccactaatggggtgggcagaataatgcctctgtcccaaaagatctctatgtcctaatctctggaactggggacttgttatcttacttgtgaaaaggaacttgcagatatgtttaatgttacagacttttgagatggggagattttcctgaattgcttgggtgtgcccagtctaatcacatgagttcttaaaaagcagagctttcctggccattgttagagatgtgatagtggaagaagtgtcagagaaatgtgacttagctggctttggagatggaggaatgagaccatatgccaaggaaagcgggtggtctctagaagctggaaaatgcaaggatgtatgttcattctccctaaagcatgcagaaaggaaccctctcaaaatctttttttagtgcagtgagacctgtgatggagttctagtttacagaactctaaggtaataaatttgtgttgttttatgagacagggtcttgctttgtggctcaggccagagtgcagtggtgtgatctcagctcactgcaatctctgcaccctgggctcaggtgatcctcccatctcagcctccggagtatctggtactacaggtgcacaccaccgcgcctggctaatttttctatttttagtagagatggggtttctgcacgttgcccaggctgatcttgaactcctgggctcaagccatctgcccacctcagcctcccaaagtgctgggattacaggcatgagtcactgcacctggcctttaatgtgtgtttttaagacactaaattggtaataatttgttcatgacagcaatagaaacttaatacaactagcttttgagttatggcttaatctatgcttcttttaataattttttaaaacaaagattaatcaatcctgatgtttaaaactctggaaatgtccttagtgatttatgcaaaaagataacatgttatgttctagagctctttctcaaccagtatagaataacatagtaatatatcacaaagatgtcatttattcagtcattagaatttattgagcttattgcactccaggacttatgatatataaagaaaaatggcaacatcactttcctttaagaatctcttgacccaatggaggagacaatttaatccaattcaatgaatatttatttcacatgggagtggctgcctgatacatatttgagatagttttctattgctgtataacaagttaccacaaaatttgtggcttaagactacatacatttattatcttagagctcctaaggatgattgcttagctagcctctctgatcagggtatcacaaggttgtaatcaaaatttagccaggctgcattgttttttaaagttcaaggtcctcatccaaacccacctggtttttggcaaaattcagttccttgcttttgcagaagtaaggtccttaactccttgaggccacccacaggtttttgcacatagatctcctcattggctctttaaaatgtggttgtttgcttcttcaaggctagtagagtctctcacttcaatctgctgagatggggtctcatataatcataatcttggtattgacataccatcacttttatatttttctgttgcttaaaagcaagccacatgttccacctgcactcaagaggaggagttatacaagagcatgactcattaagggtcacctaagagtgtgtcagccatgacccatacacatttttaggtagatcattttcacgatgatgtagaggatacattaaagacagagaaaagaaaatgagactttttttctgttataggtaagaaatgatgagagcctataaattaagacaggggttagaaatgacattatccgatctaaaaggtatttgggagaaagaaaggacctgatgataaaaattgatttgtggcttgattggtagatatatgacttggcaaatgggggaaagaaatagcattgactgatcaaggtaagagagaatcagcaatcagatttggagagtaatgaattccttttttttaaaataaatggcacacttatctcctcttttgacctactatgcatgagagtctaaattgatcacttaaaatacattatttcattaaaaccacacagcaacccaatgaaaatcattatccccattttacagttgtgtaaactgaggctttgagacattaaatgcttgcttaggatggcaaagctagtaggaacaataattaaattcaagctcagttccatctcacatcaagttgaagatttggtggactattcagacagataagtcaaagagggtgttatagagagcactgtgctggagctggagatctgggagtcattagcaatgtgggtgatagctgaatccatgaaaatgcttgaagtcactctaggagaccatgcagataaggaatttaactcttggagctcatttaaggggtgggaaaataaagaatatttaccaagaaaatggagagtgatcatacaagtaacaggagaataaaagaatgtgatattgtggtggccttgagaacaaacactaaaaggaaggaagatgcggtggtcaagatcatcagatgtggcactgttatagctgagtgccctggtagtaggttattttcctcatcctatcttcttacatgctagtaacatttgccaggagaataaccattccagatggaaagacctgagacatgaacagaaagaagtaggaagaggttaacaatgcaagtaaatgggttgtttgatgaccacattctgagaggaaagatgttttccttacccaggcacctagaaatgtagatagatattcaaggccagtttatgtatgtggtttaaactttgaaaactaacacagaagaacctatcttatgataaaaaatggtgcaagaaaacaggttgagtgaccatacaattcatgaatcccagatgagtaattcttctccccaaacagtaaaggattaaatagagaagattagccccgaatttacatctttggacatgtagttgttgtatcctttgtaggatcagtaaaaacttacataataaacctgcattattgaaggtgtgtcagtttatctgaaattaaaatataaatagaaacaattcttaatgtaaagaaacaggaatactaaaatgtgatatgtaatttttagtaattcacaaagtcctaaaacattaattttagtgattgctgaggccctatgtgaatattctttagctatatcacaggaaataatggtaataattcattttttgatggattatcacttgagccaataccatattatgggggtttttttaaccctcacagagaaaatttgcttctagaaccagaatatacaaacttattaaacactttttgacacattagatatagcagatatttttatgaggacagacaccttagttgaataaataaagtatgaagtcacatcttaaaagggaacattttgttgttttctgattttttggtatgcttcaattaaatcaaaacataacttagtcactcattatacaatttctagtttagtaaaaccactggccttaagatgtctctttcagctttgtcccagaaatctatttttcaattaacctgcctaaaggtttaactctgaaactttctacagccatgatggatgcaagcatgtgtgtgcacctgtaaaattctatatcaacatatggcagtgtggtatgtagatcaagagatattcccatagtcaccatttctaattttggttgtgacttcaccaaaaccttgtataaaaccaaatacaaggttgggtgcagtggctcacgcctgtactcccagcactttgggaggccgaggtcggtggatcacctgaggtcaggagtttgagaccagcctggccaacatggcaaaaccccgtctctactaaaaatacaaaaattagccaggcgtggtggcacgcatctgtaattccagctactcaggaggctgacacaggagaatcgcttgaacccgggaggtagaggttgcagtgagctgagattgtgccactgtactctagcttgggtgacagagccagacgccgtctaaaaaaaaaaccccaaataaaaaataatttattagaatggtttttagtgtcattcctggatgaaaggttagggaatatattttagcattcaagtttaaatcctgccctctatcacttatcagttatattacattgaggaaattatataacatctctaagcccagttttcttataggagaattttaaagtagactttatagatttactttaaagaccaaatgagataaaatatgtataagcctgagtgtacaacctagcgattagtaagcattcaatagagacatacacacatgtacctatataatatctgttattgaaatcaatcacacatatctatgatatatatcatatatattagtatatagctatgcatttaataagtatttggaatgtttgtcacgtgtccaatactgttctgttcactagaaataagcagtgaacaaaaccaaaaaaagcatctcctttcacagagctcagatacttgtaagcaatacaaatggtaatgaacaatatgcatgcaattattttccagcatcacctacatttgagtacccactatattaggaaaagctgaaagcaaaaacaagaaaatatatttttaaaacttcagtaacatcatagatgaatccgttggtaatatgttggtggcatttctttcatttggaatttgtagataaaagtaaagcactggtgtgtataacaaaagtatataaataatttatgtaacaggtgaagagacaaataaggaaaggcagtttcagactacggggagtaaaattagttataatctgtagaatttacaagaaaggttcacgtaggctcttttctttgatcttgaacaaccttgtcaggtgtgtagggcaaatactatattcagattttataaagaaacagaaaggattatagttggcaggttttactctagtttatactgtttgcaagtgcaaaacgagaatgaataaaatggaaatagaggacattattgcagattctggagaaggtggtatattttattttctttcttttttttttttttgtaatttacttggcagtattgtagggactgccattaactggtctgttaatgagcaattgttatctactcctgagggctattaataactgcaaaaagagaacctttgtagagcacggtcttgtacatatacggtgttcagcatgtgagggaacaatgcaaattagttgtattccttctaacataactgcttttgggcagacgtcatagtggtatcctgatttagtaaagtaatctttgtagatctgcttttgaggatgtatactccatcattttagtaaaaacaggaacatatatttcagtctatagcttcacttaactatgtctcttatattgttattgcctaagatacatatgctcattgtaaaaataatctagaaaataattttttttaaaaaaaggaagaaaagcaattacagtttatattcccttatttgaaaccaaatgtgcctcagaagtatttgaataggaaaaggtaatgtattcatatatattaggtaaaatgacttgcagaaccttggaccacaccctataataatgcacagtactatttctgcagtgaaacagaaatcttcaaaccatgtgtaaaaaaaagcaccaccataaatagcctgagtcagtgcaggtcaggttttatgaccaaattagttcaagtcaggacagattttgccaccaaagaaatttaagaaaaaagaaaacaaacttaagatttttagatttgtagataaaagataatgggcctgcattaaaaatagaatataattccctacttaatacagggattagattgtaaatactgattttttaatactctgtaagatatcacatataggtctgtttggcttttttatttattttttagagtaaatagttttatttttctgtcactaagattttcagaaatgggtcagctttgttcttatttcagcttttatcatgttctcaaatatctgtagtagttccaaaacttctacctacaaaccagttggcactaacaaaaagagaatcataccgggttctcattccttttggagtttccattttgtaccaattcccttcagactaaaaggcatcctttagaatttctccaaatgcaggaggtctgcaggcaacaaaatttccatgcttttattgattgttttcactttttttaaaagagtatttttgtggatatagaattgtgggttcactttgtcttttctttcagcatttaaaaaaatgccattccattatcttcttggcttcccttgtttctcataaaaacttaccaataattacgttccttgttcccatgacaatgtattttttctcttgttcctttcagggatttttctctgtggtttgttttcagcagtttacataaaatatgccagggtttgactcccttaacatttcttcaacttggttattaatgaatccttatatctgtaatgtaatgtttttcatcaaatttgggaagtgtatggccattttttcaagtatttttcttctccaatctctctattcttcttgtgaaactctagtcacatatatgttgaccgtttgataacacacaggccaagagggtctgttcaccttcttcaatctttttccctctgtttttccaattgcataaattctataatctgtcttcaagttcattgacttttttctctttcaactccaatactttaatctgctattaaccccatggagttaatattttatttctgttattatacttttagttctaaaatttccattttgtttggctgatagtctttatttctttaatgaattttcctgtctgttaatttgttgaaaccatgtcttcctttagtttttgaatatatttgttttattatttgaatgtttttatactaattataataactgctttaatgctgttatttgctaagtccagcatctggtttatctcaactttgttcttcttgactcttggtcctgttttctctcttttttatacataatgaattatgttgttgaatcctggaaattatggataatgccctgggcttgagttctgttttcttcctctgaatggtgttcattcttattatagcaagcactttattattagctgatcactttgcacttgtttgaacttgtactactctttgtttgaatgcatatgcttaaagcatgtcactccagttttacaggactcaaactccaaaatctctcccttccacatcttatcagattaggttatgggttttgttagagcaggcctaaattaggtcttcctctggaatacaacacttttaaaatctcagcctttcttgtgtcagctggatgtcagggtttttaacaaggtgttaatgagatctgactgaggcaagaacaacttcatccagcttttctcttccagaattgccaaacctgtaatttatctgaacagtttttgcgagtagcaactgcaatctggtaagcctctggtgctctcatcctgcatatatagcccaggactcaaccagagactcacagagtgtttccacgtgaatttctgaaacccactttctggacacctcccttgctctgacactctgtaccacagaattgatttctttctgctgccccacattttcatatctgcctcctcatcttagtgggaccaccatgcttaaacacaagctctctgaacctctgttgagattgttcccagacagaaagtgtggaatgatcatgaatattagcttgtgagtatcctttcttctagtcttgcactgcctgttatctgttacctaaaaagaatggcctcatacattttgtccagttttttcatttgcttgctgcaggaaagtactctagtatcaattactccatcatggttaatggtcatattgccctccagaagattttcctgattacgtttctaccaaaagtgtttgaaaatttctatttccttgtttctatgccaactctgggctttatcattcattttgctgaagatcattatttttacaatttcataaatcgtatatactctaattttcaaaacatatgaaaattctttattataattctgcttgaagacttcccctgaatattttaatatattgcaagtaagtcaataatttaatatagtggtagaaaatgtgttattttagctaaaaatagaaaaaaaattgtaacatttctattttaaaaactaatttgttagctttctctttgattaaatgcagacaactaccaagaaatgaaataggtttaaaaaattatactgtttttctctcacgattctttaatgtttgagcaaacacatgtttcttctctaaagcttatttaatatgcagcacctccaaacattatgtctgtggtgtgatgtgggagccagcatctgtatttttagtaaactcccaaggtgactttgagtgaggtaatctgaaagccagactctgagaaactgtttgtataattgaacatgactctaggtgctaaggagccaagtgaaattaatggtatcagcaaataaacttgaaaggcactgagtacactattttcctcataatgcaacaaagtattttaacttttgtgaaaggctctgcaggaaaaaaataaaacaaacaaaaaaaaaaacatgtttaacctagtttaacccagtacttccaaatttatatgaccctataaactctttagcatcaacactcttgggaagatgattagatggcttttgttgagacagcctttctaagggcctcccctcaaatacagacacttgagatgccctcgatgaccaactggggctctaatacccccagggctgaggctgaaggtgtcaacattacagctttccaattaccaattcaaagcttaccatgtgagaaaccctgctaaacgtgagaaattgtgctaaataagtcagtttagaaatacttcatattttttgtaacaaggcatacacatgcacagaatgctaccttttaaaagtagattcagtgaactaataaagattttataaactcatgattcagttttattctgaaatgttaaaactcactattaaaagattttagcagcagtttgattacctaacaggaaaataaatgtattaggaatgggtattttaacataaaataaggcagccaattatcagtatgtaattatagaaattaataattgatgtgtctagtcatacctccctcatctctattaagcattcatttgccaagcaaatattttgcagttctttcttgggctttcaaagtatgtttcctcattttaataagcaagttgtctcagaaaattattaaaaaggaagagatgccttttagtaaatatggtgattttatcttttataatagtactttaaattaatactagaactaatcattttgcagtaatttacccctaatatcgtgtacggggctgcctaggctgacacctaggagcaagaagagcacaggaacttgtgtgactgtgggtgacacacccatgaagctggccctgactagaatacatttataggttagcaaccaggaggaagggactggccagatctcattaaggaggcagtgttcccccaaatccctcagaagcgcaggggaaagcagacagtttggcacatgagtttccagggaaacccccttaggactgtttacataagactcaggagatagatatacaaatgactattccaatgacctgcttagtagtgagctgtgtttgatcactcgcatgaggcagccaacacttactgtacttataaatgcaagctgatttcttggctagagacagtggaaaggtttaaggataattgctgtgctcccttatattagaaaaaaattagatagtataaaataaggcaggaaggaagactgtctaggaaattttctttaatgatttaataaaacaaaagaaaataaaaatatctcatatggattgatgagtctgctgtgttacctttgtgcatagagttgcattatgcaaatgactttgcagatttgtcttgcttattcccacagtgctttaatgtatttagagtatctctattatctgtacctcacagaagagaaaattgagggccagtcaaagaaagtgactacaattgtgtcaaaagtgtactcagcgatggagctaaaactaaaacataacttccatttactgagaacgttattgatgtgccagacaccatgctaagcaatttccatgtcttacttgtttaatttttattagtcagagctctttcaactgaaagtgaccacacaccttactcagactacttaaaacaaaataactgttttcttcgtttaactgagaaatccagaacacagcctcagacatagctgaatttgtgctaagatgatgtggtcaggaacttacttcacaacctttcagttttacttcctctgcattgcttgttctcaaatggagtctgtatgtggtagcaagaatggctccagcacctccagatttacaagcttgaatgctcctgatttcagaaagaagaagaggctcacttacctcattcccaggaagggcagggccctcactcttttctaggtcagttcctttgtgaatcacaggggcaagggtatgctcttattggccaggcttacatcatgtgggcctccctggagccggaagagaggtaaaccattccttaaccaggtagactgaaaatgaggtaggtggtgtttccgaaagatgtgtcagggtgttagtgccaaaagaagggaagtgattctggctaggctttagccttagcttaatggatttttagatagccattatgaaaagcatggttattatttacgttttacacaatagcaaagtgaggtttaaagaaaaaaagaagtgacagcttcgctgtaaccatatcatagacatggtgccttccccaaggatataaaagcaatagtccaattctgcagaacactaaaaaggatttatagttgtgaatacattcagggaataccattctcaccacccccagaaggaaaacatttgataagtatattatcatcttcaaacgaaagggcatgcagatggctttatgtggacataagtaattgggagttttatggccattctggaatgcctgtctctcaatgactaacattttaatgggaacacacttactactcagaaaaccataaattctagattctgaactcttgagtccaatgcctatgtatgtttgcatccatactgcccaactcactcagtactttcttgttgaatcaatgagtgaaaatggatagaacacaacttaagactacttacttaattattagtaaatgatacagcgcaaggatacctcagaagtattcctcatacagggaactcattaccatcaagaccaaaaataacaaaggaaaagagaaatgactaaaagtggtattgtaacttttactgcaaatggataaaaagcagcttttgtattgtggttttttttttttttttttttttttgggggggggacagagtcttgctctatcccccaggctggagtgcagtgacactatctcagcttattgcaacttccgcctcccaggttcgagcgattctcatgcctcagcctcttcagtaactggatttacaggcgcctgcccccatgcccagctaattttttgcatttttagtagagacagggtttcgccatgttggccaggctggtctctaactcctgaccttaggtgatctgcccatcttggcctccaaagggctgggattacaggcgtgagccactgtgcccggcctgcattatctttttattagctcatctttatagcccttctttgtgtaatatttttaaaatggtatgcataaagtatgtttgttgtgagccttgtcagaaaatggggatttctgtaaaattttgctctcatagtaagtgaaaacattggggaatatggagtcagttgtctcatttgagagtacttatttcttttcagagctgatagttttatctatcagaacctttctaagcaaaacctgtttttatgcagttttatttggagctgtgttatacacagcctctactcagtctcttttcatagggcaactgtagttaagagtaatttattgtatattttaaaataactaaaagagtggaattggaatgttcctaacacaaagaaatgataaatgcctaagataatgagtaccccagttaccttgatttgatcattacacattgtatatctttatcaaaataccacatgtacctcataaatagtacaactattatatatccataatgattaaagataaaaaaatttaaagagttgcaaacaagaaagaatgtagattatgctgtcacatagaatggtagtgattcttacaaactgcagcagggaaccataaaactgttaagacttgttaaaaaaatgctttctatgataacatgctcatataacaaagattttacatctgtattcttctgagttttctctccttcatgcctacaaattaattcaacaaatattcaacaggaacgtatatgcacacacatgcctgtggtcattgacacacacacacacacacacaaatcttgccctagctatcacagtttcatggctttcagatcaagtgttttggtatgttgtatttccctagaagtttccactgctaattccaataggttgttaatagaaattaaggaacacctccaaccacatgcatccattttcagttgtgacaggtctctgcacagcatccccatccccaaatgttttttcacttctaatctttacttgtattatttatctcccaagaaaatcatctaagttgttatcggggtaattcttttttttttttttttagacggagtctcgctctgtcgcccaggctggagtgcagtggcgcgatcttggctcactgcaagctccgcctcccaggttcacaccattctcctgcctcagcctcccgcgtagctaggactacaggcgcctgccagcacgcctggctaattttttgtattttttagtagagacggggtttcactgtgttagccaggatggtctcgatctcctgacctcgtgatccgcccacctcggcctcccaaagtgctgggattacaggcgtgagccaccacgcccggctatcagaggtaattctaaggaagcggctgcaaagcagatatttcagagccttttaattaaaactagagcctgcaaatctttgggatgattattattttcactttttttgagtgtggcttaagaagtgaattttaaattacagagtatgctttgcaacttctaagattatgtgcttatactttgtatccttacaaatttcaggcattattctggcaaactctgtcttgctcttttgtataaacattatttttaatttagtggatttttatttttcagtttgctgtgttttaaagttgagtttattttttattaagaattactttgactctttcagttggattcataaaacacaaactataaacatgagataaaatcttttatgtcagagtaactcgtgcctgtggaatagaagccaacttgagatgtgagatttgaaatttatagtattactcactaaatgatttctggttgtaaagtcctgtacaattcagttcaagttaattcttcttatgacattttcagtagaatttaaaaatgtgcattatgttgatgataatgcatatttacaaattataaatttagttataatttaaaagaagaataacttgatatttatgatccaactcactagttaataaaaacattttaagtaaatatatttttactttgccagattactcacaaatttgctttaacccccacattgctaaatctaaactagtgtcttttaaacctaaaatttatgtgattggtagagtggcatgattatatgcataatgtttacatgacttgtgaaaccatttataaatcttgacataaatattatttcctgtattcttatatttattttggcatctcaatttttggctatctgtaattgggacatatgagtaaatttctgatttgattcagcttatttggatcatctaatttcaaaatttcctctacattttgagatatccaaagaaacatattgccaacttgttactggcagcaaatttgtatgggtctgcagcaacctaagttcctgcctcctcagaataaggaacttgaccaaggggcctaaggcggagtgagagaccaacgcaagttttagagcaggagtaaaagcttattaaaaagctttagagcaggaatggaaggaagaaaaatacagttgtgcgacttgagagatcaagtttgcagttttgacctttgacttagggtgttacaggttctcatacttctggggtcttggactccttctcccctgattcctgccttggggtgagctgtccgcaggcatggtggcctgccagcacgtgggaggagagcatgcgcagtgtgtttactggagttgtgcccatgctcacttgaggcgtttttcccttaccagtctagcattcctaaaggaaggtcatataccagtaaaactctcccattttgcctgttaatggacatgcttgagctcactcactcagctcctgagatcttactgggaagctgctgatcaccagtttcaggtgtttccatctactgggagactgtgtttccctggcactgttaacggtggagggtgtccggttcttggcgtcttgaggaaagaattggacaaaacacacaaacaaagcaaggaaggaatgaagggttttattgaaaatgaaagtacactccacattgtgggagcaggcctgagcatagggtctcaaaggccccgttacagaattttttggagtttaaataccctctatttggggtacaccctatgtaaaggaagaagatgaagtaaagttacaaagtcatttacccggcgtatgcctgcggagaggatatttcctgtcatagctgaagtttgaatcggctttatgttccctgcctccataccctgttttcctgcctcagcaccagctgcaaccagttattattttagagagacatgacatgtgataactgcctgaccatcacctgttggtcgcctgacattactggttgggggtgggggactctgctcacctattcatgtctgactagctatgtactgtaacaaactgacaaataaaattgtgtaaatagtagaacttttctatgaataggtgtccacacctgaaataaaatcagttgtgtttcttttttgaagatgattttgaatggtgagtgaaacatttcaccatgtcgaaagtccatcacagttacagaccaaatgtgaattttccaatcctagtgacttatacagttattataaaaattcatttgcagtcatctttcttcagataatgaaatcattgttttaatgttaacaaaatgagattgtcactttataatgttggtgtggaggagaaagtaatattaatgatcaaacttaaacttatgtattggctggttacattggctcaccacgcctgtaataccagcactttgggaggccaaggtgggcgcatcatgagatcaggagattgagaccatcctggctaacatggtgaaacccccgtctctactaaaaatacaaaaaattagccaggcgtggtggcgggcacctgtaatcccagatacccgggaggctgcagcagaacaatcgcttgaacccggaaggtggaggttgcagtgacccaagatcacgccactgcactccagcctgggcaagagagcaagacactgtctcaaacaaacaaaacaaaacaaaacaaaacaaaaaaaacttatgtattgtattataagaatacacatttggttccgaacttttgacttaacattctttccttctctcatagttgtagctacacccaatatgtgcaaaatataagatattcatattagttccccttgaattgtatgtgtttcaatttttatgagatttggaatacattcagcacatggcagtggcttaatacatacaatgttttttgattactaaatacttatgtaaataatggtccaagtcagtagtcctatgtctaaatagctttcttttaaaaagtattgtaacatctcatttcttctttttttaatttagatcggggtactgtgcaaaaagtggttgttcttcctactaacaactctgtcagtggcgagctcattctggaggagctggaagtctttaaggtttgaacatctcttctattaatctcagaacatgcatgatgagtggaattctttaatcttacagccacttgggaggaaactatatttgataaaagatcaaataaatgaatgttatgaatttttgagggtaggaaaacaccagataaaataagaaatacagaacaaatatttttgcaaagtattttcctacatttcaagttatcttaagataaaaggattctttctgtttttaagctatcatcacaacttgaagaattgtggtcatcattatttttaaaaaatgagttctagttgtcaaggtctggaagattttgccatgaaagggcttttatcatttgcttcacaagccactgaaacccaaatactttcacattattgattgttagataagctttcttatatttttttagccagtaatttcaagaaaaacgactttgttttctcttattttattgcctttaattcaaatgtcacttcagttaaataaaacaaatgttgtctctttaccactcagaacttgagatttcattgtattattctccttgtccttgaatttgggataaaaaaagaaaaaaaggacagaaaaaaaaacatacacaagggaagttcagtactgtaagatctcacctggtcagggcagagtgcatgttctttatgtatctgtgagccaggagaggggatttgtggtgtcctgctgtgcccttctctactcacagtgtcagtcactgtagttcaagtggtgctttttatctgcatttggaaagatgggtaaagcgcagcagaggagctattagaattgcaaagaaagtttggcatggaatcagtcctgctgcagaacactatttccaactaaaccaattaagaaacaatggcccagacacaacaaaagaccagagtcagcctatgactgagtaaaagtagcacttgagaactcccagtagcagactcttgctagtccagcaagttgctttgcttagttgagtagacttagaatgtattgactcattagtagacattcccacggtcaccaaaaatactgactttataagcacgtaagtgggtagggtgcagtgctgttagatttaggtaatacattttaaatgtaaagaaatataaaatagaatcaaataaatttgaggaactctggcaagtttcctactatattattaaatttgtaatttttaatgctagactaactttggcacaggttctttgtgattggtgtgttaaaatcgggctcataaaatgacgtcaatgatattcagacaagtgctttttcatgccttgttttataaagaaattgattatttcactagattaaccagaatcacattatatagaacatattttttttctcattcaactcagtagggagaacttggcttgctaaaataatacgaagtgccttattctggagtattcttgaagatagcaaaaatgtcatatagcagcacttcatttttaatactgaaatatctccttttgattatcaggaaatgttaattaagtgagcatgacataaacctaaacatacatgttatggaaagaaacatgagttagtctgatcacatgctaactacttatggtctgtcatatgagttatgctggtgttatcatcttgaataataaactctcagtggaaaaacagagtcagtcagaatgcacgtgggggacatcagcccatgagacaccaaaaaaagtctgagttttcttactgatgtgtgtgccagtgattgatatggccaagtcaggaaacacagttactgaatacagttactgtcttcagcatggtgtttgtgtcacatttctgaggtgaggtaaaaataattgggtgtgtatgatacactgtcatgagcatgtgaggaaataatgcatttaaattgaaaagttttcttagctaagtgtcacactgatgtactgcagaaaattcaatgtgactttgaaaaaccaggagctttgtttttatacagtgcaggaccataatctcttcttttagtcctctgttccacattttctgacaataagtctagttccgctgagtttaactagaattagaagtataactactagtagctgcctaactgattataggttgcagcatttgtatgtgtgtgtgcatgtgtgtgtacatatttataagggatgatcaaaaattgtcacaatggagaattaaagatatcactgttttcccttttaaaatgttggtaaatacatgcagctccagaaaacaaaataacgggggtacatttgattttgagagcttgttgccacttgagttattcaaataaagctcatgaatcttaatcactttaccagaagtctaattattattattattttttgaaatgggtttcactcttgttacccaggctggagtgccgtggcacagtcttggctcactgcaacctctgcctcctgggttcaagcaattctcctgccttatccttctgagtagctgggattacaggcatgcgccaccatactcagctaattttgtagtagagacagggtttcactattttggccaggctggtctcgaactcctgacctcagggtgatccgcccgcctcagcctcccaaagtgctgggattacaggcgtgagccactgcaccccaccagaagtctaatttttaatcattaaaagtaactaataatttttaagaagtgaagttatgaataatttgcaagcatagtactattccagaaaattcttaggttctttcattcattcacattttatcaaaagagaaccttttctaacaatatttttttgtttgcaacaatgagtattaactagtatggttcagcctaatatattgtctttccgaaacagcactggcaggtgaacaatagtgtcttatgcagagtgcttgtgttgcggaggaattagatggtgtaccattccacatctttctccacctgagtccgtggatccaattctgaattatttgtcggattgaatattccaaaaatttccttctcagattttcattttttgttctaatgcctatattgatacatgtgttttaattaccactcttttttttttttttttttttttattgagacggagttttgctcttgttgcccaggctggagtgcaatggtgcaatctcggctcactacaaccttcgcctcccaggttcaagcaattctcctgcctcagcctcctgagtagctgggattacaggtgcccaccaccatgcccggctaatttttgtatttttagtagagctggggtttcaccatgttggcgaggctggtctcaaattttaggtatatatctgtgtaacaactctatccttagtttctaaagaggaagtgtactttatagacaagtatatgcaaatgtattttatataacaagtaattttaaagtagatgtatatataaagaaaagtgatttcttcttgagatttaatagaaaaaaaatctgaatgtaaaatccttttaagcaatatttgagcaactaacatgttgttttctaatattttagaatcatgctcctataacaacaatgaaaatttcatctaaaaaggtaaaaactaagctattttatgttctttgcttattgaaatgttttgttgttatgaaaaattatattttataacttctgaataattagttatcgtactaacaaaataaagagtactacttaaagtataccgcaaagtcacctttaattttgatgtagaacttacaaggtattagtgaaagaccgaataggtttatttttgtataaaagtttgtcggagcagaacatatatacagcaagatattccaacattttgtatatctgattttctcaaatattacggtgtgtgaagccaaccgaaataaaaataatctttctgggaagaatttagcataaagtttgggctactctataacatcacaacattgttagaggcttggaatgagtaatcaatcctgagttcctgctgttgtcacatatttgaaatgcacagtgtattcttttatgcttatttttaaggaaatattatttcctaggatttaaacatgtcaaaaaaaagaaaagtctcaaatttaagggttcaggaattggaaaagaaatatttgattgtaattgaaatcctcaaattaattgtctgatttgtccctacacatgtaaatatacaatgatcattgaaataaaaagtacaattccaatatatacatgagcaaaccatgtacctctccatttccaaaaggtattatttaaaaaacaaattttaaggtacagagtaatatagtgagaatggagtaggcttccaaataggcttggcatgcatttgcatcccaatctgaccataatgtacaaacaaatcatgtaacttcactgacctgagtttctacatttgtaaggtaatgctcttctcacaaacaagttaatttatataaattacctagaataaagtggatcctcagtaaatgctgtctgtaaaagcctgagacctatttttcttggaatacacagtaaaggttttatgtgttagcacaaccgattacatgattctggagctcttcaccatatttggtttgttacagatgaagtggtattttatagtcagtcttacactcttttgacatcactgaattttatgagggaaaataaataaggtacaatggagctaacgatctcatctgtaaaaatgtttgtatggtgcataacaaacattttcccaagtaacgagaagccattcgtcattttgtctaatgtcctagggagtggatctcaagtcaggattgtctttgaagtcagcagggaagccctttgtttacagtagttaatggaaagagaaagtagcagggcaggattcaaaatggacacaaagccatttgtgtggcatagtaatcctgtatgcaagttttaactatatttagttatgtattacatctgtcttcaacgtcttaaattgtagataatttaaaatgtctcattaaaacagtgagattcaaggcaaggataattatttgactttttggaaatcatttgtacaactgcatactgcatcatttttttcagtgcgagaggactacaaattgttaatgacatcttatgtgtatttaaataactttctcagtgtttcccattttattatccatcttatgctctcttattttttaatttgttcttttactccatgtaacagaaaatagtacgcttaataaaaagtatactatctagaatgaaactacctgtgtcctacactcaaatatactagtatccttaaagtattttaatgaagctgataaatttgctgtattatttactaatttactcgataaacatttatttcaaatgtgcctggacaaatggttattgtgaaaacacgcagttgttttcttgtagtttgaatgtttcaactggagatcagtcaatttcagcacaatttctgaaaagtcaattgatgtgaataaaattattagatgtagtagagtgagatgtgattcaaataattgattagaattgaaaacatgtattgctagtttaactggtattttactgtactttttaccattaattaacattcattgagcaacttgtgagccagaaactattccaagcattttatgtggaggaaaaccttacaacatttatttcttacaaaaactccatatggtaagtgctgtgttatcctaattttactagtgaggaggctgtgattcagaaaagttacacagcaaatttgtaggtgagctgagatttgaatctaggaagtctggttccagagtttcagagcctggcgggcccatggtgtctccagagatttaatttttaaatgtatatgtatgtgcatgtgtgtgtatctgtacatggaggagtacacacacacccatacaactgcatcaggtttcagcttacagattctgtgctaacttgagttatatcagtcctttggaaagtaaggagtatcaattagagactcattccttcagctcctgagaaccatattatgcacagctaaaggaatcaaaccattatcttggaagcagtagacatcctacaattgaaggaggatgaaatcttcatccatgaggtttttaggatgatgaagatcagtggatcaagcagaattttaagacgtttaaatataaataccgatattattctaaataattatttttaagtagttttaatgagtaacatgcaactttcaaaggcatgtgaccaaaatattcttttttatttcatccagtacttactatttaccattttttccttctaaacttaaaatgccctttattttaaaccagactttctcaaatttacaaagtaacgtgttgccccacttgaaaaataagaatgcttccttgtgctttgctaagatacagcattcaaagaaaaaaagtcataacttaaatctgtaatatgttagctccaatctgagagaacaatgaatcccaatgtctaaaacacattaccattctatatggtgctttgagcttttcttttttaacagaaaagtggtaatgctataggcatattaatgtaggaaaattctatttattttggcttcatacccttctgtgctttgcttcatgtttttaatcggttccaaaatgaatccaagggtttgtgggcatatattataatgtgttcctgctgaaagtcttcttttaacttccacatctgaaataaatcatcatcattcctttaatagcaacagttgtatgtgagttccaatgaaggggtttcccaggtatctctgcaccgctgccacatctatggtacagcctgtgctgactgctgcctggcgcgggacccttattgcgcctgggatggccattcctgttccagattctacccaactgggaaacggtgagcactaaacactcggctcaacatccaaatgtaggacaccagacaatacagaagtgtttcacatctttagaattagttctattgctgtttccttaaatgacattaaaggtagaagctatgtttaacaccacacatagtctttgaatgaagaaaatggtaatgtgttataacttgagattctcacagatatggtaaatccagagtacagtactttggaaagagtcctttctcccttcaaagctcctctgtaacacctactcccctaggactcatcaaatatttcaagtagcatttagctttttgcattttttgtatcacctaatttatatctttttaattttatttattatttatttatttttgagatgaagtctcgctctgtcacccaggctggagtgcaatggtgcgatcttggctcactgcaacctctgcctcctgggttcaagcaatcctctgcctcagcctcccgagtagctgggattacaggtgcccaccactatgcccagctcatttttgtatttttagtagatggggtttcaccatcttggccaggctggccttgaactcctgacctcgtgatccacctgccttggcctcccaaagtgctgggattacaggcgtgagccaccgctcccggccgtcttttttattttatatgctttagtgtagccttaaaacccaccttcctaggatttctctacattgcttaattatcttgtaaacaaggatacaatataattatcttataatgctggttctagttcaagctacaggagtattatttcagcatggataccttgatttgctttcaaaaccttgatgaccatgctttatccttggagtggtgagtgcatgattactggttaggttaagaaagaaagtcagtctgaggcagggtactttttatccaagtagaattctaggtgggaaactgcatcgacttgtaccaagttggaaggaaccatgagtagagaaattgaaaaggaatatgcagaattcagagtcaaccaaggtcataggtattttcagtcatacagtgacataggtcatgatggtgacaaggctaaaacctttgaaaattagggttagcagagggagcaaatagtagcagccatgagcaccaatgatctttcaagtaaagcactggggtgatggtgctttatggtttttattctctacattcctttgaggaccttgacagattgtaacaaccctagagcttttgtgtattaaaagtattctgatcctcttattcattagttcaacaaatattttcactggaaatatattttccaggcattgttttagaagctaggcatataacaggaaaaaagacaaaaatctctgtcttcagggataatgcattctaaagagaaaagatcgataataaataaataaggaaaacctctggtatatcaaataataacacgatctgtgaatttaaaaagggcagagaaggtaggtacaataagtggtaagcaggaggtcgtgatgttaaatgggtgggtgtcagaaagggcgttactgcggacatactgtgtgagcaaggacttcatgtggaatggcaccaagacgttatctagcagaataacattccaggaagagggaccagaaatctctaatactggagtatgtcaggattgctcaagaaacagccctaaagctagtgaggctgccctgaaatgagaaaaggaacgataggaagaaatgaggtcagaatgccacatgatgtcagactttgtaagtaattgaaaagtttttatttaaagtgaaatggaaaacagctgaggagctgtgaccatgtgaatgatactgtttggctttggtttcaaaagataactggttggatttggcttgcattgaagccctggggtaggaagaggttggaggcagaagggaaggggtggcagaagctgcatgacaggaggctactgtcttcgtctaggtgagatataatggtggcttgtagagggataataaaggaagaggtggcaaaaaaaaaatggtctgatgcttgacagctcacagaatctattgatatatttggatgtgggaggttagagaaatagaggagtcaaaaatgatccaagttgtcagaactgaacattaggatttatgtagatgtcacttcctgagaaagaagagactgtgaaaggagcaggtttgtgaggaaaaagaggatgttacatgaatggtatctataagatgttcacacacggatattgagtaggcagttagaaatatgaatctggagtagagaggagtggcctgggctggatcacttgagagtcttaatggcatgagataggaagagaactcccactctttaaaccaggagtctcgtagatgcgttccaagactgtgttcctccatgttaatttgggcgctagtgaggaggtccctgacttcttttgatgtctatctagaatttctagacatcattactctgtgatctttcatcttaatatggggctggaggcctaaacctggacagtgtgagggaggcaaatttcaaatgtaatctcacataagtgatttttgtggccactgttggtatttttcaaccatatttgtttttcactgccaaatatgatagtagtgatattagattagcatagctcttagtaaggtgatactatttacttagcaagatgttctaaaaatttgcctctctaacacctgcaatataatcttcaatctattaagcagatatagtactgaaggaagctgaagcactataccttccaaggaagaaagggatatagggactataaatggacttttaccatagttgtataggtataccagttattatataatgtaaggaaactggacatcagtactccttctcagcaaagacttgttttgaccaacaagcatttttgtataacaaataatatttctcaagtaaaagtccatactgtatatagactgtcattgcatactagatatacttttttacattttagaagtttatgctcaatatgggctagctcatttgtttgcatgttttcccacctattacaaccccaggtatcctttctaagatgtgtgcttaaatatacattgtcattctaccaccacaaattataattttaatcatacttttttaataaacaaagaaatgagtctatcatgcagttctttgcatttacaatatcatgcctgatattaaactatgaataatggatagagaaggaaagtagtagctatttaaagagttatcttggctaggtgcagtggcttatgcctgtagtcccagcactttgggaggccgaagcaggcagatcacttgaggtcaggagtttaagaccagcctagccaacatggcaaaaccccatctctactaaaaatacaaaaaaaaaaaaaacaaaaaaaaacaattcgccaggcatggtggcaggcatctgtaatcccagatacttgggaggctgaggcaggagaatcatttgaacccttgtggcggagattgcagtgagctgagatcgcgccattgcactctagcctgggagacagagtgagactctgtctaaaacaacaacaacaacaacaacaaacagctatcttgattatctccagcagtgccttaattctgtcatgaaaagcctgaaaatgctacatatataaaaaatatgcctgagcctacccgtatttatctttgactagcatattggaagtttcactaaaaatatctacggtatttacattctccaaattatgtcctaacttagttaagcaagtatttatagtaaatacaaaacatgttagtgaatgaattaactattttgtaaattcccatatgagtttttcattttcctttgaagataatggatttggagtacttttccacatttattttctttagtagtgttaatttacctagttttgtgctgatgccactctctaagcaaaacacgaagatcacttagaggatttcatagaaataaaaagcaaaaaactattttctttgtgtacaaacagagaaatacagttatacttggaaattggtggaatccatactttgacataatgaagttggtaaatatcattggctcaatagtctccgtttttaaaaaaaactatagtaaacatgccgggcgcagtggcccacacctgtaatcccagcactttgcgaggccgaggcaggcggattgcctgaggtcaggagttggagagcagcctgaccaacatggtgaaaccccgtctctactaaaaatacaaaattagccgggcatggtggcgcatgcctgtaatcccaactactcaggaggctgaggcaggggagtcgcttgaacctgggaggcggagattgcagcgagccgagattgcaccactgcactccagcctgggcaataagagtgaaactctgtctcaaaaaacaaacaaacaaacaaacaaacaaaactctagtaaacaataaaagcatttttttcattttcactctcaagtctcttaaatatttgtggatttgtatcaaatattgcagtatagtctctaacagtatttgttctggattcagacaagtagttagaaactttattaagacaagataatcagaccaattttcaaataaatgtcttttctataaaaaatgatttcattgtttatccaaaagaatttactgttgtggatgaaacatgggaaacttgaaccaaattccaagttctacatgcaatacaatattactctgcctaccagcatgtttttttgatgctatgtgagtgccatggagggaatctacacataaaaaatgctcagatggctgccttgctgatctcatgatttaagccaagccataacaatgtttttttctgcatttcaatgtctagaagctatgtgatactgtaaattgagattgcccagcttgagagtttgtatacatgaataaaccattacatagtgttgatcacaggacaataaatttagccattgtggatgatattgcttgcctagatggctgaaaacgctctcatgatgctcatataatatatactcagaagttggctgtaggaaaataatgctggacttcaaaatatagcaaatgttatgcagtaaaaacttgatatgcgagctattctagaatacactaccatattaatcatatttcctgagatgaaagtggctaacactttcactgttttcgtgtgtacagaaatacacaatcggtacgggtcacgtgactttggaaaaggaatacttaggtggtacaaaattttatacctattctaccataagtagatttctacagtccattgtgtacatgaagtagtgttttctttagctagaaaatgagctttttttcactatcaatgactttgtgattaatttttctttgtaagtttaatatctactgtgtgcttttaatatttctgttcttgctgaatattttatctttaaaagtatgaagaaagacttagcatttaacccaattaagtgatatgctcactcgagtatacttttcggtgttgatagtaagcaatcgatttaggctggtattcacaatatttaaagagtcaccttctgacttttaacaatgtgtgatgctcagaggattgcagctgctctacgtcgacttcttagactacataataccactgaaagtcaggtacttagtgaatctaagactcacgaaattaaataatttgaatacaacttagaacttatttaaataatgaccagtttgcaaatattgtatttttttttttttttttttgagatggagtctcaccctgtgacccaggctggagtgcagtggcgtgatctcagctcaccacaacctccacctcctgggttcaagcgattctcctgcctcagcatcctgaatagctgggaccaccatgctaccatgcaccaccatgcccagctaatttttgtatttttagtagagacggggttttactgtgttggccaggctgatttcaaactcctgacctcatgatccgcccacctcagcctcccaaagtgctgggattacaggcgtgagccaccgcacctggcccaatgtaactaaatttttgaaatgcttaagctaataatacgtaacaactaaatgcaaaggatgaaacttgactggaagctggttaacttaaatccataagagatattttgggaacaactagagaaattttaatatagaatatgcattagattatgttgttaaatatcaatatatttagataattatattgttatgttgaaatattgtcgttgaaaaacacatgctaaagcacttacgggtgaagcattattgtatctgtaacttattttctaaaggctttcataggtgtggatccacagcatatacatgatatatatttgcatgtgagagagaaagaaattaatgtggcaaaatataacaatttgtgaatctaggtataccagtattcattttactcatatctgtacttttctgtagacttgaaattttcaaaataaaaagttggggacaacatgcttattctagtaaatgaaattaactttttattaaatgtccctatttttatctctattgcttgtttcagaaaagttttaatatatctagaaacagaaaacattgacttttgtaagaaacaagtatgtttatttaagacaagctattataaaaaggaaaatgctacggagtttatactttggatgttattgttttagaaaatttaggctgaatttctctaaactaaaaatttacactattaattagagaaggtagcatttactcaggatatgcatgcagcaggcgattcatagccatttcatcatgaatggtagatgggaaaacttactcagattgaaaagcaaagataagtaccccccctcattattgataaattgtataagaaatgtgagatagctgcatcaatcagaactctttttaaaaaattttatgaaagcttagcaataaaaagggtgcaaagtttaaaattacagtgttttaagagtggtgtaattggcagtgataattctcagtcacttttatgtatttctgcacttgcaggaggagccgaagacaagatgtgagacatggaaacccactgactcaatgcagaggatttaatctaaaaggtattaaaagtgagcaatggccaatctcagtgaacagtagcaatgctccgtatcacatttcagtaaggggaaacattgtcatagattcaggcgtttcactttcaaaaatatttattataacaattctgggtatttatatagggtaattaaaacttaaaggctttttgtatgtatactgagaatcgtgtaaaacaaatgtctgggaacacgcatacttcaagtatgttagctggtaggtctttctcgcagatcgtaattacagattttcttagctactattttctttctgaagaaaacctattttccattttaagatttaccactgaagaacccttagaacagcatttttttactgcagtaaatatacataacataaaatttactattttaaccattttaaagtttacagttctgtggcattaagcatatttacattgttgtgcaacatactgccagtcacgtctggatatttttcatcttccccaactgaaactagacccgttaaataccacctaaccattacctcttccctccagcccttagaaaccaccattctacttctttatgaattcttatgaattcaacttctctagatacctcatataggtggaattatacaatatttgtccttttgtgactggcttatttcacttagcctaaagtcttcaaggtccatttatattgtaaaatatattacaattttcttcatgtttaaggatgaattgtattttatcatgtgtgcatatatataatgtgtgtgtgtgtatgtgtgtgtgtgtgtgtgtgtgtgtgtgtatatatatatatatatatatatatatatatatatatatgtacgtatgtatgtaggtaagccatattttgtttatccattcatccatcactggccacttggtttgcttccatcttttggatatagtgagaatcctgctatgaacatgggtgtactatagtgcctgttgacaatcctgctttatgtccctcaattaaactaattccttccttcccattctgacatgaagttaccatgttacaatacttttcctgcctcagtcccaccaagtaaaagtatttccaagcagaccttccttgtggctcgtcaaggtgctacaggtgtgctgtttcaaaaattaacagtgagactcctatttctaatccttttgagtctgtgctttcctttagtaaaaaatggcattctttttactaactattctaactgcaaagagcaaattaagacagattttgcttacttgttccatacatctagttgagggaataaattcaagttaccatttctccatttgctattttataaaagtgtatcagttcccattaatagtagtagttgtcatagtggtaagaataatggcagtggaggtaacatcaaacaaatattgatgctgactttgtgtcagaacctgagctaagtgcttttttatgattatttcactcaatgctcaagaagccatactagagtcttattattcctgctttattagtgaggattctgtccatgtctaagctaccacctggcaatactacatgttttgcctaatttaatactttcgttgagaaacctatgtaaaaatgctataatccatgttttagagaagagtaaaactaaagcacagagacatcaagtaacttgtctgaggttacacagccagtagtagtaaggtcaggattttgccctacgttcctctgattccaaagacagtgttctcaaccactacattccaccaaggccacaatactttctgccctttcccagtgcttacctatttcctctatataacattgagtatggactttaggaatgggataaacctggcttcggtattgcctgacacattcactaaagtgtatttcctcataactcacagcctcagtttgctcagctgtgaaaagctgagaaaatgtggccaggagtattgtaataattaagtcaacaaagtaatattaagaacagttgttggtgtggaataattcttgaataaacatgattttcttatcaacattgccttaattcacagtctttccttccccttacacaaacaaaacgggtgaacaacgtatcctattttgcttgttaaatgattaccactgttttttgctggctgcgatagttgttcacaattttgtataaaaataaacatgtatatagcatttctacaggagaatgtgctctaaattcagttgtgttctttctttctctctcgccttttatttttgcctgctagcatacagaaatgcagctgaaattgtccagtatggagtaaaaaataacaccacttttctggagtgtgcccccaagtctccgcaggcatctatcaagtggctgttacagaaagacaaagacaggaggaaagaggtgagtaaagcagcacagcagcaatccatcagggcttcagagagaacattaaatcactgtccctcagcgaggctcagatcaaaggaaaaaggaaaggcatatgatcatcttttacgtctttgggatgacaagtgccactttccttaaaatcctttgtccttaagaattgatggattaattaggaattctctctgcctgctcacctctgtaacatggtgattgaaacaagagcttgggtgctaagacggtagtattgatgtgaggaaacgttcgtaaaagaaacaagatgtgtgcaaatccagaagccaagttttcacacaacggcacctttgtgtgattcacaagataaaaggaggcttttaaaaaaaagttcagttttcctcagcaagaaattacactgaactataaccttcatgacaaagagcgtttttctgctgtgtggtaatctgtttccattgttttattattcataactcttgtgctttggttaggtaatatatggaatcattgtttatgggagcattgtctgtatttagtgatgtggaaaaagtccttagattttcaaataaaaagacacttactgaaacttttcgtggattagaaagagctgggtttttttaaataagggagacattgtaaaatgacatagggtgataccttgtaaataactaatttcataatattgatgtcatgttgtcctgacaaatgagaagataaaaatatatatgtatatataaagccttagggaagtctaaaatgtaccaccatttgtgcagcataaagttgatggagccaagggggaagtggagccttccgcatttatgtgtattcttctgttgtgggcaatttggttattacatattaagttaattaagggtatgtagactgagtaccaccctaagctgtagaacacagatactgcatcagtgttacggaaataaatgttggtttcatatggaaaaatactctccgactctcagacttgtctacccaaagatcttaggagctgtttaggaaattgtgtgtccctcattactggaatattaaaccataagcagatgactacttgcaggaggaaactgaattatttggaggaaagatgagctagatggacatcagagccccatcattcttctaaagcctaagatgctaacaatacttttagaaagattttaataatgaaaattattatttatttgagatctcttttctttgctgtaaaatctgttatcaaagaagtcttgacatttctagagtcaaattaattttcaattattttgaatggatatggattataataattaccttgcagagcaagctgcattagaagtcataagtgatgatgattactatatacaagtgagttgttaggccagggcaggaacacaaggacgtgaacaatccttccagaaaaagcctatatgtatatatgtgaattgggtaagtaatacttaaacaaggatcaactaaaatgtaattttcttttattcagtagaaagttcaatagaataatatataagtgaatataacatctatgatttaaaataaatacatatgtttgaatatctgccatataaattaatagtaaaatttaaaatggaatgtgttaaggatttattctctctaataatatttccaaagttctgtttcagaatgctcaagaatatggagactcaaatattactattttgactttttttccaatctcaaaaacataagaatgtaataatttaatagtggcataacattagctctaacacaagtatgaaagtctgttttgttcagaatttaagcagagcacaattttacttatttttaagctattaatattttactaaacttattctgatcctttctattttaagaaaacatgcttctcactcatactactgtgtaaacattaatcatttttttaagtaagacaaatgataaaagctcacagagcaaaggcaaatagttcatactaagtagcataaagtgaaaactgaaagccctcctccacttcaatacttattctcacttttaatatctattgaataatactaatacttatggaataaaacttactcagtttttattcccactgcccagagtaaggttcccaagagttatatatttctccaaatatgttctatagttttcctcccctccacacacacacacacacacacacacacaccccacttcaatatcagtacatgtgattccagctcatatttcctggctgcataatattccatcgtatgaatataccttaagtgttttttttcaaagccatctatttgttaggtaatttcttgttttcctcttatcaaaaatacctgcacacatgtgagagtatatagtctaaattcctaaaatgtaattgtgccaaatattatatacatgtttaatggatttaccatattggactcaaaatattttcccaattttgcacaaataggataaaatttcttctttctttaatttctgaatgtgtttatacacaatttgtttttgaggaacatttaaacttagtaaaattaattaatgtcaaaattttgttttcttcctccaagtgattctctcttttctagttctgttctattatcttttaatactatacttgcctttttgtgctttttttgtgcacaaaccaattcatctttgatttagatattattagtaatatcttgtccatttgcacagaactttatcatttaggaaaacatttaacgtgcattatctaattttggttttggtcagatttattttttcttcaatgaaagagtattctagagtatacatgtcaaagaacctcttaccacttaggtttttatctattcattggcagtactacaggtggaactgtgaggaaggtttcaagcatttactgatacccagtaaacaatcattttttccagtaaaacctataaagtaattaaatattaattcatagctttttattacctttccttgtaaagtaaaaccacttagaggacttaaaagatgatgacattccagctaatttttagacattgtttattttgggataattgaaaaaggcccttgataatgttcaaaattctacctctgcttgtgtattttttatttagaagaccattcatttattgaaacaaaacgataaaattcaccctttaattgtggcttcatgttttcactggcgagtattttttataaatataaaagactagaacaccaggatagaatagatattttaaagtatctatgagtttcatttacagatattgactgtgattccaatttcaaaggcaaccaaagttttgtgcttatatatggagaaacatctatccaggggaaagcactttaagctatttttgctgatatggataatatcttcaccctctattagattcaatacccctgtgactgtgacaagatctcccatgtttaaaaaaaaaaaggcaatggaactgaccaaaatttcatgtccactgagaaggatgctaagtagtgctcaatacttttttcccaaatctgtgaaagttgagactattctgtgtatgttggtcataatctaaggaaatataatgttcagtttcagtaactttaatttgtctctcttttaggttaagctgaatgaacgaataatagccacttcacagggactcctgatccgctctgttcagggttctgaccaaggactttatcactgcattgctacagaaaatagtttcaagcagaccatagccaagatcaacttcaaagttttagattcagaaatggtggctgttgtgacggacaaatggtccccatggacctgggccagctctgtgagggctttacccttccacccgaaggacatcatgggggcattcagccactcagaaatgcagatgattaaccaatattgcaaagacactcggcagcaacatcagcagggagatgaatcacagaaaatgagaggggactatggcaagttaaaggccctcatcaatagtcggaaaagtagaaacaggaggaatcagttgccagagtcataatattttcttatgtgggtcttatgcttccattaacaaatgctctgtcttcaatgatcaaattttgagcaaagaaacttgtgctttaccaaggggaattactgaaaaaggtgattactcctgaagtgagttttacacgaactgaaatgagcatgcattttcttgtatgatagtgactagcactagacatgtcatggtcctcatggtgcatataaatatatttaacttaacccagattttatttatatctttattcaccttttcttcaaaatcgatatggtggctgcaaaactagaattgttgcatccctcaattgaatgagggccatatccctgtggtattcctttcctgctttggggctttagaattctaattgtcagtgattttgtatatgaaaacaagttccaaatccacagcttttacgtagtaaaagtcataaatgcatatgacagaatggctatcaaaagaaatagaaaaggaagacagcatttaaagttgtataaaaacatgagttattcataaagagaaaatgatgagtttttatggttccaatgaaatatgttggggtttttttaagattgtaaaaataatcagttactggtatctgtcactgacctttgtttccttattcaggaagataaaaatcagtaacctaccccatgaagatatttggtgggagttatatcagtgaagcagtttggtttatattcttatgttatcaccttccaaacaaaagcacttactttttttggaagttatttattttagactcaaagaatataatctggcactactcagttattactgtttgttctcttattccctagtctgtgtggcaaattaaacaatataagaaggaaaaatttgaagtattagacttctaaataaggtgtgaaatcatcaaaaagaaaaatcaaagtagaaactactaattttttaagaggaatttataacaaatatggctagttttcaacttcagtactcaaattcaatgattcttccttttattaaaaccagtctcagatatcatactgatttttaagtcaacactatatattttatgatcttttcagtgtgatggcaaggtgcttgttatgtctagaaagtaagaaaacaatatgaggagacattctgtctttcaaaaggtaatggtacatacgttcactggtctctaagtgtaaaagtagtaaattttgtgatgaataaaataattatctcctaattgtatgttagaataattttattagaataatttcatactgaaattattttctccaaataaaaattagatggaaaaatgtgaaaaaaattattcatgctctcatatatattttaaaaacactacttttgcttttttatttaccttttaagacattttcatgcttccaggtaaaaacagatattgtaccatgtacctaatccaaatatcatataaacattttatttatagttaataatctatgatgaaggtaattaaagtagattatggcctttttaagtattgcagtctaaaacttcaaaaactaaaatcattgtcaaaattaatatgattattaatcagaatatcagaatatgattcactatttaaactatgataaattatgataatatatgaggaggcctcgctatagcaaaaatagttaaaatgctgacataacaccaaacttcattttttaaaaaatctgttgttccaaatgtgtataattttaaagtaatttctaaagcagtttattataatggtttgcctgcttaaaaggtataattaaacttcttttctcttctacattgacacacagaaatgtgtcaatgtaaagccaaaaccatcttctgtgtttatggccaatctattctcaaagttaaaagtaaaattgtttcagagtcacagttccctttatttcacataagcccaaactgatagacagtaacggtgtttagttttatactatatttgtgctatttaattctttctattttcacaattattaaattgtgtacactttcattacttttaaaaatgtagaaattcttcatgaacataactctgctgaatgtaaaagaaaattttttttcaaaaatgctgttaatgtatactactggtggttgattggttttattttatgtagcttgacaattcagtgacttaatatctattccatttgtattgtacataaaattttctagaaatacacttttttccaaagtgtaagtttgtgaatagattttagcatgatgaaactgtcataatggtgaatgttcaatctgtgtaagaaaacaaactaaatgtagttgtcacactaaaatttaattggatattgatgaaatcattggcctggcaaaataaaacatgttgaattcccca

SEQ ID NO: 202 - DNA, 191303 bp, Homo sapiens
  source 1..191303: mol_type = genomic DNA
agcttcccggctctgccagggctgccggcggctccgcttgctcagccagggctgcggctcagaggaacgcgcgccggtgccccgggttgccgcgccgctggacctcagcctgcatcccgttcccctctccctgaaaaggcaccaggaaaagagagagggagagaagagttcacagcaggtaagtctggtttgggtcacctgctactccagtgggagggtgtgctggagaccgcggtgctaagcggggatagccgggatttgggggtggctgtgggtccgaagtggaggacgagcatggtttgggagataaggaaccgtcctgagacagagaaggctcccgggagcggacagagagtgggcgaaatcggtgcgcagtaatcgcggcgccagcttcagcgcggcccctggggcgcagtcccaccccgcctcagcagctgcggagccttctgacgagcctccgcctggcagcactgcacaaagttttcctcctgagacgcgtccaggaactttgctctctccctggcttcctggttcccccaccacccctcctggtctgggcagcagagagcgtctatgaatgtgtccccggcttccgcaggctgcaggttcatttggagacgctttagtcgggaacatccggggagtacttgaccaaagggcatctgcgccctcgctcgctcctttccttgttggtctgggagaagggaaaggggcaaggaagaaggaagggaagcgtggtggtttttgttgtagcgttttggaagaggaatgggcgacgcctttttcttcgccggggaatcgcgacgttccgtctgatggaagtgtgcatccttttagatttagagggaaagttggagtcaaacagcagccacaaagctggctgtctgaaatgtggttaaggcaaaacactcgggggatctctttgtagtagtgggcttggctcgctttggaaaggccggatttgactcgtgctgggcatttaaccaggagtgcggtccccagggtgtttcctcccggcttctgcccaacgagcctggagttaatgcgttaatgggctaccctggtagcgcacgggccgttttcggcactgtttctccttctctgatgactcgagttcaacctcctgggctgagttgctttgcctccgtcacagtgcaaggagggaagttgacaggaggaggagacgccgcgctgtggcagggagctttgggatccaggggactggaagagagccgcgcgccagcagctggggccgctggtgtccgggattccgagttatggggacaggagttaaatagccgaactttcagcgatttcgcctcgagcgaagcggtaataaaaggcaagcttctgtgcgtggactcttatttcatcaccaaaaccccaccactttccgtttagcttagtgctatttgcacaagcaaaagaagaggggagaagacctaaactttccggtttagcctaaaaagggttctcctgcatgtgtgcgctagcgggggatggcggggtgggggcgcgcagagacgagggggaggatctcctaacagagagggaagggttgaggcggaggtagaggagaggtctgagacatctcctgggtctggtgctgctgctattgtgtaaccatggcaaccgcgggggcaggggtggtcagagccttcccagttctgcacgtggaaagaaaaatgtgaagggcagagaagggagagagccacatgtcatcactccagtgatgccttgccttctcctttttgttctccttttccttctccttttccttctccttttccttcttctctgaggccagatagcaaggaggatgagcaagaagacacacatgtcatcactccaatgatgccctcccttctccttttccttctccgaggccagacagcaaggaggatgagcaagaagatcggggttgggagtgatcagccccagctggccactgctttaacccagtcgggtcttagagtctctgagactcgccccagcggataagacgggtcaggggtgccatcgctgacaggcgcaaagtgatggccctggtcagggagatgggcaatgaccttggctcttggaagggaaaggccaggaaatacaggaaggtgatgtgggacgagataagagtagggtcaagggctgacagacagtaaaacagtactgattcgaattgccaaaatttccaatggaatttgcccaattgtgaaatggaaagttcctagagaagggaagaaacatttatcaaacacctattgtgtttcaggtgctgtgaactttatcacaattaatatcctcaacaatatgatacaagtgtcattattctcttattcttttctttttgaacagaaaagaaaaaaaaaacaaagacataaagatttataaatgggtattgtcccattttggcttttatgttcttaatgaagaaccgtaattcttaaaaaaaaattgtattgctgggggaataagctaggtagttattattttagagatgataataaatgagatgcaaaaatgttgcttgatgtgcccaaatataagctagtaagggcacgaactgagatacgaactgttttacctgggtgtgggtctcctttcagaaacttcaagaaagttgtcatgaccccacttaatgggagggctttctaaggtcagttatgatgctgtatctgtatctgttatcatttacatgtggagaacactcaaaattttaaatgcaattcatggttgagaatgagaatgaaccacatcaaatcgataagcccagaatcgtatgtatgtgatattaatgatctattcatacctacaggtttcattttcctttgtaggaattattagtttctttaacaatgtccgtaaaggaaaaaaaaaagaaaaagaatttatcaaacagaaatcccatggttgtattaagaacatttcctgagattagttaggttttcctcagtctacttattgtcctcatgacctgaatacctaaaaatttacttcgtatttcagtaccattggttcacttttgtagttcactctggttactttcctgttgatgttctgagatgggaggttaagaaaaagtatctggcaatgtaaaatgttttggaattatcgggaaactatcatcaacactagcagaaactaacgataaaagatagaaaagtaattgctgtggctttcttttgcctttcaccagaattgccttcataggtaagtctttactaatgatttgctttatattttgcagaggaaaaatacacaaagaaaaactgaatttgtaatctctcttttatgtgtggggaagactagtaagcgtgggaatgggaattatttttggtggcagggaaggtcaggaatatgaacaactagaaaggcagaggaagcatatcttctactgtttccgacaggctaacagaccggacttcaggtttgaacttgagtcaccaagctgatttactctcacatatttttcttttccaaaactaaaaaggatattgcttggggttgaagttaaattaattcaagaagtttcatagtctccagttattcttcatactgtgctctcaatccattgcatggatatttgttaactatcaaaagggttatcataaaccagaggtgtctctgaagataacttcgggggttggcaagcatctctgtgtctcagtgtctgtttactgtgttaacaaagctactgggctaactcattactatttttattatgcctgtgtaatatcaaattctcaatctcaaggggaagacattctgactggtgctagtttaatgaatattatgtcttcgggttgtttgttataacttcattattttggaaaagcaaatgttgactctgaactttgctgttctgtctgggcggttcaatacattgctgacacatgttccttcagaatcatccttgtcaattaataaataattttcttcatgaacaagagtagccataggcttgttttgaaaagttattattattcttcctctaaacatctggagtggtacagagtacttaagtaaagtagcatttcaacactccataacataatccttgaaaggagaaacaaatattcacatttgtggaataagtcataataacaataataataatgatgatttactatgggcaataacattgatcacattccttcccacctcaaaatgtggttttaaagcaattccctttctccaggaaacatggccaaaatcctttttaatttttatacatttgccatacctgtcaagctaatagtctattttcaaacatttgtattctttactttttctgttgttatgatctcttactaggtaataagaatcttgagggtaggaatttgtcttccctaattttttataccttcatgttgttcaatgctgaacaaattctaaatactattgaagtataaccaattgtttaagtaggtaatagtgatcttgaatctttttattgactgtaaagtcaaattaaagattttggagtttataatttactttccctgagattttagcaaaaagtgttatttctaatattagggctttacccctcataaaaaattgtgagagactgggagttttatgataatgcataacatacaggaatagtgtaatgatcagatcagatagagtatataagaatactaattaaaaattatttaaaaattgtttgtaatttttggaaaggcccaattaataaagatatgtatacacaatctatgtccatgttaattcatcctaaatttaaatacctaaataataactaaaaaaaagataaaagaaaagaagaattcaccataaccaagaaatacgctgataaacaattgcaacacttttgagattattttgaaacttgagtgatattaagattagtagacatttatacataggtaaacacctatacataggtaagtcatgttaaaaagctgacattataatgaagtatactgtttatgtttgcattttaataattttgatgattttcaatccatcattattaatattggatgctttagttccatgttcatgtttcataattttaacagccatcaaccaggtcatctttaactagcatgctaatctttcactggtcagtttattcagtttgctcactcatttgcaaagctcaataagctacaaagattaccttctttttctcccctcctttttccatgctgtactctttggaaggaggtcagcatgcttagcccacacttcaggagtagagagttaggcttctcttccttgtgggcagaatagctacatacattacttgaaattattgtgcatggaagaattgtcttttcctccctacttattaatttattcaatctcttatttatactagcatactatcatggttatttattttatacttgtgttataatcaatactacttaatttaatttatttatttgttactcaaatttttccagctttggcctctgggagctctttcaattggctcctctgtcttttcaatacaactctagcagtgcatgtgtgtgtgtgtgtgtgtgtgtgtgtgtgtgtgtgtgtgtgttgtgagcatgtctttattctttgtcatttcaagatgctgtaggctcaccctgatccagtcctggaatgagccatttctccaaaggtgtctggttctttctattggataacagcattagaaagcaagattggcgtggggtagcatttcacagtggataagcctgaggatccctatctcacgatcttagccaggtaatcaaggtcaatatcaacagtgggttgtaaatcatgttgatagtttatgcttttgatattattgcattaaaatgacaatttacctctgtgatctttcttcccaaactcatatcttcaatctaagcacaagaaaaacatcagataacttacactagagtagcattctacaaaatacctgatcagtaatcttcacacctgtcttcaaaaacaaagaaagtcatcacttctccgcgcaaatgaacgaaaccaaacaaacaaaagcctcaaaataagcaaggaaagtctgagaaactgttacagcatgagaagcctaagcctaaagagatatgagaactaaatgtaatatagtatctgcatgggaccctggaacagagataaaaaatgtcagattaaaacaaagagaatctgaataatgtatggactttgattattgaaaatctgtcattattgattcattaattgtaaaaaatgtccataccatgtaaaatataaataataagaaaaataggatgtggtttatggcagacttatctgtactatttgctcaatgtttctgtaaatttaaaagtattcaaaaaaatgaagtctatcttaaatgttatatttaaattatatagtggaaaactttactaatagtgaaccattctctggtgtcaataagattaatgcatgtattagtcattttcacactgctatgaagacatatccaagattgagtaatttataaaggaaagaggtttagttgactgacagttccacatggctggggaggcctcaggaaacttataatcatagtggaaggggaagcaaacatgtccttcttcacatggcagcaggagagagaagtgcaggggaaagagggaaaaaacacttataaaacccttatgtcttgtgagaactcactcactatcataagaacagcatgggaaaactgctcccatgacctagtcacctcacatgaggtccctctcccaacacatagggattataattcagattacaattcaacataagatttaggtggggacacagagccaaatcatatcattctgaccctgacccctctcaaatgtcatctttatcaaatttcaaaacacaattatgcttttccaacagttccccaaagtcttaactcatttcagcattaactcaaaagtccaagtccggctgggtgcgatggctcatgcctgtaatcccagcactttgggaggctgaggcaggtggatcacgaggtcaggagatcaagaccatcttggctaacacggtgaaaccccatctctactaaaaatacaaaaaattagccaggcacagtggcgggcgcctgtaatcccagctactcaggaggctgaggcaggagaatggtgtgagcccaggaggcggagcttgcagtgagccgagatagcaccactgcagtccggcctgggcaaaagagcgagattccgtctcaaaaaaaaaaaaaaaaagttcaagtccatagtctcatctgagacaaagcaagtctcttccagatatgcacctggaaaatcaaaagcaagttagttacttcaaaatataattggggtacaggcattggggaaatgcacccattccaaaaggggaaattggccaaaacgaagaagctacaggccccatgcaagtctaaaattcaataaagtagtcattaaaccttaaagttccaaaatgatctcctttgactccatgtctcatatccaggttatgctgatacaagaggtgtgctctcaaagcctggggaagctctgctcctgtggctttgcaaggtacagccccactcctggctgctttcacaggtcagcattgagtgtctgcggcttttccagcacagtgcaagctgtcagtggatctaccattctggagtcttgaggatggtggccctcttctcacagctccactatgcagtgcccctacaggaggctctggccactactccattactttgtgagggctctcaccccacatttcccttctgtacttccctagcagaggttctccatgagggctcttctcctgcagcagacttctgccaggacatccatgcatttccatacatcctgtgaaatctaggcagagtttcccaaatctcattcttgacttctttgcacctgcaggaccaacaccacatggaagctgccaagacttaggttgcaccctcttaagcaatggcctgagctgtaacttggccccttttagccacggctggagcacctggaacacagggcaccaagtccaaggctgcacacagcagggaggccctggatccagcccatgaaacgtttttcttctaggcctccaggcctgtgacaggaagggctgctgtgaagtctctgacatgccctggagacatttccccattgtcttcatgtttaacatttggctcctagttacttatgcaaatttctgccacaggcttaaatttttcctcagaaaatgggtttttcttttctgttacatcatcaggaggcaaattttccaaatttttttgctctgtttactcttgagccctttgccagttagaaattttttctgccagataccctaaatcatctctctcaagttcaaagctccacagatctctggggctgaggcaaaatgccaccagtctctttgctaaaacatagcaagagacacctttatccagttcccaacacatttctcatctccatctaaaaccacctcagcctgcacttcattgttcatatcattataagcattttggtcaaaaccattcaacaagtctcagaagtttcagactttctcacatcttcctgtcttcttctgagcccttcacaccattccaacctctgcctgttacccagttccaaagtcgcttccacattttcaggtatctttacagcagcaccacactatccagtactgatttactgtgttagcttgttttcatgctgctgtgaagaaatacctgagactgggtaatttctaaggaaagaggtttaattgattcacagttccacatggctgggtaggcctcaggaaacttacaatcatggcagaaggggaagcaaacctgtccttcttcacatggcagcaggagatagaagtgcagagagaagtgggggaaagccccttataataccatcaggtctcatgagaactcactcactatcacgagaacagcatgggggaactgccctcatgacctaatcacctcccatgagatcccttgcacaatgcatgggtattacaatttggattacaattcaagatgaaatttgggtggaacacagaaccagaccatatcagtgcctttcaacttaatgcttatgttttcctctacttccatttaccaccttgctgccattttttctgtttataataaatactatcataataaataaatactgtaaattagctgttcttgtaattacttatttttctaataaaataacacatttgaattactaaaaacattcagatttcaaattatgattgtaattataggctctcatgcaaaaaatgctatttattagtcatctctataaatcaatcttaagcacttaaaaaatatgtgcattttttacatctgtctttgctattttaatgatattgacaagacacaacatcagtgccagatgttttcaattccagatgatgattatgcttccaagattcttgccaaaattactgtgtgactacttactctttttttctctttcaatctcaataacatctaccacattaagtgcctgaagaatcactctccaacaaatgttatatgtataatatatataccatgactattttgaatattaaattatacccaagaggcttctacctccccccaaaataacttttagaagctaaaacttacatgtgttccacaatatagagtggccagcaaatatggctaccatcttactatctccctattatattttacacatatatatgcatatctatacacagatacatccatgtctgaatacatgcactatacagtcatgtatcatttaatgacagggatatgttctgaggaatatgttgttaggcaattttgtcattgtgcaaacatcatagaatgaacctacgcaaacctagatggtatagcctattgctcctaggctacaaatctatacagcatgctactatactgaatattgtaggcaactatgacacagtgtgaagtatttgtgtttctgaacataactaaacatagaaaagatatggtaaaaacatattatacttctgggaccaccttgatatatgtgatccatttttgaataaaacattgtacacatcacatgattgtacagatatatctctaaatgtcaattctctctctctctctctctctctatatatatatatgtatacaaatacacacacacacacatatatacatgttactttacacattattccttctcttccttatgttccaaattgctgaattttttttaattgagttttagtgtctctcaggaagctttccttcagtcagacccaaagttgttttcacttttctatataattttatatataccaaagtcatactatttttaccttatatttatacttatttaataatgacctgattctgtgcttcacagttaactggagtttctgctgaatttgtgttatactggggcaacagctgaaagtttaggcatgcttttttatttctggttttagtttgtatgagtcgtagcatacaaaacacatttcaagaacttgtttggaaaaagtcatggaacctgatcccagaatgtgtgactaaagggtgataacctactgaattttctgaaacaatagaagtgtctgaaaagactaagatcaatatgactaatatgctttggactcttactagaatcttggattttgggttttaatttctgttacacaaaataaatttaaaaatgttttaaggagtgatcttgtcttgacaacttagctcaatccaatagagggatgaagcaatataatattctcactaaaactttttaaatgcatactcaatttgcacactaggtatgtgcaactcacttttttgtatagactcatgttgtctacctcttttttttaaacttctatcaatatatcttcatgatggcttgtgaatacttaatcataatgagagtactagttttaaaaatttatttgtaaatgaaaataaccatctcaaatgttaacaagattttaggtttgactttacacaccagagagtgaattctttatatatttttgcagttttatatatattaactttatccttgacatattttaaaattaaaaattcattgttttgaccacactatctccggtcttgtctcttcatatatttatatagttccccatcataaccgaattcattgttatatgtttcttcccaagcagattggccaattataaaagtagccagattattctgtctgaaaaatgacctgcatgatgaaagagtgtaagacaaattatttttaatttggaaatggaagttaatacaaattaagaaattatagtagtagattttgaaattgacttctatcacctgtaaagtagctgttcaaaagcacctatactggatgtacagacgggtgaataacatttccctttctttggcttgattcacatttcacagaactgtggggatttttgacttagacttcactatgatgaggtttggcagagagcattcattgttcgggttttcaaaagggcaagtttttggccagaataacttgcaaagagaaggaatgctatgcttacacatgtgtactcaataaaccttcagagagcctgggctaagatattacaggattcctcaccctatcccagccccagtctctggatgttgattgtttagaaggcttcttttgttgtgtcactatcacgtgtcttttcatatttcaggaactagtacttttattcatatttcagaagttaatagtgtacagtgaatagtcatttcatatcctgtgcactttcactcgagttattaaaaatcacaatcgcattcaggcctactttcccctactatttagcagtacaaaaccatcatctccatgtcaatgaacaatcattcttttgtataattgcaaccctttattacattcaataatcgtacatgaagattttgagttttcctttactaactgtgtacagacagtgttgaagtatatgtgtgctttgatagtgtattaggatgagaaaaatctactgtaaatttcctaaattgataagcagagcaaaccagcattagccatgtggaccaggcatatgggtctacagttttgctgtgctctttccctaaggggctctggctacgattttccctttcaactggaataattttatatattttattgccaccaactctcccagccgtcaaccgatgcctctactccctaccccacaaacacccacttaatcttacctggaaaagattttttcattcaaaatctacccacttgtttgtaagatctctttcagtccccagtagctcttgccctctcccttacttctagtgccacaagattgtttctcaaggatacaaaccaaatggttgttacctaggtatcttttttccatattcttatagcatattgccaagtcttgcacaaaataagtgcagtttctaatacttgactgaaattaatccattcagaatctaatgcctctgtttttttgtcttgtgacaacttggactatggatcttatcacaaagcttatgtcactcctatatttcccatatatttatattgctcttgaagccctcctaactccagctccccttttgtcttttctttaatgagtatttattgtgcacccgctgcatgccaggcactgtaatagtcactgatgaaacacagatgaaaaaacatggctggccctgaagtagacaattttagaagaattctttatcaccgtgggttaaatcacatatccttacagtatcaaacacaaatcaacaaaaggacctatttgtagtcttggtcttttttctcacagcctatgcttaattacatcaccttcttcctcacctgcttttatctatgtggaggttatgttcagagtattatctccatcctttctttcttgggtcccagctatttcagcacaccaggagccctggctcgacacctgagattagtcctgattactcaatatttcagttataaaggcagtcactcactttagtaactaaaagtgtcagagtccttgattggtttaattttcaatgggggctttaaaatatggaaatgaatgtggtgcagtggctaagactatgggttgtgaaagcagacatcctgggtccagatactagctctgtcagctcttagttgtgtgattcaggcaagttactttctacatctcagtgtcccattttttaattggagttcatgaaaacactaatctcacagagttattgtgaggaacacatgggttaatacagggaaacgaaatactatatgatgtgttacaatagctgtatgttactttttctttttcttaaacagactatgcatattacaatagatcgaattcccactccattcgtctgcttttgtattttttatctactgagtttcatccatttcattcaaagaacagccccttggtggcctacttcaagtatatactttcataagagaatggtgttttagaattgagtatcccatctgttttggcacggaagtgtgtttaaagggataattttggggcacagtgcaatagatcatgctacagtgatgtgaggaagaagccaggacagagtaaacccttaatactagttgccacagaagagtcagccagttatagaagctgatcagcaagtagtaaaagccttaaacaccctcctctgaattcccagacttatttcctagcatctttctgtttacttttaaactatctactactggattcataacattaaatatttttttactccatttatctaccctcaaatgttcaatgtatatttgttcaattctctcccttttctctctctgtctctttctctctctctttctctctttttaacccaatgcatagttatttacttagccttccaagttgggtctgctctcattcccatctccttgcccacagtttacttccactgtgtgattacaaccttgtttcttttgtgccttgttccttatgccttttctaaaaaggtattgctcttgggatcttttgttaaatgctctcactattctgctgtttcagaatattctattttagtctccctcataagaaagtgaggggaaacaaaatgacctaattcaccatccactcactcaaggatctggaactcagcccagtaacattctccatagtgcagtctcatgcccagagacgggatcgtttgtagaccacacaccagtgctcaacttgctctacttgagctgtctagttgctaagagagcccagaatgcttgcttcctaaatttgggcttcagaggaccgtgtaggaacctgcagtacagcacttgtgcaatcaagttgcctaacagaagctaagcattcatccctcaagaagcaagtttagggagaacccagagataaatgagtaacttctgcatctgtagggaatctaatgtgcaaagtacatctttgttccatgctgctttatctgcttggtcattcctcagaatacagtttaatagaaacagcaaagtatgttaatcaatgttttccagaaattgaacttaaaggtcacttcagcttctgagcaagttgaagtgaaactgaataatgttctgattattttatgagaaaatacttgttgaatgcttttcttggtatggtttcaaattagtctattcccataattgtctcttttgcttttgggtcctcatcaatatatcagattttaataatttacaaaaccctatctacagaaagtgaaatgttttagagataggatacataagaattactctaaatattttctaagtaatcacaaataattatttagtgatttctaaataatcactctacaatgttcatcttgggaatactaaatattgccctatgtttgcagataaattgctgtaaaatgtttcttgtactctttctagtgcagagggaaaagaagcctttactcatacatatgtgtgtctatatatgtatgtgtgtctctctctatatatattataaacatatacacacacacacccacacacacacccacacacacacacaccgctttagcatgtgtcattttctattccctgagtccttaaggataattttgttagagcaaatcaagagaaggaaacaattttaaagactaaaactgagtcaagtcaattcaaagttcatttttgttttatttttccttttttatatataaattcactcattccttatgtaattttatttattactttagtgaatacgtattataaatttgctggcttgattctctgtgagatttttagtaaatgagataaacaatattaatttttaattattttgtgggcgacataaagggtgtcctttttcaaattattacctttaggtgttattcaagggacctgcctatcaaacagtgggttttctgagtagttccaggtcactaaaaaaaggttgatcttgatcaaggtaataatggttgttccaggtccatagcccaggaatgaacacaggtagggaagatggaacaatcctaggactatcatgtgggttcttattttgaggcccccataattcccgggtttcccctgactgttccctttctagctccatcatggttgctttctcctcctctcactacattctctttgtccacggttctgttctttttctctctatagactttgttcactgacccattcactttgctcattccagttattatttaaatgggaaatacacataaattattaactctaacctctcagccttgttgcttttccagtaggccctagtctacagcaatggatcatccacttaagggtttacattcttatgatttcaccacgtgccgtctcctactggttgtgactttgtatgcacaagtgtgtacactgtcttttggtggaaaggaagctcacttttgagtcacaattacaattattctattaattatttgagaaaattggagttatttaactgtatccgccttagtatacttatatattgagatagagataaatgacaattttgcatccaaaatgcaatgagttttaaagagagtaaataaagaaataatctattctggtgcctgacaccattgttattttaaaagtcaacactagtgttttgatgtcttctcaccagtatatattaagcatgttctattggttgcagaaacttgaaatgctaggacttggaatttgaattttattccatagttgatagggaaccactgaatatttttgaacaatgaaataacccaagagttagtgtcttgggaagatgaacctatgaataattttcaaggagattaattaaccctttcacatatgtgatatgggctagactattgcaatggtaatgagaatataaaagaagaataccagagaaattataagaaataatttattagactattatgtcagactttaactgcctgatattcacatggtttatgattttgccctattctatattcaaatcactctgcctgacatagaactttttatatatctctcaggacctagattccctgagattcaaaccttcccattgatattacactttttgaaatgattgttgtgttgttcccaaaattcacaatggaacaagaaatatctttccacatacatagaagtctgaggtcagactggattctagcagtatacagaatacctcatgatcttttttcctgctaaaggaagatgactgtttcagactactaaaataatgagatacagaaaataggtttgtacaggcatcaactttcaaacatacatcatagaactagaaatagaaaccaatggtaatcttactaatatttattttgtgaaataaagtagtgaacacttattttgttgtcatgtatgtttaatatttagggcccagcattgctcatgctgttcatcctgaatggaattccttctttctcgctctctctttttttaaatcttttgctattctattttttaaaaaccaaatcacatctcaccttctccgtccatcagaataccaaaccagatcacatatataatgaacttttttttattttcacattcacaaacacacattcacacatcaaaataaataatttaaatttaaaactattttatatggacactttgtctcactagcaatctatcagttcttaagaactgatagttccacatttcatattcattctgtgtgatacctagcatagtgatcaatagttgttttgtatctgcaaatgaaaaaaaatgtaagtagagttttgaaaaaagaatctaaaatcctgagttgtatgtagcatcagtaaaatatttttgtttaaataaataatgaaacagataccacagctcttcttttccaatttttgttagaatcagaaagacttaaaatgattatccttttctcaatcaaagatatccaaaatcagtctcttaggtggcagtattgatttaatttaaaacatgtgttagatggaaggatggacattttaacctccgtatcattaagttgataagctatgaaaatgttctaagtactctattttgcctccttactatcagcccatttcgctttaggttatcttcattcaaaagaatgtcaggagcaaaatatactatgtgaaagtagcagacaacctgttagtgttcagaaagcagtgtctctaaagttcaattttattctaaatatattaaattagtgcatatccactaaataatttttgaatttctccaacaagctgcattttgttaaaacttgtttaacagaactagtgtctgaaggtttttctttgtttgtttctttgttttgtttaatttcagtcttggacataattggagtataagccttgacaaactgtcagtttcagaatatttatttgaaaatccttctaattaataagctaatgataaaataatttttttctaatgtatctcatggactcatagtataagaaaataatgataaaatattttttatctaatttatctcatgaactcatagtatttcagaataaaaaagcaaactgagatattgtctaaatttcttaattttacatggacaactgagcacaagctggtttgaattccttcccctgccccaacactttactgccctccttgtttctctttttctttctttcttttctttctttctttctttctttctttctttctttctttctttctttctttctttctttcatctttctttctttctttctttgtcacctttccttccttaaacatgaatatatttatatatatacagacacacagatatatatataatttaagataagtgctaagtgttcagaggggaatagctctgggcttgagtaattcataatccaattcttaggttggtgcaaaagtaattaaaattaaaaaaaaaaaaaaaaaaaaaattgcagaaaccgcaattacttttgcaccaatctgagacactagttgtagtgtgctcataggcacatgactgagttatcacagagctgagattacaactgaagcctcttcattcccacaagagtaaactttttgcttcttagtgaggttgacaactaatttagaaagaagcctgtactgccagaattgttgacatttacatcaaagcatggtgacaactaatagtcacagaagtgttttaaaataagaattaaaaataggtcatacattgataaaaagttaagtagtatttgctgttagatattgcttggaaaacttgttctgactagcctgtagaaaggatgaaactttcttgggactactgtctgactgcatcctctctccaccaagccacccaaatattaagcaatgggtaggctctgtaggtagagatgggccattttccacatatttatagttgtctttaaaaaataataagagccacaggttgattaatctatttcagccattagactatgataagaaaagtataaaattctgtcaaacttttcaattattatatacaccccagtccaaaatatatgtcgttatcaaaaatatgcatgggaacagtatagagtacccctactagtgttttgtttatagctgtttgtctgtgagaggtagacttatctaaagtattaccattttctatttgttatctggatgtgaacaaagagaaagataatgtttttacacaatatcatgctttcttgatgtggtcacctttaataatagaaaccaaaagaaacatttcccaatgtattcatcataattctatcaggaagcagatgtgcagtcttatttttcttttaaatcatgtatttatttattgcattatatctttcagttgtagatattttcctgtagagggaaattccatccttcctggaataataattccccaagttttagatgtattttttttaaactggggatttgacaatgaaaatacacccttccttcttaaatatattggccttttgattatacctctatacaggtagaccttgaatgcttataatgcttcttgaagatatttcgtgtatttataacaataaattaagataattttatgggcaaagtcacattcttactaatctaccacaaatagacgtccaacattagtatcagcttcacagtaaattatatcattcaaaggtgaaaatttataacacaaccaccgatccttctagctttctcattactttccttcattcccgttgaaatgctttatgtttctatgagaacatcaccacccttgactgttctgcatatttccagatactcttggcctcacttctctatttaaccagccaagacctccagatgaggcattgcaagcaaaatgtttcagcctattataacatttcaactcttgacatttcaatgtagttgatatagctccctgcatgatgaaacataatattgttttggctttttatgatcttcaggcgggtctcagtttacctgtgtctaatgaaatatctgctgtttctccagccatcctaatggatatttctctaaggccaatacgtttgtattgatttcaggacattttttcaattaaagtttgtttaatttggtaatttacattcacattcactgtacaccatcacttagataatagttctgatcagttgctttggctataatccattatcacctttgtacaaaacctctaactcatgttttcttatccactttaaagttcttccagcccttcagatataaaatgtcaaaaataaaacggggctttcattttttattttttcccttaccgactcactgaacctcttttctttatttttatcagcaccatacggctagtaatttgaactttacacatcagtcatctctaatgcaatacagagaaggtcctgtgaacctagtcccacctgggttcccatcccaattctgtcactaacaagcttgtagccttgggcaatttgctttatctctctatgccttagattcaacatctgcaaatgaagtgttaagagtatttaataaattactgtgtggattgagttaatatgtgttcacaacttagaataatgtctggtccttagtaatacctcataaatgttagctactattattatcactttcctttgctctttttttccaatcacttcagcaagttttcttaaaacttgcctcctttccatcgtcactgccaacaccatgattcaaactttcatgttcttttgcctgaactattttattagttttctaactcatatttttcttctcattttatcataagccctaaccaagttaggatattgtatttaagaacctttatcattgttagtaaaactttatttggtaagatcaacatcgtgtagaaaaatacataatttaagcaaaactaacaacattaagtatgacgtgtatatatatagcatgtttgaatgtgtatatgtgtgtaggtatatgaaatatagtagtaaataaagtaagaacagtatcattccaagcaaattagattctcatgattattaaacctgtttatgccattaaccgtattcttggcaccttcctctactgattaaaaaattgatgaagcgcattatatactcaggtacatatttatataattttgttaggaataatatatgtccttttaaggtatatgaacccatctgcattttcccttgcctcttgtttttagcatcttctctgaatatttctgtaaaaggctgacctttggaaatactttgtagtgtttgagatgcgtgattgctttctctaccacatattttctccataaaaggagacttatgccacatacttgctcctattttatatgagaataattgtcaggaataactgatgtccttcttagtttaaagggaattacctgaattggttttaaagaaatatattgtgaactttttaaaagatggtatgcatatgtactcagatattgaaaaatcacaggtgatgaaactattgtgggtgaagcatgattttctcctgataaggtaaactcaaataaagtgactggcctgtttggacacctctggtgtcattcactccctactacaagtgatggcagaatccagtgtaaacacaatacccttgtcatgattgggttgtaatctaactttgcagtttagcccgtgtttatcttagtcacatgaaactattacatcacgtctttctcacgtcgtatcttatgtgtctattgaaacattatctattcacaaactctcgtttaaatgatttctctactgtgaaattttctttgattctactacatctcctatccatctcactctagaagtttttttttttaccatttaattcatcttctatatttctttttttaatttacataaaaaagttttattattattattatactttaagttttagggtacatgtgcacaacgtgcaggttcgttacacatgtatacatgtgccatgttggtgtgctgcacccattaactcgtctatcgcaaggacaaaaaaccaaacactgcatgttctcactcataggtgggaattgaacaatgagaacacagggacacaggaaggggaacatcacacactggggactgttgtggggtggggggaagggggagggatagcattaggagatatacctaacgctaaatgacatcttctatatttcttgtatagcactttcattctgcctaaattacagctctttgtatacatgttttatatctctaagtgcctgttgtttccttgaataaaaggccacattttatttaccagctacaaatacaatggagttgagttttatacaggttctaagttctaaaatcaatatttaaagttgaaatttcctactgtcaacattatccagacaaatcctaatgtaatatataaaatgtattatacaaaatttgtgtgccacaaaagtggctgacattcagtctttcaataaactacaacactgaaagttttcctcctgtgtcaagtcactttcttcacttcagcaccagatgaagtaattggcttgtctttagaggctgtgttgtatgaagaaatccatgcatctttaagcatgaaaatcaaatgcagcttgcggagatgctcagactatgagaacttataatgactaagggaatctaattttcctttccaaaaaaatattttttaaagatttgcagctcaaaaatgctctctatctgcttagattttaagaaattttgttatcaagttcataggagtttagataaataagtatatgtatagatacatacagatagagataggtttgggttaaaacaaacaataacaactagtttaaataactagtttaaatccgtgataggtggtatcattatacagtgatattatgtagtgacttagttcaagttattattcagtgaaggctcccatgtagcaacgttatgaaaaggacatacttttgctcaaatagacctttattcaaatccatgctctgctactgactgactgtaagacctgaagcactcactacacttctctgagcatcaactttattgcaaactaattagcattttgaaaagttttccaaaagagtctgaaataagatgtgtagagtttatttcatagtaaacattcaaaaaagattggtgattattacttattattgatgtttccatttacaaaataaaaatttataacatgaaaattgaagcttttcttgttagaatgggagtctgtaactttactcagttcaagttatatttgaaagattggcaaaaattacctttccttactgtttctgaaaagcattcagatacgaaatgcttggttatttacttgaatcaggattgaaacatttggctggttgaaagcaattctgggaatgagaataagtgagccactttaaatgattaaagctggatttctgaattgggtctttcagaaataaggggcttctttgcccattttccatgaatttacatttttcatagtaaattgtcttggatcagataaattttaagtaacatctttcactttattcattactttaaaaaattcatctttaaattacctagttatttcctactgtcctgttatcctttctgttggagagttgattctttttttcttatttttccatcatgctgatcatttttatagcctttttttttccagattccatttctgatctttgaagtattataaatctttcaagactttggaaattaagattatgttttactgttcactctggtgacaagcactgtattctttgctttataacaattttcttactgaattctcttgatttattgtgtggtgggtgatattactttctcctttttcaagtgaagaaactgaggtatagagtgattaaataacttgccccaatttcctcctactaagctgtcaagatagaatgtggaaccaggcagtttgattttagagtttaagttcttcactgctgcacaagcattggctcactttcatggagaggccactttccaagtgcctttttttttcttttctttgtattctgttttactttctaatcttactgtatattttggatatgtatatacttcttttatattcttacttcacatccttgtctttccttctcgttagctcacctccttggatgtcctcggcctctaaacctctgccttatgacattcagtcgctgactcagttcctttacttctgtcttccaaggagtctgaacattttaaatgttattttcctttcagtcagttccaagatgatgtttgcctctgctaagtgtatttcctctcagctactggaaccttctgttctgcagattgctccttggtgcatttaggaagacgttgtcaagtttctttttgtgcatatgcttgttttcagtttctggaaacttgacagagcttccagtctttttccacgttcttcctcaggttttcctcaccctcccagtacacgtttcccatattgttcttccttccacttactgctccactccactgcatctttagagtgtccttttgttctaaatgctgaaacctacctgaaatttctggctttttttcactgtggcatgagttgcattttaatcaactatgacatgtcattcttagaaaacaaaggtcattcaatgaaaacaaatggctatgcattctggaaacttaagctaataacttttgttattattaatttttacctgatctacgtcacctgcttctttcatttttctttcacaataatttcacttttaatgattcccaacaaacttatgataagggtgtggttttatgcaataatcactgttttgttaactctgtgtttactgatgctgtgacttagtacatgaattgcgcaggacatacagtgcagtggaaggatcacttgttgggcagttggaggatgcaggtctttgctgttgttagcccttctttctacttgactttggctgctcagaaacccctctgattcttgctttgttacttgtgaaacagaggatgaggaatatctaactccaaagctgaaattaagatgagattaaaaaaaaaaacacgttttacaaattgggaacagctacgaaacaggtacagattattattatattgactctcaaagcacagagatgagtgtttatcagacaagcaaacacataaaatgaaaacaaatggacagtctgactagagtgagaatttcatttcttcagagttttctattgtgcatcagatgtttcttaaaatgcagaaatcttcactttgagttttaataaaaatatatttgtatgcggcactgtgaatatttaagttgtaagatagtggatgacatacctgttttgctaactcaaatatcataatccaaaaataatacctgtgtgggtagttcagtttcttcctataatgggtattacagagtgattcatagaaaaaaacacagattggcctatatgtacatgcaacatatggttaagtaagtcccacctaagaattgtttgcttccttctgtgaagagccatctcactcctacgtgaatggtagttgttttcctctcttcctgcttcttgcaactctccccgcctactccacccgcaaccatcctcagttccagccctgtcttctttgcccctccagaggccatgggtgcctgggtttttcataccctgcaaagttacagcaggggagggaggaacaattttatgattaaaacattataaaatatttatgatttatttctgtatctatctatatgttatttatatattttatatttacccctattgctaattatgtgagtgattcattcacattttaatattttaaaatattaatttgcaaaccaacacaaagaatcactgtaagccatgttaaaaggaccaattatttgattttatttagttcccttctggaaactgctgaattaatttactatttcaggtgaagactagtgtaacaacaaaacatggaagataaagctaaaatttttagtccctttggaaattgagtttgaattattattaattttctgatatttccttattttatgttgattgtgttgtcttccagaatcatggtcaccctctgtgtggtcaagttgcctgtattttatttacattgtccgactgatgttatccattcccctcctccatacgtgcaagtagtcattgcttgcatttttatacttcacttcctaattttagggttgacttcttttctgcttcattgcaattattcttcataaacctcttctcctagtaaaaaattaaataatactttcttcccccagagttttgatatcttttactggtttgcagagaggtactttgtctatcaacttgttgctcatccaagttgagcttctttagtgctttaatcttccatcagaaatcatctttctttgtatcttaatcatttttccatcatgtctctgaactccttccagcttccctgcaccttttggataatgagaagcctgggtctgaacaccaggtgcagtcccaccagtcctgtttaggagggtcccattacctcctgtgctgctatgatgttttcttgttccccaaggttctcattagaatgatgatgcgtgtttctacaggcagagagtcaggcaaaccgcatcgcccccatttgcctaagctgccttctggctaattctttttccatcgtggaaatctcagtttcaatttctctctctctttcactatgactctgtctctcttgttctttatagtatttattttactcattctgcctgactcagatcttattcatgtgtttattgacttccttatttttttttctatatttcatcagacccattatcttcccagtcctatactttcatgctgggttgatagtaatctctgtcattctgactgcatgttcatccatctcttaaccatatcaatttcgttcacacttcaatggtaaaaaaaacacgtatttacttgtatttatataatgccttacctttttgttttctatcagatcaataagtagcttgacattatcctgttaggcttgaaaactcaattttatcaaagtggaattgagatatatattattttcagtattactgtttgcagttcaataaaataacagttcagtttttaatccacaaatgatatagttcatggagagatgtggtagatatgatacctctggagtagttaccgtagaacttatggcttgtgtttcttgaacactagttggtcattctctcttccttcacttccttctttcctatctttcttgcttccttcctccagtcatataatggttactgaaatcctactatctgcaggacagtgtgaaggaaagagtatgcactggtattagatagcctgctgtcaaagtgaatagctctgcagctacatcaaatcatttacattctgtcactgtgttctcacccataactggagtggagttcagcactacgatgattaagtgagaataagacatcattttattcacaaattagaagcctagttagagataaagccataataaatttttggataatattgagaagaaccttgaccacttgaaaagtttgtctttcttgtttataaaacaacacatggctccccattgcctaccaaatcaattgcatcaaaacaccttcagagtacacatgtggtttgtatatgaccagaggatggaagtgacagaagatggaaaataatgtaatggttcatgaattaggtaataaagacagatgaggactagagttagaggaaaatttgagtctggcactttagatttgggaaccaattttaaagtcaatgactgttaaaaaggggtagattctgtcctaccacctggagtgttttcatgattaatccagattccttatcacccctctttgacttgctgcaatgaaaaatttgaagatgatggcctggaaactgcaatttaacaccctcctctacccttactgacagttgatttatgtgtttatactaggttacaaatttttagctgaaagtgcagccagtcattgtcaaaataagagaatatcagggtctaagataagtatgaggaaaaaacagacgaaaggggttgaggaactaaaggtgttgggtcccaccagtagctgaggtgatggtaaagagagtgatgtgggtaacaaagcagttagacacaatagacacagtcagtgagaaggggagaaataagtcacaatgaggaatttgtggaaagggccagaaattctgagtttctgatcttagtgaaacagaaaaaattctgatgatatatcaggtgaaattcacctctgatatttcatgtatgttcttttctattttccctaagtgttggctggtctgagaaataaagggacagagtacaaaagacagaaattttaaagctgagtgtccagaggagacatcacatgtgggcaggttccgtgatgccccgcaagccgcaaaaccagcaagtttttattagtgattttcaaaaggggagggattgtacgaatagggtgtgagtcacagagatcacatgtgtcacaaggtaataagatatcacaaggtaaacagagtcagggtgagatcacaggaccacaggaccagggcaaaattaaaattgctaatgaagtttcaggcaggcattgtcattgataacatcttatcaggaactagagtttgagagcagacaatcggtctgaccaaaatttattaggcaggaatttcctcgtcctaataagcctaggagcgctacaggagaccggggcttatttcattccacagctatgatcataaaagacagccgtccccaaagcggccattttcgaggcctcccctcagggatgcattctctttctcagggatgttccttgctgagaaaaagaattcagcaatatttctcctatttgcttttgaaagaagagaaatatggctctgttctgcccagatcactggcagtcagagtttaaggttatctctcttgttccctgaacactgctgttatcctgttcttttttcaaggtgcccagatttcatattgttcaaacacacatgctttacaaacaatttgtgcagttaacgcaataatcacacggtcctgaggtgacatacatcctcctcagcttgcgaagatgataggattaagagattaaagtaaagataggcataggaaatcacaagggtattgattggggaagtgataaatgtccatgaaatcttcacaatttatgttcagagactgcagtaaagacaagcgtaagaaattataaaagtattaatttggggaactaataaatgtccatgaaatcttcacaatttatgttcttctgccatgacttcagccggtccctacgttcagggtccctgaattcctgcaataatgatactaatccatgtgctttgggcgactgaagtgaaaacgtgaagactgttgggtgttgttgaggagaagagctacacctctgcccagcagagcctttgttggcttgttttgttttgctttgttctccccaaacaatgttgatgtatgtacggcataaactgatgcaatttatttacttataagccttgcaaaatacaagtaacaagagaaatatgagatcatattgggacatggtgcgaaaagctcagacatcagagtattatagggagcacattttagacagtatacataaagtgtaggcaagggtcaaactgtgaagaaaagacacataaaatgtacaatggggagctggttaagcataccaaattgtcaacttataaaagcatctttccaggaatttagtctcacttggagaaacaaaaatcttttggttaatattttgaatataaccagaatctttcatacatgttatttttattatactatgctaatattttaacattgatatcaaaactgttaccatatttgatattgttaacataatttatttattaactgccacatttttagtattgactttctttatccatctaagcaaataaggatgaaattttattattacaaaaacaagaaatagaataaaaccctaggtctatttttttttaaacagactaaaaaggtaggctgtgccagaaacagtgagacattctgtatttcaaagtgccatttattcctgaagcacgtcagactctgcacagtgaccttctgtgtttatctttataaagagtagagtaaaccattatgcaaacacacttccatttgggcactgtagtgccaagtgttaatggcatcattattccaaacaaagcatgtttagaaccattactttttgttttatttttcttgtggggatttccataaactgtctgtgggctataagatatttgcatgatataactattttcttcttactgtctgttatgctaatggtattttgtggtgtttttggtaaacaggttgatttacttcataaagagcctgtttaaaagattactttttaatctgtgtcagctctctttctttgtgtgtcctctgtatttcatgaatataaatggcctattgatgatgacttgggtggaaaatgtaagcaactcataaggagatgaaatttgctcataaattaggataaattcttaaaatttttcaataccaaattaaaatgtagttaagaccataggtcttaaagcgatattatttttctgaaatgtgatttttataactttatactctggaaaattcgattattcctttaagttggaagaatcaagctctagaattctaggcaatacattgaagttggagattgctttattatcttaagaatcacttgtggccaggtgtggtggctcacgcctgtaatcccagcactttggaaggccgaaggggtggatcatgagttcaggagatagagaccatcctagccaatgtggtgaaaccccatctctactgaaaatacaaaagttagccaggtgtggtggcacgcgcttgtagtcccagctactcaggaggctgaggccagagaatcacttgaacccaggaggtggaggttgcagtgagccgagatcttgccactgcaccctagcctgggtgacagagcgagactccatctcaaaaaaaaaaaaaaaaaaatcacttatattgcagcataatgcaagataaattaaaacattattttgtctacatttctaagctaatatgtatatatgtaacaaataggtgataaaactaacaattatcagaagaaaaatgaaaataattaataattggataggccagtgcacatttggaattaaaagcacatcagctaaaataaagggaattgtgtaagtgtgacataagtcatattgttcattcatattttcaagagctcggcatttaattgttgttgactgaggtgccacaacttcatgagatatcaagggctcattacttgttgctctatgataaatgcaaatattatctctggcaatattaaatgttttataatttgcattctgttgaagagctaaccctcattagaaataaatatataactaaaataaaacatgaatatatgtatgtatgacatctctaaaaggtaaataagctgttttatagtacctaaatgtataagtgaatcatttgcaaaatgtctttaattaacaccacctattgggcctgttccctgatttgtctactatttaagatttgtgtacttttgcatgttacacccctgttggaaatacattaagtttcagtatgactaaatgttataaggggtttaatatgtacctgtggaaaacaaaataactaatgaacccatcagggagattaaaactaagatgatagcctcataaacactaaactctaatggataagtaactagcatccaagagatgtagtgcacagtaagacatctatttagttatatatttttatctcttagcaatatatatatttaacttacaagagaaaatacaaaatttttattctggtagagtgtttaggggtaacgtatatggatatcattgtcctgctttgaaaaactttttttaagtcagatggactggcaggaatgcatagtgtgataataaagcaaatgtcaaaaaaaaaagtgtagaatctaggtgtgggtgtacagatgctttctgtatacttcaacttttctgcatgtgtgaattttttataataagatgtttgaaaaaactttgcaatgcaagatgattacattatttttaaagcaatcaatttgaaaaactgtggagatgacagtaataacatgacacaattctttatatatagaaagacaagttatgctttatctttaaatgaatacctttaaaaataatgacatctgagcttagctaaattcttttcagacttatgcatattttttgtaaaaaggttttactcttttctctttagattatgtgttcaaacctaattatcttttatggttgtctattatttagggccaacctagacttatcaccttgtgttgtattttagtcaatgcacttactcagttttatggttctctctggtacgtttacaaagtgcactttatactgcacttctagtttcctataaacaaggagacaatctgttctactgtatttcaaatcactgccatcctgaccattacttcatttgcaataaaagtcacaaactgtgcaagtgcatttcatacatgttcatttccaaggtgttaataagtaaatgtctggtcagccttggtacagagaaagagaaagtaacagacatcccccaacccccgccccacaacatggtaggatttgcatgaggcttgatgggataccaagagtatgattcgctgcccatttccctgaggctcccttccatgggaacatccatgtttgttccatctttctaaaaaataaaataagatttctattgaaaggtaaatgttgtcaaccactaagagttattaataactgagctttgacaaatgtatgtcctagccagccctgagaaaactgggcttggggagagtttggaacttgggaattctctgtagtgtctgaacattccttagtttagcaggcacaggaaatatgatggcttggaggttaggcaagcagaagcaagcagtaaggcactgtaagcagtaaggagcagataagggtttctgtaatggttgattttatgtgtccacttgactgggccatggggtgcccagacatttgggcaaatattctggatttgtctgagatggcatttttggataagatcaacatgtgaattggtagactgagtaaagcagattgccgtctgtcatgttggtgggtctcatccaatcagttgaagacctaatagaacaaaaagcttgacattcccacaagtgggagggaatttcctcttgcctggctgtcttgagctgggatatttatttttctgcctttggacttgaactgaaacatctgactttcctggtcctggaacctgaaggtgtttggactggaactacagtattatctctcctgtttttcaggtctttacacttggactagaactgtaacatctgctgtcctggttgccaggcttttgaacatacactgttggttctcctggatcttcaccttaccaactgcagatcttgggactcatcagcctcaataattatgtgagccaatctcttaaataaacctcaatagatagatagatagatagatagatagatagatagatagatagatgcatttctcctacttgttctgtttctctgaataattctaatgcactgtccttgggctgatgtgattggagaggaagcactctacatgacagtttgttaaggcaaactttggataatctatgtccatactacatacaatgttatttctagacatgatcactccaagatgttggaattcaaataatgattgggtctctgctgtatcatcttaatgactcttgaaacaaaaatagcgtaaagtaattgtaattctttgagtcctgttagttatatacagttgaccctttaacaacatgagtttaaactgggtgggttcacttatattagagtttattttttcaaacaaacagatacagtattctcaggatgcaaaacctgcttataccaaaggcagtctttttgtatagtagggctctgcagggaggactgtgggaaattttgcacacgttggcatatgagaatggcagagttcctggaaccaatctttggtgtgtatcaagggatgaatatacattataacattgccattaggttaggaatcatctgcaaatagttatttacctctctcagaattagcaggcatagctttcttgtgattgcttgatttgaacatgtcacagtgtcccagttccttaggctgctagacttgactttgacttgcatcagtgactacttttgctttagctccagaactaaagatgaacaattatggtagtcccttctactattttatttgttgtatagaataacaaaatacaccatgtaagcaccaagtaatttatcagtttctaatcctaatacatgtttttatttgttttctaaaatatactctttcaatataaattattttgatgagattattcatctatgtttgaagacacattgcttgtatgtaatcttggcaatgctctattatttttagttattactatgcaaaaaatcaacatcatattctgttattgttgtgttgtttcattgtttgataggcataattaatagctctcatttttcttttactataagattgtgattaacattttaggcacttagcctgagatcactttcatcgtagttaacttgtcttcttccacaaatcagacatagtgttgtcctcagattataaactattaattttagggcaagaacaatgatgtcttttgactaccatataatttaatttggtgatcggagatcaaatttaattgtaaatattgatacctcttttatttgcttatggcccacagtgattcttttacatgcatctttggcttattctaacaatcagtaagaggtaattcattcattacttatttacacattaccgtaaaatttgtttaacaggtacttgaaataatcaaaaccaaagattaaagaaccctcactctgaacaaagaaatattgtcctacaagtaaagataggtataaaataaaacataaaaacaagacaaggaagagataaatggttaataaatcaaagggagacaaaattgtacagtggttatgaaatcaaagattatgaaatttaaacaattttttcatatattcagtcaagaagctataagataatgaactattctataattagaaaataaagaaagcatctcaaggtatataatacaattgtaagagatgttctttgcaaaaaagttttgtggactttttcattatttttatcaaagtaaggtcaaaaaacttttttttacagacagtctaaaatttggaattttaaaataggaatttaaaattttcttctaatataatagtttaagttctacttcaggtcaatgtgatgaactaaacagaaaatattaccacaaaaagctctaccagtacaagatgctttgagaatatgaaagaaatagtactaaatacactataatatactgagaattgcataccttgatcacacacacacacacacacacacacacacacacgcatacacacatgcatacacacatcaactacggtgctctattttaaccagcatagaaatatatattgtctaatccctagttctgattaagaactccctagttctgattaagaactatattctttctggaactgattttgaaaataatctgctactgttttttaagagtatcacactgtttttgtttgctttgttttaatttggggttgggaaaaatttccagaaatcttctatacatgtataaacttggagatgtttacctggtttattttgaagatttccaaagtgaagaatgaaaaaagaaatgaggacagactatacaagcccaaattaaggaatgagaaaatggaccattttcttgggttgacaacactttctctattcaggtttacatagggtttttgcagcaattttttttacatagttttactagactttcagtctcagtaatatcagataacgtctctaattatatatgtgcggtgtgtgtgtgtgtgtgtgtgtgtggattttttttattgtaggtaacagtgctgtttaaaatttatattgcttagtatttgagaaactttcaggtgatattaagcttttaaataggttaagcttttaactgagttaaattgctttagaactttagaaacattgttttaaaatattattttgtttgtctaacatttacaataaaaggaattaacaggaaacacaaaataacaccattcaccattcaccacagagggaattcaatgtaaagaaagtcatctttggatcctttccagtgtggcttaattgtggcaccacaataagggcattgttatgccaggtcttacctacttcattactttatacataaactcagagaactgaaatatagaaaagctgcgatgactataatcttctaggtataaatgtagcaaaagctagaagatactgaagagtaaaggagttaaaatgaacattaagatgtaagcagtaaattgattagtacattgcatacacaaattctccttcaggtttcaggtttgatttgggaagtgattctatttacagaatatatatatattctatatatataatatatatatccctgtaaatatatgtgtgtgtgtgtgtgtatatatatatatccctgtaaatatatgtgtgtgtgtatatatatatccctgtaaatatatgtgtgtgtgtgtatatatatatatccctgtaaatatatgtgtgtgtgtatatatatataatatatatatatatatatatatttctagaaaagtatttagaacagaaatatctttccaagattttcagttcttagtaccgtaacagctcaaaatttttttcatcacacctctaggccaacaaacaaataccaagaattctgactattacagttaaggccaaacaactaaataagtatttatgtcctgacaacataaattaaaacaaaaaaaagttttacatgttttaaatttaaatattcttaaattacatatgaattacttactaatggtgagtgcgtatgtgttgggcaccgtacaacttctcaaaccttggaatcagattgaacactgagatccttagtacctgttccatgaggacttttggggatacttgctttactaagaacccaacttcacatggctatgaccccttgaatgtaacccccttgaatgttaaaattaagaaatagcttgactagtggttaatacagtgtctgataaatagtgagtattgttgtgtttatcttgaaattttaaaatatcttacagcattcctgatgagttcactgtattactccagagtgtcttgcacatagttttggaatcacagtgttagactattagatgctaatgttaatcgtagcccctgaatcttaattgagaagtccaatagcctctgacatggtggaagtgaatggaagcactgtaagtctactataaaagctcagtatcttctttaatgtcattgttttctgatttttctcagtccattatggcaaatattccctacgatttataatatcacaaagtctgtgactgaaaatttgatgttagcacttacagtgatgataaatgagaccatcatcattgtttgaggcaagtgttacttttggtttttgtttgtttgtttgttttcattttttgctgtttatttattttttgagacagagtcttgctctgtcatccaggctggaacgcagtgacacgatcttggctcactgcaacctcctgggttcaagcaatcctgtctcagcctcccaagtagctgagattacaggcacgtgccaccatgcctggctaactttttgtatttttacttatttatttggggaggcagggtttcgccatgttgtccaggctggtcttgaactcctgacatcaggtgatccacctgccttggcctcccaaagtgctgagattacaggcatgagccaccacgcctggccaagtgttacttttgtatttttaagaaaataatattatcactgtttattaagacattttaaattttgacataacattttaagatttggtgttattttgtgtttcctgttaataccttttattgtgcaaatggtttcattttgtgtttcctgttcatttattttattgtaaatgttagaaaaataaaatattattttaaaaagtttctaaagttctaaaaaaatttaactaagttaaaagcttaacctgtttaaaagcttaaaatcacctgaaagtttctcaaatactaagcaatataaatgtttatatagcactgttacccacaacaaaaaaaatctacacacacacacatacatgcacacacacatgtacacaccgcacatatataattagagacattatctgatgttaccgcgactgatttaactaatttttttcaaagtttctaactatattcagaagagctacttgttttaacagttcctgtgagatgtattgtactgagaagataactatatcttctcatgagtctaccctaactgcaaagaaacctgggggtgctccaaggaaggaggtttgaactaatttttcgttttatctcatttttgtgtttcagtaacccagttaactatataaacattgtttccttttaaaaacaagtatcttatagaaatgtgtatttactctcagctaaggacgttagtagaaatcttatctggattattagaagaactcaaatatgagagtccttgaactagatgatgttaaccatttcctgcttagtaaactgtgagtgccatcagtgtccacactgaaagctcaaaacagaacactaaaacaagtcatattaagatgaatagtaaaaaatataagttgttttgtaagtgaaaaggaaaacaagatatgatgacagagaattctcacagatctcagggagggttaattaatgatcatcattaatagtgatacttagtagctgtttctgacacttgtgattttaaattcaaatttttacttattcattttttccatgtttatttttaatcttcatttcctagaacctactttgctgatcaagtttccatacctttaaatagattgtcattgtgatctctgaccatagaagagataatttgattaacttttgttcattggttgaaattgtttacacctactaggcagtgggtgtttgagagaataaaacccaaagctagtgtggagtgggctggcatgttagggacagggtgcactcccagttgaaagactgctgaaaattgatagggagatgaggcagggagttggtcaaatgaattaggctgttaggaaataataggaagggtacttctcctatgttgtatatccaggactgagcctggttatttcatatataactacaagatcagaaaacaataaattagcagatatataggtaagtgaaacaatatcaatgacactaaagcattaggataaataaataatatttaaataataaggtacttgaaaaaattgattcttaagattttcatgaaattctgttatctaaatatcagaaaaatatatttatagatacaagattttgcttctaaattgatcaaggcattgtattttgcattactggtattaaattgctttttaaccaggttgctaacagcacatctacagatagatatatttacagatagttagaaacagggattattagaaagactgacagaggccaggcatggtggctcaagcctgtaatcccagcactttgggaggctgaggtgggtgaatcacctgaggttggtttttgagaccagcctgaccaacaggtgggcagatcacttgaggtcaggcatttgagacctgcctggcccacatggcgaaaacctgtctctactaaaaatacaaaattagccgggcatggtggtgcatgcttgtaatgccagctactcaggaggctgagacaagagcaacacttgaacccgggaggcagaggttgcggtgagccaagattgtgccattgcactccagcctgggcaacaagaggaaaactccgtctcaaaaaaaaaaaaaaaaaaaaaaaaaaagaaaagaaaaagaaaagaaagaaagatggacagaaaattccacttctgtgactagaactgtgaccatctcatgttgatactgtggtatacggaaagatgagcccattctctggaggaatgaactatgtttttccggttcacttacttcctcctaattgctgtaccaacattctttcttttagactttctattcctgaagctactcccttgaattgttcatattaaatttgctactcctttgagtatccccacaaatctgcagcatccttttgtagcctgcatccattcactggagtcttctgctttgtcatcatcaaaacatatctggagattttattgtacatttttcctgaaagatatatttgtaaacggaagactggtgcttgtgtcttatttctccatttcttttatctgtgatacctgctattaggctagtttttattttctttcgaaaatatgacttatttctttttaccaatacaattgcatatcttaaatgcagaattgttaagtaaaaaatatatatatatatttttttttagatggagtctcactctgtcacccaggctggagtgcagtggcccaatcttggctcaatgcaacctccgcctcccaggttcaagggattccccttcctcagcctcccgagtagctggggttacaggtcctgccaccacacccagctaatttttgtatttttagtagagatggggtttcaccatgttggccaggctgctctggaactcctgacttcaagtaatctacccgcctcagcctcccaaagtgctgagattacacatgtgagacgccactcctggctaaggatttttactagtaaaagtgaaatgtgattgtatgtatgtgtaaaaatacatatatgtatacatatgtgtatatatctcattaaagaactgtaagatgtcatacaaatataaagtcgattggataagaaagattgaattatctatttataccaattggtttttctttgtatgtacaattagccctctgtatccgtgagctccacacctgtggactcaaccaactatagatcaaaaatatctgggaaaaaaaatatctgaagtttcacaaagcaaaacttaaatttgctgcccactaatttgtatgctgaatccaagggaatgaaattatgtgtaggcattgtgttaggttttataagtaatctggatatgatttaaagtttatagaagaaaaaaatgtataggggaagaggtgagtaggttatatgcaaatacaacatcacattatataggagacttgagtatcagcagattttggtatccaagaaggatcttggaatcaatatcccacgaatcttgagggatgacagtgtgtttttaatctcaaacttttgtatttgagaataagaaatcacttctctttgcaaatgccttataatttctctgcaataaagatccttctttccaccagatttttttttggctttttgtattattaaacatactctatcatcttgcttggtgacaagatgtgattcctgataatttcctgttcctttaatgggagttcttatctatgagttgtagatttagtcttccaagattccagcaacatagcttttagaatggcatttccccatttattatatagtacttaaataccaaataactaaaaataactaacaatgatagcataaaaatatgccagcttctgcttcttatataattatttgatttaaatattgtacttttatctatcccccccaaaccaataaaacattaaaggctttttgatatattgttcagaccatcatatgtatgtcaccttacactttatatttgacttcactttttcattcacgcattttttttttggttttacataataaatttaacacatcttttgtgacatgtattatgccagactggcataaaataagggttaaaaaaacactgtcaacatgattcccatacttgaatggcatcattccagaaagagtttaaaaatttggaattagatttttgtgatgctctcatttctattcataattcagagcccttgaaacattcctaatgaggtttcaagtattttatttttcctccgtgctttataaacaaataaaattaaaccaaaccaaacacaaataaagccaagctagaattgtgtatatcatccagctgctccaggatttctctctgaaacttatctgttctccttagataaatacagtggacaccaaagccagattaatttatgatgacaatttctctatctttgaaatgttaatcattgggctgggattaaagtaggaatatataataaatcctaatcaaattctatgaaatattattatttgctttacaccattcagacatatcatactagaggcaaggggaagagaacaaataagaacaaacacagctttaattttgggctccaggctgacttaaatgttggatattgcaggccagttcccaaaggaaaaaatgtatatatgtgtataaattcttagaaaccctgataaagatcctcacggaaatcctgatggttgtgagaattgtgttcatttttctattacatgaagcataaggcaaaaaatatatctctattctgagaatctttcccctctatctcacataaaatatattttctacctctggggaagaggatgaagtgtgtgggtatttacatcttgctttagtttcaaagctagctttaaattcaacttttatgttatttaatttaattaatttaaatttaataaatgatactcgattcagttatcagaaaacttttacatttgtttgaaacaacttgagtaaattcaatctcctcttttagttgtaaattttatgaaatcagaatacaaaccaatttttattgctaataaaattcagcatccacatagagaaaaactgaaaatgtaaaatgcacacctgaatctgaagacttagcatgaaaatggttttttgattaataattttatattgtatacatgttaaaatgattatatattggattaaatatataagaattggttttatctgttactttttactttcatatataactgtaagaaaatttaaaattacaagtctcgggccaggctcggtgcctcatgcctgtaatcccagtactttgggaggcagaggtgagcggatcacttgaggtcaggcatttgagaccagcctggccaacatggtgaaaccccgtctctactaaaaatacaaaaattcgccaggtgtggtggcgcatgcctgtggtcccagctactcgggaggctgaagcttgaacccaggaggcagagattgcagtgagccaagaccatgctactgcactacagcctgggtgatagagcaagactccatctcaaaaaaaaaaaaattacatgtctcatattatatttttactagagagcactagacgatattatacaactggattatattactatatattacagtcatgtgctgcataacaacttttccatcaactcacagactacacataggatggtgttcccctaagattataatattttatttttgttgtatctcttctatgtttagataagtttaaatacataaatacttcccattgtgtaacaattggttatagtgttcagtacagtaacatgctgtacagatttgttgcctgggagcaatgggctataccctatagtctagatgtgtagtaggctgtaccatctaggtttgtttaagttccctctatgatgttcgaacaatgatgaaatcacctaatgacaaatttatcagaacatattctcattgttaaagcatgactgtatatttttatgctattcttatttttaatcactttgaaatcactggaattataataaaagtattaacatttactttagtgcatatatgttagacattctgctaatcacttttctcatatgacctgattttatatgcaggtaccatgtcatatcagtttcatacctaattgtgtgttgtaccatgatagctatgtgataggtactcattgtcattattgtgaataactaattgtaagtttgtcttattagaaataattattgcattatgagtaaacatatgaaagccatatttattgaaaagataaaaaagtttagtaagttgtctaaggtagaattgctcttggcattacttttcctaactaagatggcattgtctcagcatttgggattcccagagaaagtcttttcaactcatggatatggctcaagaaagacatattcagaaaagaaaaagtataagatgggttgtatttattttgagaaaccatcacccagccgaagagagaaaaggttattccattcacatcatgtggttagtctgggaatctttctagtgtaaaagcaagaggagccataaaattaaagaaaacattgatggggtttttagacactaaaaaaaaaaaaaaaaaaatgccatccttctttgctttcttctaaagaatctctttctggactctctgaaataaaacaaatatccaaagcctttattcttcttcctaaaacttgtctacgttctgctcttgagatccatatccaatgcaaattggggaaaataccatattaccatggagaatgattaaataaaaataggacaaccgtgagctagatgccttatttccctgatgtaatctgtgtcttttataaataaattatgacatctttagaaagattttattattgagttttaaataaggttataatttcatgtctagagaaataaattttgattttaaagcaataaaattcatatggaattaactttggctgacactgagggtgtagataaaactaagtactttctcagtgttttactagatattgttggttcaaaaatttattatattggtagagagatgatatctcaaaccttgattaaataagcaattgagtaatttagaaattggtaagagacactgagcgaattgtccttttcagcaatgttgatatatgtcaataattgcttagaaattttaatacatcaaaactaaaatgcattgccaacttctgtatagttcacagaaacttggtttttttttttctcttaccttctattttgctggctattaaatttaaatagtaccttgatgcattaaagatttggttaatgcattttttaactctttttcctattctctttttttgagtgcaaagtgcattgcacacatcataaattaatactgagaaatctaaatttactccaagaaggtctttcagtgaaggctttataaactgggcccttgtttattctgtgtgtggccactttggttattagtaggggttacactgaccgccttttcccagatttatgagacttggcaaaaaccttgagaaaacagagcccagtttctctcaatagaaaacattattagatactaaataaacattaatttaggtaaactggtactattcagcccaaaaggaacatgttcttatttagatttgctctgatgggtgaaagaatatgtgccagaaatgatttatagagatcacaaagaagggaacttaagtaatttaaatttcagtaatagttaagactatccttagaaagactttgtggtcattcatgtagggcagtgatcctgtgctagggaggacatgcatcatgtccttcttccagtggagaaagatcaagacaccaatcttttttttaaatattagcacagaatccccaatagtacaatgattaattttctctggattccaataaaaactgagaaatagggcatactgtgcagttagttgacatatggttttgaaataaattattaagtttttgacaatgttaaaattcctgaagaggttaaagcattttaaaaggaataacttgaacttgtccctcttcaacaagttaatgtcatgaaaaataagagagggggttaatatgtgtgctatattaaaaatgatagtgctgcaactagttataatgtgcttagaattagacgtcaaattggacaaatcacctataaaaacagttttgaaacatctctgaaatttttaatgtgaactgaatattaaataaaatgaaaacatagtgatgagtaaagtggaaacaattaactcattagtagtttataaactagattattgatataatctcattgttgtaaaatacatttatgtatatgcatagaaaatagggaaaaataaagaagattttaacagtgatcatctctaactgaggtgttgataggaagatggtgttttgattttctttttgtatacctaccatttttttaatggtagaatgtgaaaaactacttttataataatcacagtctattattaatggaataattaagcagcagcaaaatatacattaattcattcattattaggccaatccccagggaaaccagaagaaacttgtattaaatagatttatctcttaataatgactccttaacagaagcacttaataatgtgttcgtgtcttgcaggttgtaggctatagattatagggagtaaataatatgattattatatatagagatatatagatatagatatagataaaactctgctataaaatgttggacagaaatttgtgctgatgtttgaagtgactatgatcaacagtgtctcaatttttctttttaatgtaagtgatcctgtacatatcagaacagtaagtcaccttaaatcccatcatcactagtcccttcatttaaagatgagaaaactgtaattcacaaaaatagaataatttaccaacatctactggctggatgtaaaccagaccttaacttatatgatttctaatgccgtgcattttcactctgtcacaatcaaagttttgcatatttgaggaaaagagaaaatgcagaagtcttatttaataaatgaattattattttatattgagtaaaataaaacatttttattgatgttaaaaaacattaaataaatgctcttataaacttaattttttaatattagtaaatatgctaatatataaacattttgaaaattatatgataatagtagtctgcagtaatatattgttaatatattaatgtaattaatagtagcatgtgtaataattaatgacagcatgcaacaagtttatctaatttaacttgttttgatcactttttctgtggttataatagtttacaatgttgccctctactcagggaggtaaaaggtgtttattaggtgtgtttgttgtgtgctgagaatagttgtttattctgcaacagcactgtaaataacagtatttatcatttgtctaattctttgatagagaaatagaatgtacatcttaatatagtcacaaaaagaagaaaatacaatagtatttcataagttttaaaatggttattttttctcacttcaatatctctgaaatcaatggcatcctacaaccaatgccatgtcatagttaaaattgacaagattgttttcttagtgagacataaaataatgaagtatattaaaatgacatcttaggttagattaaatgttataataaataatatttattcacttctttagaaacattttcattataagttcaaaagcattgttcttaaagaatagcattcatctgtagtccctttgtgaaaaagacagaaatattattacatggatttcaggatgctataaatcttaacttaaaagcatttgctgatataaaatgatgttttcattgtgaagataaaatagtatatataaatgtatatatctatttgaataacgatatttttgctacattgcataactctttagtactgtttaaatctaataatcagtgctcagatcttactttattgacatattagtaacatttaacccagtggctctgctgatcactttatcttcctctgatttctgattcctgtgaagatttcacaggaatccagagtcttacatatttctcattgtccttctccacaagtagattttaccagtctcagttgctggttcagcctcatctctctgacctttgaataatggagtgtgccagggatcagtccttgcacctattttttcctctatctgaatttcttcccttggcaatctcacctctcataaatgccacccttatacttatgactgccaaaattatacatttatctttgactactgccttcaccttttgactttaattcagctgccttctcaatgttgccaggtgaacgtccaatagaaagccagagcatatccaaaaccaaatcttgatcttccagcaacctccaaaatgggagttgaacaatgagaacatatggacaggggggaatatcacacatcggggcctgtcagcaggtagggggcaggggagggatagcattaggagaaatacctaatgtagatgacgggttgatggtacagcaaaccaccatggcacgtgtatacctatgtaacccacctgcacattctgcacaagtatcctagaacttaaattatatatatttaatttaatatatatattaaattaaatatatataatttaatttatatattataaattatatattataaaagggaggcacaaaatggaaagaaaggggtgaaaggtattcatgttaatacacatgtaatataattatgatatttgagttatgtaaatgttttatataatcaaaaagcaaaacaaaaaaataagaaaaaaagcttaaagtacacaaaaattagccaggcatggtggtgcacacctgtaatcccagctgctctagaggctgagacgtgagaatcccttgaaccggggaggcagaggttgcagtgagcagagatcgtgccactgtactccagccagggtgatagagtgagactgtctcaaaaaataacaataaaattatgaattaaaaaagaatatcagttattgctcttataaaatttacagaacattttattcctaaaattaattaattgtttaatgagtcagaacagcagataactattatgtttcctctgtataattgtttgacttcttatctgtctactaaacatttattatgcttttactttgagcccattcagcttctatgggctatctgaagtagatttaagagagtatacattttctgtgcctaagcatctttccaaattttttggagaggtaagaggcatgtaaaattcaggccatatgcaagaaaatttgactgtaagtcgatgtagttgagaaaaatctgctgtagttaccctggtagaaagtgtgtgagtgtgttgacctcgaacttacccagaaatgttttttggataaggttggatcaggacagcagaacatcacacagaggaagaaggaaatgaatataatttagatgggatgtgttcattgactattttgcctggaacagggagtgcacattgaggaataaggaaagtaatttgtgtagttaaagaagggatttggataccaacctagggagtttatatttcaaattagagatggcattatgaaagcaaacatttgaagaaaacaagcacagaaaacaaattatccatttccaggattgaagtctatgggtcaagtccagaataccaattgtagcaacccaggcattcaatcagaggaactcggtgctacattagtggcatgaaaatggagtagaaaaattaatcgtaggtaaaaaatagcgtgtacattattaaaggtatcattaatactgatgacaactttgataaagagcagatattcccttgccatatccctgtagtgtctgtgttatgtgtgtgagtatatatgagatttatatatatacacacacacacccctatgtatgtaccatatatatgtcttatatatcatatcctgtatataccctatgtatatactatatatgtcatatctatgtcatatatatacatcacatatatacacatcatatatgccttttatgtatatcatatataccatatgtaatacatgttacttctctatttgataaaaataaattataatatctgaaatcagagtttctcatatctgactctgctgtaaataagatttaataacattgatccctgaaaaagtaaaactgaattaagtcaaaaaggttaatctctttttaaagaaaaaagtctatgtatgttgttaatcatttaaaaaatattcatagacactttgcttggctaaaactacataagtcacattcctgttatattgatgacatatcaacatactaaatttacattaaaaaaccctgaccctgagtggctaattgaattcctgaaaataagatgtccaggactacagtcatgtctttagacccttaactcagagcactttccgctaaagcatggtggatccctgttcatgttccctttgcattctttatcaaagagtaactggaaaatctgacacttatataaaacatcagaattgaattgttcaagttaaatgataataaaaatctgtaaatagtaaaaaataaaaatgtattttcccagttgatacacattatattttttagcaagagaaagcataatatgcctttcaatgcataatgattttactttcctttaatattttaaataaaaacatattgtagacaattgtataattcaattgttttaaactaaaataatcttgaaataccatttacagattataaaaatgttttttaatatgttactttaccatattgcgctacattgattgatcaatagatagatgatataagcttgctttaaataaatcaaatgcaatatttggaaaatcaaagttctgtgtatacttaatgctgatgcttatgataatccctggaagttggcagcccttgttgaatgattaagtaaaatagtacagaagtcaactttttaaaggagaaatcttgattttatgaggataatgcagtacaagaattttgctgaagcattgtctgaaaaactgatttattgaagtgccaaggatagaaagatatctttttctcattgttttataatcaagaattcgttgctcttcattggcattccaaaggacacacgcatgcactattacaattgaactctacattctttcttacccaagatagcaataatctctacatctctacatttttcctctgagtagcttgcatattttaccaattagacattgctctctcatcctctttttaatctgggtttgcatttatttaggaaaaggtctgtgctgtgaattttctataaatgtgggaattgtatagacaggataaatgcttaatggatagttctcaaatatgtctttaaattctacttaattttatgctttgtcttctggatacaactcaacaattcacaggaagagagaaggagaagtagaaacgtgatagtaaataatcccattgaaatatcattttcttattataattttttttttttttttactgagccaacagggataggaagagggagaaacttgacaaaactttgcaaattgatttttttctaattaattttttctaattttttcttttttaatgtttatttatttatttatttatttattttattatacttaaagttctagggtacatgtgcacaatgtgcaggtttgttacatatgtatacatgtgccatgttggtgtgctgcacccattaactcatcatttacattagctatctcccctaatgctttccctccccctctacccccacctcacgacaggccccggtgtgttatgttccccttcctgtgttcaagtgttctcattgttcagttcccacctatgagtgagaacatgccgtgtttggttttttgttcttgcgacagttaaatgagcatttgctcacttctgaattataactaccaacatgattcatgtgcaaaccataaccagttgagggaaaggaactctcctagtctataataagaaataattgtatcaaaaagaaagaaataattgtcataatagccattgtttattttgcaagtactatgtagatacagattttaaagtacattaattcaaatgcaaaaacatagcaaagttgccgttacctgctaaatttcaaagaaaatcttatcctggaaatggtaaaactggaattcataatcaagcctgtctgactccaaagttcaaattctcaccattatctcgtggcccttctctacacacaggggttttctaggatattctcaagtgatgttagaaaaaaaaaatgtggttctaaaaacttgcaaaaagatacccagaattacaaagaatgtccctgaatcactcagttattcctcccgttttggagggtatgaatctttataacatctatagttctttctagtttagtccccacattcccatatgttccttggacacttggggagacacaaagtttttgagtttttatgatattatacacaatgatactgtaaagagatttgaaaagcttctccatcatatgtcaaagaagtgggctggtgaagcaaagatgagactgagttcttctttcatttatttaataaataaatactcacatctgactccataccagagactgtgttaagctttggggataccgtggtaaatgtaatagatatcccgaattcatgtggttcaaaagaagtaaaagtacatgtttcggtagttggagattatgcttgttctggaaggtacaaatgaaaatcttgcaagatttagggaatgatctacttatcacttggaaatatattttaaactgttatttttattatgctataacaactcatgttttgaatactctaaaaaagtacagaagttgtaattaaaactaaatttcttgatatgcataaacatttttggttattacaatatccaaataagccttcaaaaataactttaggttggctttctgtcaaaaccatttctaagcatttatatcagctccaagacctccctcatagacttttcttcaaacatatttagtagtctctagttgaaaattctaaaaaaatatttttcattctgccttttattttgtatagtctaacaatttccacatccaataaagcaattaagtatgttctttttattaggatttcagtttggcagtgcatagaggctcaatgaattagaagttcggaggaaaataatgtattgttaatactgcaatagggaccttatctaattgtgcattgaaaaacatgtacactgtggaatgggagttgagaattttaatgccaaattatacaaacacatttgtaaatatgataggagaatatgggagtttccagacttccttttaagtttcatatttacttactatctttagaaaatacttgctatcatagtccatgtaaaaatggaagaccattaagctaacatttgttagagctagctatgtgccagagaagatactaagtgctttccatgcattatttcattttattctcacaacaatcatatttgataagaactgataatcctatttcgtagatgcagaaactggacttaaagaaattaagtgaattctttcagaggataaagttgataagtaacaaaatagaaattacaaccaaaccatcttatagccagagactgaacttttaaccagtaggctgagcaatccctggaaaattcaagaattttatctcagttgctataacacatggtaaaaacaaataagtttaattattgaggattttgagagactatctgaattgaactctgtatttaaaaattcagaacgttgcgctagttttagaacatcgtgctagctttcaagtcaacttctgagatcatgtagtaagaggtattatattttctccaagagggaaagatgtaaaaaataaaaatggagaaatatccatcggcagctgtatgtatgctcaacccaggaatcccctgcttatcctgactgaggcactttttaatattcatgtaagtccagtttttaagatgtagctgaggatataaggatgagactaaacacagctcagaaactgatactactatgttgatagagaactagataaggagggcgataagggtggaggggaaattagatagcacaaatattcaacacatgacttcaacagaacagtcatgcaaaaagaagaaagaaagaaaacatatctacataggaagaccagagaggttttttttataaatatgtggctgcctgataaagaagctgaaatttctggcactttattagtctcactgtcacaagacaataccccaactcattctatacatattgcgtatgcactggggaactgcaagttactttctgaacacgaatatattagtccaggaactactcccttatacgtattaagagaatgtaaaagagatgaattcagcattaatgatagaagctctttaataagatccatattatgcttctatattgcatgtccagtacatcaaataatgtttctaaaacagtgttatgaggtcatactttaaaatataataaattcatgtgaaggcatatataaagatagtataaaacttgtattaattataagatgatatttctacattttattatgttatttggaattatataatacattgacattaatttttaattttattaattttgatttgaggacagtaatgttcatgctagagaaacatttcatccttatgcaaatatgtattttttaatatgttcttttaatagtccatgttagaaccaccagaaatattaagatgttctaagatacatactagctctttgaatctgtggcagagacaacttcaactcttggtatgctacaaatatagtaattttgaaaactgttacaaataatactggcatgttcaagatctgaaatggtttaaaatgttattaaaagtatttttttatgtttaacctaccaaaacctaattcaatctcaatatgatatccaattttgccatgttttaagttaggagacattgcttcactgttttacgagtttccatagtcaataaaataatttttgttttcttgctatttatgaaagttttgctatgtttgatatataatcacagggtattataaatgaaatttgatcaaaactatgttttataagctggtatggatgtctaaatatacttggtaaaaacatgacaattttaatgtaagtaaaaatagtttcaaaaattgatcataaacaaatatagctgtttttaaacatgattctttttcatgtaaaaattattttaattaactatctaaaataatttcagacatatgttcaaaaatggtcagcaactactaaaatataaattatgtgaggttcctaagtggcatcatatttaggaagaataaattttaaagaaagctgaaaacagaaaacattaataaagagtttgttaaaaaactttacacctttaaaccatactatactagttgtaaaactaaatactaggtgtgggaatggagactagaacactgaattaagtctcatagatgcataaattttttttaaattaccacctgttaagattcaatacaaaggatatattgaattgcagacatacattattgttatactttgaaaataccattgaatgtactatatcttcgtatttcacaagatccacaagatttttaaaatttgttttcccctttagaaactagtatcctttctggagaaggcattaaaggaagcacacttctttgaatctttttaatccaagtaaaaatcttaaaagtcaagtactacacatattcaccaatgtttattctactttgattttaaagttttatatgaggttattgttgatcgggtatttagttattttctctttcttgataaattatgtgatttaatttaaatgagtagcattagaggtgctccaaatacaattatgttatatccttcataatcagattcaaaccatcactttcattctccccgtttaaactatacaaatggaatttatttgcttgcttgtttctttgtgtttatgatctcaaagaattaaaattattttcttcatttgctttcatactcttggatgttatatagtattttcctgaaaactctgctttacaggccttacaaactgtacttgtactttcagataatcatgaattgtctttaaaaccataattttctcttgttcttaaatcgagttttaatagaaaattaagacaaattgaatataatgatttttaaatgactaacactcatggatcacttactgtgtactgggcagggtgcggtgctttacatcatggtttcttagtccttacaacgaaggaatcagatacccttgttatccacaatttcaggtgagaaacatgagccacagtatggttaagtaactggcccatggacaaacagaaagcaagtgacagaccttggctttttgcctgtgcgcttaaccactgtgctagtgtgttttgacatgtcccagaagagttacggaagatatgacctgggatatgtggaggtgtagctaaaagaaacttcttttaccttgtatgacaaggcagtcatataaggtacaaataatggaacttatgatatcaatttatttataaaacttatatatttgttttaagctatttttaactttctcaatagcagagttaaaccgaacataggaatatttactgagtcagggattcgagaacttttgaatttctggtagaagctggtaaattatttatagcaaaattcagatttctcctagggataacgattttccagacatccagctcgtttctgggccagaaggccccaacaatgagcatgtgcaaacttattctataatgtttaccttatagtgacacaattagaaatacaagtgggttggaacagttgcatttgaagcatgttaaaacaagatggaatgcatgaacatatgtcattatcattagaaatataaaaaatgttcactaaataactattactgctaagagtgctggacaattctttcatttgttgaaagaaaagctgccctttttgattgcataagtcatcatcaattgttgaatttaaaatgttagttattgatagttgctgagtttggtcaaataccatgaaattcaaatccgatatgaagacttggttcctaaattccacatgtgatgctaagttcctttcacatctgcctatttgtgttcccagatagcgttatgcttatgaaaattatttaaattttttatcctatttccctagggtgtttacttccctaaggtgtttcattaaatagtgaagaaagaaacaaatagtgttaataaatttagcacatcttttttaaaaaaataaaattaggctatataggattcatttaactcattataagtgttttgatcttaacagtacatgtgttcctggagaatttatgtgaatatgaaactcaaggtcatagttttcctgctacgtgcagtttttttagattaaatgtttgctgttaaatatgggcattgatggtagatttgatggcatttctttatccgtttatataaaaggttaggatttttatgaagaatccttatattgtcctacagcatacatccaaaaacgtaatttaattatttcataattatttactgctttccagtagttacaaccttaaaattctaaactaagtaggtataaccccatgttatcatttagtcttagtgtaggaatttattgaaatgctatttcctatacataagtggttgtgtataagcaggcttacatatttttacatgttggcaactataacttctgtatgttgttttgatgataagatgaaatcctcatctcacagtctgataagatatgtattaaataacaaaaaaatttcaatttttcctcctttgacataactaatttttttcagtaaatatttttaattagaaaattaaaatatacatatgaagattgtgaaaaacatgactaccacacatgtcaataaataaaaagaaattctgttttacaaatttatctgtcgttcctatgtaggtgttgtgctcttctcttcatgcatctttgcattgatcttaccttagaataagtgctgctgaaagaaacaccatgataatattttaaaatataataaagtaggtgaggcacagtggctcacgcctgtaatcccaatactttgggaggttgaagcaggatgatcacttgaggccaggagttcaagagcagaccagcctggtcaaaatagtgagaccctatctctacaaaaaaaaattagctgggcaagtggcacatgcctataatcccagctcctcaggaagccaaggcaggtggatcacttgagcccaggaagtccaggctgccatgagctgtggtcatgccactgcactctagcttcagttacagagtgagaccctatctatctctaaaaaaaaaaaaaaaaaaaaggaaaaaaatatatatatatcataaaaatatctgtattgctttgaaaaacaagtttccaactacccaattatttatgctgatacagagaccatggagccactaacttggttataaaatagaatattctgtacattttattatgaataatcaattttttacaattcaaatccatttattcacataggcagaatatttataatattagatatagattataaattctggggaaatattaaatggacatataattcaacagctgaatgaataactgaatgtgaatttcagaaaggaataaattaaaatttttggatatttgccaaaatattgcttagttttgataaaaatgacatttctaaaaaataaaagggcttgactaaattagaaataagcatatctcaataataaaaacatagttggcccagtgcagtggctgatgcctgtaatcccaacactttgggagcctgaggcaggtggatcacgaggtcaggaacttgagaccagcctgatcaacatggtgaaaccccatctctactaaaaaatacaaaaaatttagccaggcatggtggcgtgcgcctgtaatcccagctactcaggaggctgaggcaggagaatcacttgaaccagagatgtggaacttgcagtgagcagatattgctccactgcactcctgtctggttgacagagtgagactctgcctcaaaaataaaataaaataaaataataaaataaaataaaataaataaaaacatagttaattcttagttcattattccaagaaaatataataattttcctttcatattttcaataattcctactctgctttattcaagtctcttcataaaaaaaaaagcagatatacctaagaggcacatatcagaatatttgaggttgatgcttttgagtttaaaaaacaaccgatttatgttttgagtgcagacattaaaagttgacaaaatgttctacaattatccaaaagcatattataagattatctgggtcatgaaaagttgtatgagttaaaatgctcccgagggtataagaatttgaaaaggaaaatattgaaactttgggctgtcgattaatctgatttgaagaaaggtcaactctgatgatgttagtactttctctgacccttcaaattgataagtatcaattgctgctttgaagagcaaattgatttgagatttaggatgaggaaaatgaatatcaataaagtcattcacagtaatattttattaaatttttataaatgtgttaacttcaacagtttagaccttggaggcactttgtttctttgggacctctttacaatttaaaaattattttgttgttactgttatggtcaggaaaaaatgaaacccacaaggcttaaacctaagagattacacacatatattctaaaatctcacaattgtattattttctgttgaattcattagaggtaagatcttacagaattttatttggctcttagtacatggctataaggcatgcaaacccaagtaaaatgttaacagtgttgctttgttgaacagggattataaactatatactctcagtgtattttagcaatgcaaacataatgtttaaaccgctacaaaataaaaatgtaggtactgtaatttatatttactgacaaatagcttagctcagctctacaactaatttctgatgataatcgtaatttgtttggtgtgtggagaaatatcattggccatcataaagaggtttggaagtagattagcatttaatcaaatataagactcttcatgatctctgaggagtcagatggccttccagactcctttagaatatatcatttgatggagaattcatggcatctgaagacaatggacaattagtctttcaacaaatacttgctatcttactaaagtagtaggatattttatatgcctattagaaaatacacagaaggaaacttagaaaggataggataaatttatgtgaaagttctagcattccaagctcttttcctgtggaccttttcacataccacttgaatcctactttgatattattgcacttgatcaatggaataaataatagccccctgtaacataaagcttctctgtgtttgcctatgttacccctttggctttcgagtttttttctataatccctctttgttgtgctgtccacagccatgccaggaagtaatgttaccaataattgatcagtcatgtgcaccctacaggaaaaccatctaatcaaacaatagctcaaaataggagcagcaatttggcaaaagtgagttaatacagatattgcttttaatgctgagataggcatatttccttgtgctttctgaattgggtaaaaaacattctcaagtgaccttatatgtaccactaaggtataaagaacaaagagctctttataaaattaaaaaatcaggggttctttccttcccttccccaacctacacacacacacacacacacacacacacacacacgacacacacacacacacacacacacacacgagaaagaatcctaaatctaagtgttctagattttcatgcaagaagacttacatattttaatcattgttccgtgcatagaagctactttttcacattaatagtacctgatcctggcttaatgacttttggaaccaatgcatatgaataaataaagcaaatcaatgaagttcacatgtaaaatttcatatttcttgctcctcaaataaattttaccatccatctagtaagttctggactctttgtgttccttagggaaatggcacaaggccttcttgaggttagattatgcatttggatctctgatttagtggaacagtgtgtaaaagtctctcataatcagaaaactccctattggctccacatctgaagattcccaagagtgctgtttctatcagggagcatctggaatagattatatgcagttaattggctccaggtcaagcttgttacagacagtagcatgcagtataacctatgcatttcactaaatccacccacttttggttaaatcacacctacttctctccataattcatcccagatgcacaacacacacacatgtgcacacaacacacacacacacacacacacgaagacagcaaaatatcaatagagtaggaaggaggttgttggcaagacgtttaacccataaattatctcaattaaaggattaactattgaatttataggattgttgggaagaaaaacaaagaatcaggaccagtagattgtaggtcttgactgttttatagtagaaaaatatataaaggcttttaagttccagcagtttcaccatttttactttattttgttcctccaagtacaggttcagcacacgtgggcacttctcagaatgtcttagtagtaaggaaagcagggctttgatttttaacttatttaacaatattaatgagtttggttacaaggaacagtgttactactgttcagtgaaaaccaaaacatcaatcttcttaacttacgatgttagaggcacagggcatgtcttagcgattaatgaccagttggaggagtaggtatctcaatgcatagccaagggccattaaccccaactagtcattaattcccaggaaatgtcctgcactgaggtcattattgctaataaaatgcacatatggaaagttccctcttttttgcctatgtatataaacatacattcacgttacatgcattgttacatgtcataaaaaggtatttcacatgtccagaagctcaaaaaaaaagtgtaatgagaaattcaatatactcagtctctgcattcattttacctttcactttttttagagggtatgggtaggagggagaatacatgtttgtatgccacagctgtgagtctgctgcaatcagatatcagcgctttgctaataatgtgaatacaagaaataatggaaggaacaggataatgcgattggagaagcactgatgaatgtgggtggaacagcacacttgatcaataccaaaaggcagtacgaagtgaccatatgcattgttttgagtcctaatgtattaggtaccagaatacgcagagccaaatttaagagttagcccaagattctctttggtgtccttctgttctatgccactgaattatgccacattctcttccctctcatagccatataaccaagtctatcatgcaacctgccttgctgttcaggagtccttaacaaggtttcactgttttctggaactgtctctgtttgcttttccagtctcttttctctgtcctccatgaaagtatacttgtcttgtttaagcctatatgatactcctttgagttatcttgcatagcgtatcataaatgtctccattttaaatttattttatggtactttattgtgtataatcaaccattcccttcagaaaaataatcttattcatttcctcaccttataaatggtcagcgattagatatgatgccaatggctgataagaatatatataagtgaatatatgttagatatattcaaataccatcacaagttatataaatatatctttattaacatataaatatatacatatttaaaacttgtattggaatttgtataaaagcagcaagtttttaaggagaatctgtaagtcaaagaatactggtattctaactaacaagttgaaactaacttttaaaactaacaagttgcaagaatgcattgagattgaatgattcaaaactcatatattcaaatctaatctgataaatttttttctgtagatcagttaaagtgactgttttgtggcaatggcattaatgtgttcctactggcagttaaataatataatttttaggactttaggttattttttaaaaaaggctttattagtgttatatattaaaattagcataattgaagtttttaaaactaaaattttcataaagggctgctgatggtgtaggttttggtcagaaagacattcctgttgtctctcaaattttatttaatttaggtgaaacgttcaggaaatgtcaattaaatgtaaataaaatatgcaatatttgttatatttaatacaacatgattgaaagagaatctaaaccaacttatatgcatatgtagtaaccttctaaaagaagaattaaatgttgacagattatatacaaagaataatttagtattccttataggtatctttgaatgtaatgaaatgtaatgattgatgaaacaacttattaagcactcatgtttaacatttcatgaagaaatgcagcataaaatttgaagtctatccttaaatgtttatcatgtataaacataatacacatcaaaatttgattttattttacttcccaagacttgacttaactactgagatttaaggtaactgaaatcttgatattcaaagtctgggagacattttaatacactgaagagctgatctcacttaagaaaaattcaacccttattaggccttctcttaaaactaaacaatataggcataaaatatttattttgaatgttaactaattacaaaattacttaaagtctaatgctttttttattatgatcaaagctatcaccaataaatctatcatcaaataaattattggtcctgtggcctatttcctagtaacagcagtaagttaattaacatggaagagaagttgaagactctggcaggagctgaagatcactagattctaccataatgcaaagcactggaagacttaggtgtgaagaaagcagactctagctaaagtcctgatgatgtgttgatttgatccatctcttacttgccgtgtacccctggaagaactatttaactctgtacctcaattttgtttcatcggtgaagtgagataaataattacccacccttaatggctgtttttaaattaaatcatttaatctatgtaaagcacttttaaaaaagtattgggaacatataaatgctcgataatatgatttgtaatttttgttaccaggcttagtttggaatacgtgttttgattgactctacatcttacagaaaacaaccaagttagcctattttatggcaacccagttaattaccacctcctccctcttataaacccttatattttggaatttgtttttctattcattacttccctgtgtggaataatacaggtttcaggtaacattgcattgttccaggcctaacacctatactggggccctgacctaattaaagttagtttctcacatttaagtgtaatttttagatgtctctaaactcagaaacaagagaacttgtctcaaaatgacagcttttgtctgttttagttggtggatcttttcatttggggatgatatggggcacgtataggcttctaccagtgaaagtggtctcgtctgatcaaataattcaagtttcgacaaaagttggttcttcagatatttgcttaaacaaaacacaaaaacaactttagtcaaggaaaaaatgttaaataacaaaatagtttaaattcttgtggtgcatttatttctacatctgagcaaagccagtccttaattttattccccagttctgattcatttctataagagtaaaacaagagcgatgggaaaattatttttaaaaatctatatacattcagaacattataatttagtaagttgaggaaagtctaccaattgttatcttaatagttttttttttttgtactttaagttctgggatacatgtgcaaaacgtgcaggtttcttacataggtgtacacgtgccatggtggtttgctgcacccatcaacctgtcatctacattaggtatttctcctaatgctctccctcccccagcccccagcccccaacaggccctggtatgctatgttcccctccctgtgtccatgtgttctcattgttcaactcccacttaagagtgagatgatatggtatttggttttctcttcctgtgtcagtttgctgataccttaatagtttttttttttttactcttttttagattaaattaacaccatttgaaagagaacattgttttcatcatgaatgctaataaagatgaaagacttaaagccagaagccaagattttcacctttttcctgctttgatgatgctaagcatgaccatgttgtttcttccagtcactggcactttgaagcaaaatattccaagactcaagctaacctacaaaggtaaatatatacatattttctaaattgtttattaagattttgaaatgtcttttttgattgctatattttttctttttagaaaagcatattgacttctgtgaaatgttttggcatcagttcataaaaatagaattatagaacacgaagcccaattactcatttttgtgaggaaaaagatgctaaagctattcaagtacccttttcagcccagtatttataatattcaatttgatctgcaagtggtaaacagtttggtgttaaaacaaataaattcctaaaaatagaaaaatgttaacacatttcatataactcttactagtttattcctagttagaggggattttttttaaaacacagtaaggtatcttcaaaaagaatttaagacagcaggatagcttcaagttctcaactatatatgtacttggtaatagaaaaagacaatgtgaaaggtttaaatataaaaaagatgaaacaattttctaagaaatgaaatctgctaagctagttgtttttaaatgtttgatataaaagcaaagtttatatgaattatggttggtcaactttgtgtgtgtctgtgtccagtttcacgcccaaatagtttttactttagttttcctttttgatgtactccgggcttcattaatacctcaagaaataaaagggatgtagggagaataaaacttctttattctcaatgtgataggcaaaaattatgctggcaatttgaatatcctctgatatctttaagatcacattttatagacaaacgaaataccaataataaaagcaaattggatgtcaaatctaagagtaagttgaattagcacattatatccattataaattttatatgttggtatttgtacagaatatatgtcatgtattaaagagttaaacaataatttatgtatttttgagttcttatgtatttatatgtatcaaactcatttaaattggaagtatattttttggtaatctaggacgtttttatctggaaaaattgatcacattatgaaatatcatttattgatgtcttatttaatcaataattaaaacctttttttttttttttttgagatgaagtctcattctgttgcccaggctggtgggcagggcatgatctcggctcactgcaacctccgcctcctgggttcaagcgactctcccacctcagcctcctgagtagctgggattacaggtgcccaccaccatgcttggttaatttttgtatctttagtagagatggggtttcaccgtgttggccaggctggtctcaaacccctgacctcaagtgatctgcccacctcagcctcccaaagtgctaggattataggagtgagccaactcgcctggccacaatcgataactaaaacctgtatttgaatgtcttccatttcttaatcatagatatattcaattttctgtcattcccctaaaattatcttagtttcaagtgaacattaacagttttggtaaggtttaggctataaattaaaaacaaagtcaaggcttttaaccttgccagtataaatagtattgaattataccttcttccataaacaactcttcaactagataaactacatgaagcaactatttttagatattgagcaataggcagcaaagatgaaagaaataaaccaccagttgtacatgcctataatcccagctattcaagaggctgaagcgagaggattgcttgagcccaggagtttgactgcagtgagctaggactgcatcattgtatgcaagaccctgtctctaaaaaaaaaaaaaaaaaattcacttaatggtgcgactcggaaagggtttggggcaaacggggaatttgtgagctgagccaagatattgagctgaaatattggaggtcaaggagtgctgaatgatatagcagttctgcccacccagaattttaaaagtttaccaaacctggggcactcaggtgacatgctgcaagggtaattttgttttttaatttttattttaagttcaagggtgcatgcccaggtttgttacataggcaagttgtgtcgtggaggtttgttgtgcagattatttcgtcaaacaggtatcaaaacttgtacccattagttatttttcctgatcctctccctgctccctacctccatgctctgatagtccccagggtgtattattcccctctaggtgtccacgtgttgtcattggttagttcccacttataagtgagagtatgcagtattttttcccctccattagtaggttaaggataatggcctccagttctatccatgtccctgcaaagaacatgatctcgttcttttttatggctgcatagtattccagggtatgtatgtaccacattttctttatccagtctatcattgatgggcatttaggttgattccatgtctttgctaatgtgaatagtgctgcaatgaacatacaaatgcatgtgtctttataatagaaagatttatattttgggggtatatacccagtaatgggattgcaggttctaatggtatttctgtctttagatctttgagaaattgccacactgtcttccacaatggttaaactaatttacactcccacaaacagtgtataagcattccgttttctccacaaccttgccagcatctgttatttttgactttttatataatagccattctgactgaatagtgtgagatggtatcttgttgtggttttgatttgtatttctgtaatgatcaatgatgttgagttttttttttcacatgattgttgcccacatgtatgtgttctcttgaaaagtgtctgttcatgtcctttgcccaccttttagtggtgttgtttatttaaaactataaaaaccctgaaagacaacctaagcaataccattcagcacatgggcaaagagttcatgaagaagttgccaaaagcaattgcaacaaaagcaaaaattgacaaattggatctcattaaactaaggagcatccgaacagcaaaagaaactgtcaacagttgacagtgagttagcaggcttgagtcaacagacaacctacagaatcagagaaaattgttgcaaactatgcacctgacaaacatctaatataaagcatctatgaggaacttaaacaaatttacaagggtcacattataagagctcagctgttctattcctactgtaagggatactttagtcctgccttaaaaaacatgaaactaagtctcaaaaggattgaaatgatcttccagtaaactcaatatctgccagaaaaaaatctcaacaatttttaaaataagaaaacccaaatcaaccatattctcaacaatttaatatccataatgtccagatacaataaaaacatactagacatacaaaaaaacaggaaaatttaataacaaggaaaacatgcagttaatggaaggcaaattgaagtgatgcagatgttcacattagctgacaaagattttaaaatagctatcataaatatgttcaagaatttaaaagaaaacgatatcaaaaggaataagcagatatggaatctcaatagataagtgaaatgtattaacaaaaataatgaaaactccagtaatgaaaattatatctgaaattaaaaacttactgcatgaattaaagattggagatagcagaacaacattcagtaaacctgaagacagagaaatagggatcatccaataaaaagaacacctgagtttttacatgtcaatttataagatattccattaaactggagccatatctagaaagttcttttgtattccttatgctctttgtgtgactatcatgggattatatctttaaattcttacaagctctattgttttaaaaagatatctatatatttatatctatatatatctacaaaaagatatatttttatatctatatgtattatgtatatgtatctatatatagtatctatatatatggtagatagatacatacatacatacatacatacatacatacatacatacatacatactcttgctctgtctcccacgctcaagtacagtggcaagatcttggatcactgcagcctcggcctcctaagctcaagtaatcctcccatctcagcctcctgagtagctgggactacaagcatgagccatcaggcatggctaatttttgtattttttgtagagacggagtttcaccatgttgcccaggcttgtctcctgggctcaggcaatctgcctgccttagtttcccaaaatgctgggcttataggagtgagccaccttacctggccaaaagataatctttaaagccaaaggttttaggttttgttatggcagtgcccatttctaaaaccaaaatgtaatttggataactattgctgtataacaagccatcataaaactcattcccttaataaaacaattactatatccctcagtttctctgggtcaagaatttggaaaggcttagctgggtggttctggtttgtactctttaatggagttgtaatcagacgacagctgcagttgtagcagtaaggatctggctggcatctcttccttcatgtatcctcaggtttctccaagggagtcttttcacttcggtagtttgggcttgctcagggcctcaagtgcgtatatttaaacaaacaaagaggaagtttcattgcctttttatacgtagcttcagaagttacatggtattagttccagagtattctattggttgcaacatgagaaagccttactcaattttaaaaggagagcacaaagactatatttctcaatgatagtagtgttgaagtcacatatgtaaggaactgtggcatgggaggtattgtgtatatcactgtaaaacacaaacagccacaactaacttttatacaatcttttactttttataaaagacacctatgcaaatcagtgtggaaagcaaatggtgcaggagcaacttgatatcaacatggaaaaaaatgaacctcaatcttcactctataccatacacagaaaatgattcaagatggatcatagaccaaaaagtcaaagctcagatactaaaacttctagaatataacatggaataatatctttggaacctcagagtaagcaaaaatgtcttaggacacaaaaacaataaccataaatactttttaaactagatatcagcataagtgaaacaaaattctgtttaccaaagacatcaataagaggaataggcaagctacaaaatattcacaaaatatatctgagcaaagatttgaatccagaatacatacatgcatacatacatatatacacctatataaaacaatttatataggtgtatatatatgtatttatatatgtatatacatatgtaaatatatacctatataaattgtatatgtatatatttatgtatatatttatataaatatatataaatatattataatatataaatatacataaatatatacatttatataaatatatataaatatatacatatataaattgtatatgtatacaattgtatacatatgcaattatatatacaatttatataggtatgtacatatatgtatttatatatgtatatgtgcatatatacatatatagttttatatatctctctctctgaaacaaattgataatagaaaacaagtttatatagggtaaagtacttattcagacacttcacaaacatattcatgacaaataaacacttaaaaatgctggacctcatgagtcattgggtaaatacaaattaatattacaatgaaatactcctatatatctgttggaatagctaaaaacatgaaacactgactatatcaaatatttgtgaatctgtggaaaaatttaagcttggaaacattgctaatgcaagagttaagttggaaaatttttttggtagtttcttatactattaaacatgcacttaccattcatttgaagttctagaacaggccaaactaatcaacggtttaaaaatatgataacagttgcctttgttgttggggggcagagaggattgactgagaggggcatgagaggaaattttctgagagtatagaagtgttttctatcctgatagggatgttgaatgcctaagtgtacagatttgtcacaactcattaaattgcacatgtaaggtctgtccatttgactatatataatactgccttaaaaagaaaaagaatagaaaacaaatattaaaatccaaggaataaaaaaagatatggaaagtttgaactaaaggaattgaagacataaaaagggaaactccggtttctttaatacagtgaatatcacagaaacactgcattgacaaacgtgggtaatgcaaacatcacacttgcaaataaattttaataactgataatattcactgaagattcatattgagcaaaacattggcataaggactgagtgtgaattatctcattacctctctgtgagatgagtattatcacccctttcttatgtatgaggataccgagatactgagagattgagcagtttgccaggatcacaaatttaattcgtggttcaactcctgagtcaaccccagtctacttacagcctaggatgctagccctgtcttgctcactgtagacataagtatttctttcctgaggcatttacctgtcatagtgaataaatatacagaatcatcatgctgatatttgaccaaaactgattatgtgattttcaactgtaaacattaaatgaagttgaagaagattacatgtactctttaagatcactgggtagccaaaaagattatttgatttttgtaggattttatgccctttgctaaacttatttttttaaagtcaattgtgataaattgtctttgtaatcaaaatttcatagaaaagtgattattaatattaaatcaaatatataaattatcatctgaaaataatagcttgtattaatgtatgtttttggccttagagccaactctgtaaggattaaaaatcttgttttatttatctttctctaaattttcattcatctcagcccttattcttatatataaggagaattgatatgtttttcttggattaaacgcaaaaagctctacgcttttgatgcttcttatattcagtattcgtttcaaatttataattttttcagatgttttaggttgtctgcatgtcaaaggctggtaatcagaagcagagactgaatgcaggatagaaatcctagatatcttccaacacaccctcagcacacacccatacttccctaccagctctccagggctactatgagtcatttctaggttgtatgctaataatagagtagtcacctttgttaagagaattattgataatcctttgctgctcacagcacaccattttaaggaatgctgaaccattttaaagaatgcagagtcttcattttggaaatcacaattgttcaacactatgaagcgtatatttcccattcacttccaaaaatttcaagttttcctatctacctcttctttataaaatcaagcactttagaagtaaagtagctcaaatcctgccataccaccttttaaaactcttttcctgaattttaaaaagctatgacacaaaaattaccattaattttgtgttatggtggggcaaattgcttatataccacgttcctgcttctgaagtaagaatcacaacattcccttgacattttcattttgtctctcatgacaacttattgacttgagatcagctggcactaacctttgcttagatagtattgagagtctgaaaggttattcttgggcactaacacactggtagaatgtgaggttaaaaataatcagccaaaataaaaaataatattggttttaaaaataattaacttttatgggcataaaattagctttgttttctttgctttccataattcataccttctcagtgtaaacccaagttgcaggcagtatctctggtagtagttagctacttggaatagctgcaagataatattaacggatttctttccttttttctctttctttcttttttttctttttttgagacagaatatcactctgtcaccaggctggagtgcagtggcacgatctcggctcactgcaaactccacctcctgggttcaagcgattctcctgcctcagcctcccgaatagctgggactactggcgcgtgccaccaagcccagctaatttttgtatttttagtagagatggcgttttaccatgttggtcaggatggtctccatctcttgatctcgtgatctgcccacctcggcctcccaaagtactgggattacaggcatgaaccaccgcgcccggcccattgaggaatttcttaaagtatttcttaaacaacaatagagttgtaataaccattttatccaaataatactctttaatgaagacttaacttagaacctctgaatccataggagcttggttgtttgattctattgttgtgcaaagaaatttcccttcagttcatgtggcgaattctcgcatatttatgactaccaaatttttttcctgaataataagtaaggaatcatggaggtcagaatgttctatatttccaggtttcgtattatatgattattactataaatattgtcctacaaattgggcttctcatagtgacttctacagtttacgctgcaattgtaaaaataatttttgagagatgatcttcttaaattgcacaataatgtattttctatctcgccatcatcactaaggactttgaatgtgttggggatatttatactcaggaatcactggtgtctgtaatgttatttgtttggaaaactccagaagatgagataggtataagtcatcagcaagaaaagtaactcatctagtatttaccatatattcacccattctacaaatatgtaataaggaatcattatttaccaggcattgttttagataaaagtcattgtctcatttgaacttatttttcagttagggagacaaacagtgaagaagcaaacaaacaggtgaatatcatttcagacagtgctaagtgctatcaaggctataaagccagagaatgactgggcccaggtacactattcagactttatcatgtataagtctcacaacattgtttttatacccattgttttcatacctattttatagataagatacttgaggctcagaccctgaatctcttgcccaaaagcaaaaagctattaaatagcacaaccaagctgtgtgcttttatttatctagttcaaggcccatgttattgtcaacttgccatgcccttgaggaaaacattgcattttcaagaggataaatattaagatataaaaaataacaaggttttaccattagttctttagcagcaagctattttcaataacttctaatagcagtaattatgttttgaacctcccacatttcttaaacgtatattcattgacaagaaaaacttcaaaattcctttttgaatttttatttgcctatcttataactagggattaatgtatctgatagaatggttctttgtttaatcagaattttctaaaaaatgaataagtaaggctatatctttttctgtaatttacaaattatttagctgtgaaattaagcatgtgtctcaagtagagatgtcagttattaactcatctaaacttgtttgatttgtttgatttgtattgatttgttttgatacatctaataatatgtattttatctggattcagtatgatatagcagtgaattatttagcaagatggaaagtgaccaacactatggagaaaaatgaatcaagacagggagctcagtagtggtgggtatgtagtaatcaaatattgtggtcaggaaagcgcttactgagagaatattttcacaaatgcttaagctagtcatgcagatatcaggaatatttttgcagaaagaacatcaagtgcaaaggccctggagtgaaagtgtgtctggcatgtgtaaggatcctaaagaagatggtatggctaaacaaatagtgggatgggagaaagaagaaaattgactaaatagacaattaacaggagagaggagggattagatcttctactgctggcatttagtctgagtattatgggaatccactggagaattttgagcacagtctgacatgatctgactctcagaataatagaatcattctgatttctatgttgacaatacacagaaagaaagagatcgagaaatagggagccaagtttgaggctattgtaataattcatgtgagaattaatggtctgtggcacaaagtgataggagtggatacacaaagatagagccaacaggatttgctgatgagctgaatacaaagtgagagagaagtcaaagatgactccatggcttttgtggttttgttttgttttgttgtggtctacaggtggagctaccattaattaaagtgggaaatactgtggaagaagtcgttttgtgggaagatcaagtggacatattttatttgagaagggtattagacacctaagtgagatgccaagaaggcatttgagtacatatataaccctgaagttcacggagatgtcaattggagatatgagtttggccattaacatatagaaatttttaaatctacaagactgtgaaataattaagggatgaagcagaattcaaaagattggcttctggtatactatcaagtcaggagatcagagaaaggaagaattaactgcaaagtgaactgaaaaggaatgcccaggtatataggagaaaaattaggagttctagtatagaagttgttaaatgaaaaaagtaaaaggaaagagataatcagtggtgtcaaagtcagctaatatgtctagagagatgacaactaaaaagtaacattaaatttaacagacctcactgttgactttgataaaagcagcatgtgagtgtgacagccaaagcccgattaagatggattcttgagagcatgggactggagacattgactatagataattctcttaaggaaatttttgacaattgtgatataggcattagctggagaagcaaagagatcaagagacttgttttaatgcaagaaataacagcatatttgtattttaattgaaataatctagaagaagaataattggtaatacaggagacatgccggataatctacaccttattgaagacagtattgatgagattatttttcctaaaaacagggtacatttagaacatgtattaataaaagtggcttattttgcataataaatgcatcttgttcattatcagttgcaactgttatctagaaggaaagctaggttaaacataaaaaagttttcaaggaggaatgtttaagtatgatatgatacaggctgtaggcactatatatgtttaggagattaatatgtaaagatttggaaacagaaatccagaaagattaaataataatgctagggtcacataagtagataatttaaaaaactgatgttcagatctaagcccactcttttttagtaaaattgtgtttgtattattaatacaacttacctgtatgcaacccctttatatgataataattgcaatccatttaacattgtatatggaacattgctctaaacattattggtctatggagcttcacagagtggtggaagtgacaaaataatataaggtaatatatgatgcactattgccatgcaaacatacaagaagccttcctggaattaagaagatacataaaaatcactaagggctacagtgatcatctatgttctcctagcagggtaaaagagagctcagccttgaggcacttgggttgtgtctttgtttttgcataaatgtggaaataattttagaaagggcatggtttgtctaaaggcaatttttattgggataaaatccagtcaattatgttttggtggaaaactctttttgaatagatcttgtaagcaattggtttactattctataaactattgaggagcaaaagtttttatgtgcaactgctcatttcataattcaacttccctaaatttgtctctaatttcttgagccttattaaaggaattttcacagtgagatttttccgtacatgtgtatgaatataaattcaatgacagttttaaaaataatgtccttaggtcttttttaaacagaagatttgaaaaacacttctctgatttcttaagaactagtaatatacagtttgcatttttgtaataatcctttaaacatactgctttaatccaactaattcaaaagaggcataaattagaacgaaagtcctttttatttataaagatggtcataaaggggtttatttgactaaagccacagtgagccagaaacagtttggaaattaagataaatacttcagtaatcccgatggagtggtgaagtagaagaagcaatagaagtgaacctgtcggaatattcagtggaaatataagtagagaccttttgaaaaagaatcttgtttatctaagtaatgctaaacattaaaatataaaatatagctgtaatgggtgatggggcttagaattagaagataaagataggtttgagctctttctgtcacatgaacagtctatgtaccattagaataattaattgtctttctgagtctaggttttctcatctggaaattaagttcttcttggggatcaaattaaataataaatgggaaagttcctcagatgttacaaaccacaaaatggaggttgtgacagatttcaaagacagaccatacatgtttttaattaattgaaggaatatatgaagaaaatttaaggtatttaagaatataattgtagttgagcatcttgggtagaatttttgctaccacagataacagcaaagatatttgaaatgaaagtctacaatgcgtcctcatcttgacacctttttttttcaagtaaatgcatgttaaattattgtacttcacttctttgtatgaaaaaaaagctgaggggaaaaagcttatatatcattggtttaaactaaacaggtcattgatcacttctagcaattaaggaataagctagttagagatgtacaaatttgaccaatttagaattgtaacagaaaaaaatactgtggccacattgcataaattaacacacaccacgaggtaaaggtttgagagaaattctagtgtgaggaagaatgaaggaattcagctctttaatgcaggcaagctgagaataacaggggcacagtgtattttaaacctttctactccaggtgtggttcaagctgcagttgtatcagcaaaatctgaaatcttgtttgaaatgcagaatctcagacatactctgtgacttctaaacaaaaacatctgtatttcaacaagaatcctcgaatgcatgttacaccctgaaaagtaatgttctagggttcccatgattcatgtgagaatatgaagattagaaaaggaaccccttgtgactgcaaagcattatcacaattgggtctctaaatagcacattaacttctctaaattattaataagatggcaataaatcctgatttagatcaaaggtagataaaccaaggcaaacaaaaatcagtagtttaaaatactgtgagttaaagctttattagacttatgtataagaggtggtgttgaaatacagaaatgatttagacattatttttatcttcaagggcttctagtgtttttaagggacaaaataaatagacaaaataattgcaaaaataccagtgccatagtataaataaaaccaaaattttaaaattatttagaagaatttggatatgaaattgaactttgagcactggaggaagtttaaaatttattcaatgaagcatatgttggtattggagtattttcatcatgaaattgacctaatttaattgtgattgggggaaaatgaaataggcagcatcacgtgggagagactggtgggagagcaggtgtagcaaaagataatttatgaacctgttacagtaatttagagaagtagtaatatggcgggcagtaggaataaatatattcaagaacggagaatagaaaacttgcttgataaaatctataaggctttaaatttagctggatgttgtgtgaggggggttaaacagacttaaagtgatggattatataaacagaggaaagaagagtaaggaagaaaaactaaaagtgattcagaaatgttgagcctgaggattagatcatttcattgaagtcattaaaatcaatgagatcagatgattggaggaaaaattgacaatacgtagcaagctgtggcaaattctaaactgcaacacttgggagagatgatggggttgtgggtgtgtattttgaagtcatcagcagagaactaacaatttatgggagagaaactaaggaagataatgtaaaaatggaaagcattttctcattgcttatacctgctgaatagtacctgaaatcgaagagaacaatattacatgatgatatttttaaatttccctcttgaaagtgtatgtgcaagttctgatgcaaattctctgcacacctttaccagatgatgctccttgggcaagtgattaagaactttcatctggagaaaacctagagaaaagtctcacagatgattgacatttatttgttttagatgaaaagccaaactgaaattttcttgaatctatgaaaattgaattttagataaaatgtcacactgagtgcccagtatgagcaatgatcaatgatcagttttacacatatatacacacacatatatatattctggcaaattattttaaatttcataataccgagagagggtgtgatttgaacagcttccaagaaaaagagaagacacattcaaagtcttggaaatacaaatggtgatatggtgtgactgtgttgccacccaaacctcaccttgaattgtagttcccgtaatccccacgtgtcctgtgagggatctggtgggaggtaattgaatcatgagggcggtttcccccatgcttttctcctcttagtgagtgagttgtcatgaggtctgatggttttataagcatctggcatttcccctgcttgcactcatttttcatcctgctgccctgtgaagaggtggcttccaccatgattgtaagtttcctgaggcctccccagccatacggaactgtgagttaattaaaccagtttttctttataaattgcccagactcgggtatttcttcacagcagtttgaggacagactactacagatggcatgagacatctcagctgtgactgtcacaattgagaagtttcacatatgccttttaacattattttttgatatacatatacttgattttaatagaattaattttataaaacaatattgttataaaataatgttatctgttttatattacacacataactttttgctttattccttaatttatagtgatcttagtttgaggaattatttgtcttgtcatattgtcgtatttgtctattacttggagtcaataatagatgttgtattaagttaagaccttccgatgttttctacattaaatttatatacttgattgaaacaaataccaaatatgtgtgacatggcgtttaattttaaacattctttgtaacttgaagaaggagaaattctgaataacttgaaggaagctatgaagcaattgtaaaagtagtatcaatcgtgctcagaatgatactctcaacttttttccaggaagtttattccatcgtgacattgcttttctggaaatgtactagatatttataatactaacttttttacaggtcaataggaaaaaagatcccagcaaagcttttgaaaatttaaaaggactcattcaaagtatgaatttactccgtaactataaatgataaatctcacaatgatggattatataaagcatccactattgaaagctggccaaataagaacaaaatgtaatttaaaagtatggatgtgatagaaatgtgaccatgagtaattgccacactcctactccacaacctgtcttggcaagaacacagaccccatgacataataagcttaatttgtttctaatttatgtttccctatgtgatatcatctgttttattattgatataggtaatgttctaagaccaatgaacagaatgatctataacattccatcacagaaaagcaagagaatttgatttgtttgtgttctttctgatttggacttgcatttgcaaggaaataatggttagtgtggatagcttaatgatatctaagagagcataataataacataatattcacctgcaattttgaagcagtcttttgtagggcttttagatttgactaatattttttctttatatgctttgaacaattagctttagagactaaatgtacacagtggagaatcataggtatttttgtgttgctaaaggggaattatgagttatcttgataaacagaacgttttcacatgatctcaagcctcagaaagcatattggaggtcagctgatgccaagttaagatgagctaattttcccaatgttaaatctaagagagaatccatgccttgccttggacaaaaagctgtagtatttctggaagttatgggcagaagctttgaaggcactccatagaaatgatgctctgatactaactcagcataaaaagccctggaactttagagatcagaggagaaatgctgaatttagggggaaggcagaaatagaaaggatgctgaaaggcttaaagagaaacgtttttacttacacagctttgtagagaatacattggagatctgactatactaaagaaacatgagaatagccctactgataaaactgctatttcctgaaggaaaaagaaaagtgggcagggcaataatttgtgctgaatatcctgagatggcagggaaaggtgactgtattttgatctggatctatttttagttgtgaagtttctctgctgaggaattttactccctagattggaatacattggaagttaagcttctccaaagctgattttctttttagccccatgaatttctgtctttcataaaatgttctttaaaggatgtgggaagcattttttttcttttcttttcttttcttttttttttaatctatgtagtcttctcgtgagagaaactgacaactccacccagttcgggatctctggcaataaatgcaagatttcaaggttataggatcttgttcatttaacactcaaatactgaggaagtctgtgttgcttaatcctaaatttattagattcaatatgactcaccactcccttcctttctggggtgaagaggaagaatatagaccatcgggtcaaatgtttccccaggctgaatgaacaattgtattaagggacactaaaagggagatacaaagaattatttttagaacaaaactatttcaaataagagcagagattacctaatccttatccttccccttaaatagcagagcatctggctatcaattaggagattcattttattaggcttgctaaaggaaatatagataaaaagatatttccattttactattagagatacttaatggtctactatgttatatggttgtcctttgtcacaagtatattttcatttttgttgtggatgaacattttctctccactaggctgtgagttccatgaggacaggagtgtgtcaaacttgtaatcaatgtctttccagcatgtgcagatacctggtattcttagatgagtcagtcattgcctgcaaaagtcacattttgggagggtagtgactcactttcttgtgctagcaattggaaattattttaaatatgattactaactacatgtggaaaacatatatttctccctgtgacttctggtaagatatcaagaggtgttaataaagacaaatgaagaaactcttcaaaaaatgcacacatacatacaaacgtgaaaatttcatgttgtttatatgaaattcgatcctcggaaccatttcattgtcccatggtggtttactggtactgggtcaagaacatcttctctgtgtcatccatccatcaaaatttgtaatatgcaatgatttctatatttaagcaagtagataaataaaaaatcgtgtccttgcttcattaattttggaaataatgagattgtagttttttccaaaactgtgttgctagaacaaaagtgggaatttgaacatctgggtgattaagattagaaactgggaacaaggtaataggagaatgcactgctaaaaggaacagtgaaaaagaagaattatggtggattaggtcaaaggtttagggagataaaacaaaggagtcatttaggacctagaggtaagtgctgctgacatcccgaggaagggtggggctgtttaaccaagcacagagctggcctcctctcaatggcacgtgtgaagcaacacactcacccttttacccaaggggaaaaataaaaaaacaaagttcctgtccaaaaagctttaaaactatggacaatctcaaaaatcgcatgcccaagaatttccagtttagaattttttttaaaaagctctgaagtgtattgccaaattattattattcaactttgatgagtttgaacccagcagagccagcatccatttctgatttatgaaatccactgagtgtcttagctttacgtgttaagatacaggctctaaaattaccaattttttttctgttttggttgataatcctgtggaaacaaaaatgactttgcttggtttggcagaaatacaagaaagataagctggttggaaaagagggaacttgttccaatccctgtcccaaagtcttttcataatgtgtgtgtcagcctaagaaattttaatatgtaatgcctaaatctaattatttaatttggctacaatgaattgttgaaggatgtttaatcgttttgctgctagcattgtcacagggcaatgttaaatcatttggaaatgataataccccaggttagtcactgttttttcagctgttttttcttgtaaagttggtttgaaactaaaccccatagaattggttatgatgaaagaaaataaagcaagtggctatatcaactttatatttatttttctcactgtgtaagtaaagacaaaaaaatgacataaacagctcttaaacattttcctcctctcattgccgtaattcagggattcaccatgtttcagaacctctggatagtcttcctgaccccacctttccccattctcatccacttggataatttagccagacttatctttgtaacactcagctatagttgttgccacttttctgaataaaacattttagtagcttcaaatcacctgcataataaccaaaatcttcaacctgccatcataggctgtaatcatctagatgctggctttatgtctagtctcacttatttccacccaacatagtccctatatttcagcagagcacatttcctcagtcatacaaacaattattaagcactgaatttgtctcagactctgagctaggtgctgggaattccaaaataattacaccatggtctttgccctgacacaggtcacactccagagtaggagacatagtagaagtgcagtatgtacgtgcaacctggagtaacatgtgttcctgtacagcctagtgttcattctgcctggaacaaatttttctttatgtgtttcctctcaaaattctatctgtctttcaaggctgtgctcaaatatcacctccttttagaaggtgatgtataattaattatttgaaaggtttaacattttatatatacttctattagaatttatttcacgtatgttgtgttttatatacataactggttccacactgatctgtgagccccttgcagacaaggctcactaatctcacgaccttaaccccatactcaacacttaatacacactaaatgcttataaatatttgtggatttaatagcattttaatattattccattatcataaaaaatgcagagatgttcttatcttactaattctgatttaatggaagataagatacatgctttttaaatatatcttatttggcccaaagtagagtttaataatcatactcaaaacaatatttattgacttttcctatctaccaagcatggttctaagaactttatataaattacctccttgaatcatcatgagaactatatgagttgggaaatattatgatttcctttttatacatttggtatagacttttaaaaatacatcattgttattataatgactgatagatacatagcacttactatgtgccagacactattcataatgctgatcatgcattaactcgtttattcctcacaccaacatggcttatcacatcatttccggttttatcctcactttacagatgaggaaactgagacacagagaggttaagtgactcattctagattgcatagccagtgagttgggaggcaggataatgccctggtggcctgaacctaaaattcatattcttactcattatgagaagtaatatttcattttgtaattaacaatgcaatgcatggttcaaaataattgaatattattcataggcacttgaaacaataaggatttcgattgtataaactacttactctactagttgggtcaaaataaacccctgggaatgcttttacatatttttgattttgctgatttcagtcttagttaaataagggaaattgcatggaagacatagaattgcctgattgaaataaggtttgtgtgaaatgcattatcttgttaaggctttagattatatttgtttaccttttatcttggttccattcttctcagttctactttacaatcagtatggcgtatttgttggatattatccctgcattcggaactgctaaaatatattacaccattgggtctctagtctgaaaaatgattgaagttgtatttagcttaatagaaaaataattagtatcaatttcagacttctatccaatacacaaagcatgatccataaatgttagtaagacatttatgttcagtaaagtcacgctcatttgagatttcaaatatcatgtcttcttcagcatactgccttttgctttgtaaaaaactaagataaaacccagcttagaaactaagagaaataacatttaaccgttataaagtagaaaaaaagaaggaaggaaatgctaaaaaatatgaaataataataaagcccattgttgatagacggaatatatggccattatatttaagggactcaaatatcatttttacagaggttagaactgccatgatactttttagaattaccttagtgcctatatcctagacattatctctttttatctttctcatcaattaataataggctacttttaaataatgaattggttaaaagtcagatagcatataatgggctttaataaaatgatgaatattattaccttattagcattcagtattctaggatttaaaaaataagataatatcgtaagtacttgaggtaaaatctagtgaaaggatttggataacttataggagtctgtgcatatcacaattataaataaaacaaagaattgggacctaaagagaagtgtcaaaaaaaaaaaaagaaaaatcaacactgaagactccaattcaattatcaactttgctgctacgtagttttgtaactttagggcatgtgacttcacctgaaaaggattaaagagcttcatttgtataactatgcatttgcattaatttaatttcaaggtctattctagcattaaatttttgatatcattactggattactggttcagggtcatatctctttcagagtacattttctgggattcagtttctttctttacatctttctgcacatatgaaatagaaaaacttcaattctccaaacacaggcatcaatctaaatactatcaaaattaggatgggcgaaagacaagctgcagactggagataatatttgcaaaagatatatctgatgaaagactataatccaaaatatacaaagaactattgaaattcaatgataagaaaactaacaacctaatttttaaaaatggacaaaaggccttaacagacatctcaccaaggaagatatacagatggcaaataagcgtatgaaaagattctccatatcatatggcatcaacaaaatacaaattgaaacaataagatactgctacacacctattggaatggccaaaatcgaaaacactgataccaccaaatgctaatgaagatagggagcaataaaaattctgattcattgctagtggaaatgcaaagtggtatagacactttggaaggcaatttggcagtttctcacaaatctaaacagaagacccaacagtcatgctccttagtataatatttactcaacaaagttgaaaactatgtgtattagtccattttgacactgctgataaagacatacctgagattaggtaatttataaagaaaatgaagtataatggactcacagttccacatggctgaggcctcgcaatcatggcagagggcaaaagtcctgtcttacatggtggcagacaagagagaatgagagccaagtgaaaggggtttccccttataaaaccatcagctctcatgagacttattcactaccatgagaacagtatggggaaaccacccccatgattcaatgatctcccaccgggtccctcccacaacatttgggaatcatggaagctacagttcaagataagatttgggtggggacacagccaaaccatatcactatgtccacacaaaaacctccacacaggtgtttatggctgctttattcatacttgccaaaacttggaaacaacgaagatgtccttcagtaggtgaaaatttaaataaactgtggtacatccagacaacaaaatattagcactaataaaggatgagctatcaagccatgaaaacatggagcaaacttaaatgcatattactaagtgaaagaagccaatctgcaaaggcaacatatgtatggtttaaactatgtgacatcctataacaagctaaactttggagacagtaaaaaaattagtgattgccacggggaggggtgggggagaaggatgaataggtggagcacagacaatttttaaggcagtggaagtagtctatatgatactacaatggttgatacttgtcatcattcctttgttgaaatatataaaatatacaacaccaaaattaaaccctaaactataaagtttggaagattaatatgtgccagtgtaggtttattgattgtaataattataacactgaggtgggggatgctgatgatgggagaagctatgaatgtgtggggcaagaagtatacaggaaatttctgtatctccctctcagttttgctataagcctaaaaccgctccaaaaaaagtgtattttttaaaaagtagaaaaaaatgctaagagatttatgatacacttgatttgatgtttactttgtatacattaattaattttatagatttgcaaatattaatatatatagatgctttaaatgataatttaagaatgtgaacacagggttgtaaaatatttcgtatttaattttttgtatatttacatgttttttattcattttaatactgtgtgtttttcacacataaatattgtgttaaggtacaaatataatatattacatctatttctaaataattacgttgaaaactgtaattacatatagctatattggcccttttatgctgtatgtattcatttacaaagtgggacaatatgtatatttaggcaagtaaatattttgcctattactaattctttctttctttctctttctttctttcttttttctttctttctttttctttccttttctctctttcctttctttttctttcttctttctctcctttctttctctttctttctttcttttttctttctcctttcttttctttttttgctttccatagacttgctgctttcaaatagctgtattccctttttgggttcatcagaaggactggattttcaaactcttctcttagatgaggaaagaggcaggctgctcttgggagccaaagaccacatctttctactcagtctggttgacttaaacaaaaattttaagaaggtcagtatatttatatatacatttggttaaattcatttattttcatctctcttcttctcccgttttgttttgctttgttttaagggacacagtgtcaaatgcagtgcatcacatacatgtcaaaaagcagcataaagaatatattgcctctgatacacattctggatttttatggatttaagtacatatgcatgttctttatttagagtgaataaatataataaaagctttgaaaatataaatgaaaacataaaaaattagttaatatacactaggccatataatagaaatggaaagtttgagactgaagaaatgacaaattagttatacatcaagaatgaatatttatatcctaacaatagttgtaaaattaaattttattaactttcagttcacaaataagcatactttcaaatgataatgtggctataataacaaacaccatactgctttttccaaactctcatttcacatctgaacaggtttctcctacaagtcaatcactctcagcaagtaaagataaataattccccaactatgggttcattaagacaatctcaccatgacaaagaaacatacactagtactttaaaattcttaaggcaattactactatgtcctacattttcaaccaccagtgtgaaacccggaggaaagggtgccacactttagacattgtctattaactagtactttagcaaatatcaatatctatgcaagcagagatagatgctaagactggcagagatcgagtggctgataagattacataatatcagatctcttctgcatctttgaaacatcttctattgtctttttaacccatctttgtcagaagtattgaaaaaaaagattaggagcagttgcacggtttaaatccaatagttaccaatattgagttcttcttcttcaaagagaattatttataggccatcctaggactttggactttgaagctacatacagtattaatctacaatgaccactttaaccctctaattgtgagatttaatagccaaatatcagttgttcaattattttagaattatttgttctcagggctttagtctacacaaaatatttatcttcatatgtagtaatattacttcacttctgaaatagaacaatgatatttggtttttagtcaattaacttttaagtaattctttcacacatttttaaggcctaccaaaggaaaaggagttatttcttataaaggctcatacttaataaagaaattatttctgcaaatgtatacacatacatttcatgtaatctgtgtttttggatgaaaaaatgagggctaaaatactgctagcaattgtttttgacttctgttaatccaaacacactaaaaacctcatatgattatctttaaaaaaattaaagtatctggtagcctggatattgtttaacataaaataaaataagcagttgattatgtactagaatttgaaagtttgtcctccattctaatctaaaattatagctccattccatttttttcttaaggctgtatttttttcttcaggaatttcttttaaaaatactcatactcctagtacgagccaattgatggcatcaagtaacatcttaattttcagtaaatatcttagcaggggatgacgtgttttatgaaagtggccaaggaaaaaaatcttagctaactttgcaattttgctttaagagatgctgcatagcttaaaaggcattttttccaaatatgtctcagttttaccatactagcaaaaagcaattcatacttttaagggaatttgttcttgttctgttctctgccttcagggattggaagaaaaattccctttatctgaactgagtgtattagatcattgcttaaaataaattcttataacttcctgctgtgactattttaagcaaatctctctttggcgatgttccatgcatgaaatgtgctaatattttaaaaagtaaatgtttatgaagtatcaatttatcttatgatattattaaaataaagttgtttgaatacattatgaaattagatgttatctacataactgatatttctttatatctctataaaatgtataattcataaggggattatgtatgcaaaggtaataatttatgttatataggtatccaccattccaatttatataaatcactctattgctaaagatactccacagtagcacataagtgtcaaaatgcagtactttaggtttagacccacttggttttcattggctcagtgcccctcggcaaagatccaaactcttttgcggaggaaaccacacatgttgggactctgaggggctgaaggctgtcctttgtactctttagggttaaagcaatctacaacatataattgagttatcagtgactggttgggatttttttttcccttggaaagttaaaaaaaaaatctgtagaaaatactcaattgaagttagcaaaatttgcaatatatgtgaacttggaggttttgtacaaacaaggctgtgcctactgaaaaaaaggccattatcattcatatttgccatgggcatttagtgcagaatcaccagaaattatagcaaaatccttcacaaaattcattttgtaataatcatttaataatatctttttactatctttactcttgtttagactagattttgagtctactagagtgaatagcgcaggtatataattagtaaatatttgacaaataaatgattgcagaggaagaaagtcaaaattaattagatttttggggaacatttccactatctagaaaataaaaattaagtagactgagttgttttttatttctttgttttttaaattctctggtattaaaagaagatggatgatattatgaccttttgtcttttttgaaaatttttttgagaggaaggactatttctatagggacttagacttaaaagcaagtataagcacacattgcaaggatgtgacacctcacaacttaactatcccgaagcttaacgattccaaagttggtccgtaaggcctctcttcggctagggaatactcgtggactccttctctgggacggggtctggaaagatgatgcccattgatttgacagtccattcccccaacactagatcaaaatggaacaatcagaaccagaagtgatcacattgtaagagaaggacatggatcaagaactgtatttaccagttatgacacttttgttgtaggttcagtttctccagaagccaactctgagatgaagattagctcataagtgagtgttcttggaatcagcccagtgggaggaaagctaggaagcagtattaggcaaagggagaattgagctgtgacgtagccccagcaaaagcctcagctgacaggccaagctgataatgtggcaaatatttcaatatatttttctagtgtgagtgataataccatttttaacttagtttatccttttctcctatctaatctgttcaccacaacggtaagagttatcgtcacaaaattaaaagtctgaatgtatctcactcacttgtacaactctggcagtttttcttaggaacttgaataaactccaggcttcttagtattgacttctaaggctcttcctagcccattgcaaccctgtttccagtctcactgttaactattcattgttctctcacatgcactctattttctgcttctctctccccaccctctctttctcctttactcaaagcaccctgtttattcttcataaaatagataatttactatcaagttctgtgtcttttctaaaacttcctggatttcactttcttgctcatttcactgctcttcattcttgaaaggctttatcgaattatatttttttcaccttttgctctccaaggcttcacctcaccctcgggaaatttaagtgttcttcacgtttacaggagcattttatatatttatgccaatgtcagatgtcctagctgatagtgttgtcagtattcatttgtgtcagtatgccttcatccacattatacattccttgaataaggggatgatttttatgcacttctgattctcttttagtgcattgcacaatgtctgatacataaaatacactaagtagtgtgtttctttaaattttgaatttgtgattttgttagttttccttttttgagtaagaaaccactatattacttttatcaattagcgtggaatagatagctaacagaataaaagacacctgaatttggcttaaaaataagaaaatttgttatataatatgaatatgttcagagtttgagtgactacaaagatgaaaatatcatctgcttaatgatgttatcgaggacccggttctttctctgtcggccactcttgggattggcattatctttaggttggtagcaagatggctgccacagtcttcatgggtcacatccagacaaagaaatacaaatggaacaatagatcatcacttatatctcttttttaggagcaaaaaaactttgcaaaaccctctctttcatctcgttggccagaaatatattagtttcaactctcaaacttgcaaggaaaggagggtaactataagttgctgatatcagtcacctcaagttgaaggaatatttaggaacgaaacactttgaatactacacttacagagggaacagaaaacaaactttctttaaaaattaattgacttagaagactgattttttctttttcaatttaacaaaggtaacccaagggaaacataaaagttttctcagccaaacaaaaagaggtatatatattgcctatttggaaagacttacaaagattagctagttctacaagaaaattatctggaagaatttatttttctttcagtagatagccttggaaagtatttgtttccagtatttttttcatcttgtgtagtaaaaattgaaaaatctgctaatcctcataaataattattttgcttgtacaagagtttatttgcctctgcaaaagttttctcgattcatgatttaatataaacttcatgaaatctggtctgctgcaaatctctttaattatgttgaaaacatataagttttctccctttagtattttgactgttttaggggtgtgacattgataagaaagagtgtcttataacttggttcaaagacttacataatatgttattctatagtcatagtatttagcattattcactaaatagttaatgtacagaaaacatattttttaaaaaatcaaataactaaatatgacttaagcatcatttaatatatatcttagtgtaattatacataaaataatgccacttttattggtttggttttgtcagtctctgcagccgaaacaacttatatgcattatagaaataaaacttgggatactttataagtgactacactttgaatatttttttcttttgcccttctacttgagccagcatttctttttcatttagttcaacaaaaatccattgagtatctattattagcactaagcatattgtaatagaatataaaactcagatcttgtcattgctctaatcttagttagggagacaaggcataatacagttacaaggaaagttagaaaattttaaatgtccaaaataatgagacagatcacatatggtagaaatacagagagaggaaaacaactacatgttgttcatggttttgaactagtacaagacggatgagtaaaatttggattaatgttaactggttaatctaaaatgtttgcatttaaatttggaacttggggtttgttgtttccttgttgttcagttcgaatggggaaaaatatgtttgagaaatggagcagaaaagagtctattgtctattctgtatgcagatttttcacttgatcttagccaaaaggccagaagtgattgtatgtagatttctcatagtttaaattaagggagctgcattttcctgccccagcccttaacatcctactctatctcctgagtcagagaaagtatataaaagaagaactttaatagtccttcggaaaggtggccaactgtgaatagacatttatatctatttatcattcatttacaagtgatgcattagaagcctgttcagtgtagacattataataatgaatgtgtttgacatttgtacaatatggtttaaggacccacggtttctaaacaaattattcgaaacgacatagtaactgtcagtttgactacaagtgaacattctctacttcagccagccttaagtagtcctagtaataattcatataaaatccagagccctctctatgtaaacttcaagaataatgtatacaagctgaaagtcttcccctccctctttctcactcttttttttttaatggagtcatagttgatggtaaaaaaaaatatgcaatactctctgtttggttatgttacttagttggacttttgagttaatgaattgttgggatccttccatatgaaaatgttacttattttggaagcggttcaaacctgcagggatggaacaagtctctaaaccaggatgcaagcaaagggtcacaaagagaatgacgtatggcttaccaagctgagtactgcttttgtgtctatattattcaagcatttatttgttggctttctttctctctttctccttccttcccttccttccctccctccctccttctcttccttccttccttctttccttccttccttccttccctccttccttccttccttccctccttccttccttctttccctccctccctctctccctctctctttctctctctttctctttctctccttccttccttcctttctctctctctttctttctttccttttctcttttcgtttctttctttctctttcttctttctttttgcatgtaattgtaaagattacttgaaatccataatgctacacctttatgtttgagcatttatattgtgaaaataactaacctaaatgaatttataattttacatataataatttccagtggaatatttaaacacccttctttgtctaacataaaaagagctttgttatttccctttctttaaggaagtctagaacaagagttttgatacatgaggactctacacttgcttgtttgatattaagtataagcaaaaatactattataaatcagaatgatgttctgactccagttctattaacttactctatggctgagtaagacatttctgtctaatgctttagcttctaagaagtctattacatagtgggaaaagaaaagaataaataaccttctcacttaaaatcaaattatttgtaaaacaaaatcatcagtcttttaattcttatttaatacttgaaattaagaaaatagaaatacttggaaagcatgtggacatcctaataaattaacttttgctataagacaccctgcttagtttcatgtgattaatctgtttccattgcctgccgagcatatgctgtctagtaatcacagagctaaaacaatcgactcgttcatggatgtgctggctccctagcccgggtgctgatgtgcaggtcccatctggttactgtaatggactgtcaggatgttgtcagactgctcagacctcgccagaactctcacaagaactccttctctgtgtccaattctatgggaaactctgcagattacttttcaaagaataattattgagcgctcaccatgccagattctgtgccaggtgctaaaggtggtaggaagaaaaagcaatgttccttgacaccagacatcagtgcttactaaacttcagtaagtcatggattagaggtgttgaatagtattcactacaaaagtttgaagtccatccgcaagagtaattggaccacaggttctaaattactgaccatttgtggacttcttagatttatattaatttgtatggtatattagcatttctctctctttcatgcaatacatatttgtaggtgtttttttgtttgtttgttttatgagataggttcgcactcctgtcacccaggctggactgcagtgatgtgatctcggcttactgcagccttaacttcttgggctcaaacaatcctctcacctcagcctcctgagtagttgggactacaggtgcttgtcaccatgcccagctaactttattattattatttttcatagagacagagtgttgccatgttgcccagtctggtctcaaacttctgggttcatgaaatctgcccacctcacttgtaatcccaaagtgctaggattacagggcatgagccatggcacccggccttgcaatacatatttattgaggttctactatattcctgatactcttctagatgctgagaatatagtgaaaaataaaacaggtcagacattcatgctcatagtgtcttcaatttgggaatagagagttaatggagaaaaggaaacaaaatagcacttattgcgaagtattatgttaaaaaatgtgtggtgttcctgggaaactacttcagattggttattagaaaagacctttctggggagatgataataaaattgacaggtatttataagaagggatcatctagaagaggtcagatgtattttaggtagaacaagctctacctagaagataataatgaagtattattttaaagagcagcattagctggcatacacaaaaaagctcaagaaatgtttactgcaagtttctttcaaatgagtattaacttggtggagatgatttgtgttttaaggctgggctgctgagattcacacctacctaaggtcacaaaccaagcggcgatgcagtagggactcacattcacgtgttctgattgcactgcatttaattgatctttacacctggaaaaaggtctcaaactaaacttacttttgaaaaagaaagtgcaaatggatgtgataagcaaaagtgtagtagaagacagagatgattcgtggaagaaagctaaaatgcaagcgaggcttctgagctgagtcgggaaaagggaaagggaaagacaattgtcacccaaggcttcatgcagaaaaatcatggaaaagaccactttagactttgcctggaactccatcttctgtattgaagcacattttcttggaaaatttgtaggcctgcccttatataaaaatctaaaacaaaacaaaacaaaacaaaaatggagaattaaacttcccttctgtaacaatttctatctaggccaggccaatacccactgcgcaagctttacctttggcgctgttgctcttgttttgcaacaggaaaacacctccctgtcctgggaacccagagtaaccattgctcttttagttgttcaaatccttgtatcatatagcattcagagtgacatttttttctttaaagccatttaaaaacttgtatcctgttttttgaaagagatggccactatctcaagggttctgaatttttgtctttaattaggtttttatgaataagtttcaacttccttttgtgtgtctcattcagttgttttgacatctctgaattaggctgaggggcatttgactgaccttgcacttgctaacttgagtcaattaaattgcttctccaaagatgaaacaaagagcagatataattagaatttcctttggatgttgttataaagtcttatcattatttgaatgtttctgtaacttgcctaacactgaataattaaaaattaattgtctgacattttcaccttactaaaagataagtgaaacaacaattgttagggatactgcaatattttatgagtcccttctaagtattttttcaaaatgaagtaaaaataatattaaaaggacaaaaagttgttttggattttggacagagaaaagtaaataaaatcaatataaattcagacagtttacactatatttacataaaaaagtattattaaatctttttaagaatatgtttaaactataactttatgcacaaagcctatttaaggaggcactgaagacaatttttatttcaataatatggtctcttttcatactagtaagctatacaactctaaaagaaaatatacagatatatgtttagataataatatttgagccttccaaggttagcatgaaaaaattaatcctttggaaataatcaattgtgaaatactataaaggcaacataaatatactaatatgggtcagtaaattatagaatatgaggactggcttatgagacatacttgtttaacagtgttgacccataaactcttatttccaagtgaagacattttataaatttatttacttctgtttgccagttttctgttatcaactagatctgtaagaattagcactcaaattaaaaccaatttgcaagtattgtttaataattgttcaattactagctataccctgaataagtaagttgagaggaattcttaggttcttctggatccacagaaaagatctccgtttgatttctgatgtctcctgcacgtgggtagacagcaacagtaagctctctgcatatttgcagtccttgatatcaaggctctaaggtcccaaagaccacaacccaccaaaattatatccttaaaatctgtatctggtgcatcagcacaaggttagttaagaattagtgttttgtgggaatatttcagagcaattaaaatctggccattaggcaatggcatctctgtttctggtatgactctctttgataagtgaaggaaaaatatctgtggatgactttctaaaggacaaatacggttgcatcagcttttagaaacagggccatgtgctttgttgtgtgctgtttcatgcaacttttaatatgtcaggatactgtgtgcaagacacactacagtgtaagaagatttatgtggcattttattgctgataaattcaaaaggcagtaagaatattaataatcactgtctcaaaattgttcatattaactattgatcctgagggctgacttttaatagataatgtggacattatatttttaactatatggtgtgacttttgtctaatagtgacgcaatctcaaagtgtactgactaggccactaaaataatccaaggaacacaggtacctcttgggctcttgtacaacaatgctggaacttcagcctgtatgtgaaacatatcttattctatacccaatgaccctatagttgacatctctatttttccctttatataactgcgtgtgtctctgtctttctctctcttactattttccccctccacatgcatctatacacacacacacacacacacacacacacacacggagagagagagagagaaagagactagaaaaatatgaaaatagtggaatgctgttatatatgtgcgtatattgtacattatatatcgcattatataaagattatatataatgtgatatatatatacatataacacttcaaaagattattgaaaattttgccaattctatgtaagaataagagcggatctttaaaaatgattttgtcttgtttttcgtgtttttagattgaattaagggaaattctgtctctttaaattctttatcaattaggaataaaaatgaatatttaaaaaaaatctctttaatgactaggtagtatgtaagaaaaaaaatccaccacaaatcataattaaactgacatcttttcaatattgacacagctataatgactatttttcccttctaagtaaatgtttagagtctaaaagacaatcagatatatcataggttgtttttgcttaaggtaattctgttagtgatgactaaaccttggcagcattgtgtcaaaataagccaatgtataatttcaataaatccttatttttgaaggttttaattttactttaagaagtaaaattttctttgtgatcctagctcataatccctgtgcttgtatataacatttacttgctaatcaaaaagtcagttctctgaagcttgtaattagttgtatggcttcatcaactaggatggtgcaactcaaattacaattatgtgacttataagcaataactgaaaatgtacaacaaaaacattaaagcatcttttacagatttgtattcctttacaaagagaatatatgtgcaattgctattttagtgtcaagtccctgagacaaaattagagttgaaaccatctagctaaaccaaactattatattagagttgaaactattaagagcaagtactttaaaacagaggatcaaaagtagagactgccagtaagcgctccacagtgctccctgggcacggtgatttcatcccgtgtactctcttgtcactctgtatctcccatcctaactcagacccaagcacctcaatttgatgccttggctgacatacagaaggcctttcataattatatgtctaatgaacaaatagttaatgaagagtaactacttggtgctaactttgaaacttttatttaggtttcaaaaacgatataaagagtgcttccacattttgtcattctttaaataagcccctcctcttagaagcactagtgaatatattcacatttaattttggaggcatcatttatctcataatttaatttaactcaatcacccaatactatgatttgaagtaaaaaataaaaccctgtgatggcctttatcctttttaagactcatttacttaatatgaaagagttatatatttttttgtttcctacattattatttgtatgatatgtaattttgaaaaaatctatagatatttgccctacatgtattccttaaatgtgattaaacctgattatcatctaaaacaaacaaaaaaagaacaggatcttacatgctgaaatgattcaaagaaatattaatctggcaacatagcaaagacatggaatcaacctaaacgcccatcagtggtagactggataaagaaaatgtggtacatgtacactatggaatactacccagccataaaaaaaagaaacagaccatgtcctttgcagaaacatgaatggagttggaggccattacccttagcaaactaacacaggaacagaaagccaaatacttacaaaatggacttctatgtgtccatgtgttctcatcacttataagtaggagctaactgatgagaatacatggatatatagagaggggaacaacacacggtgggacattttggagtgtggagggtggaaggtgggagagaatcagaaaaaataactaacgtgtactaggcttaatacctgggtgaagaaacaatctttacaagaaagcctcatgacacaagtttacctgtgtaacaaacctgcacttgtacctctgaacttaaaagtaaaagttaaaaagaaaggaaaaaaaaagaaaatattattgaaaaaaaaaacctttcctaggcacaaggtctgcatcaataaatatattttgagtgcattaaaaatattaaatcaattgacaggttatggaaaagtattctgtgtactattttcagtccaatgatataaagttgtcctttgtaaaatcactgtattattgaagaaccagcaagtacagcatttcacttttgcaagatgaaaaagttctagagattggctgcacaacaatgtaaatatacttaacattactgaattctacactgaaaattgttaaaatggtaaattttatgttatgcgtttttaaccaaaattaaaaataataataaaattggaccagtggaggggggaaaaagtgagaggataccttgagagttcataagctcatatctaaagcaaagactctgaattcaagatgcaattttttttttttcttttgagatggagtctcgctctgtcgcccaggctggggtgcagtggcgcgatctcctctcactgcaagctccacctcccgggttcacgccattctcctgcctcagcctcccaagtagctgggaccacaggcacctgccaccacgccaggctaattttttgtatttttaatagagacagagtttcactgtgttggccaggatcgtctcgatctcctgacctcgtgatctgcctgcctcagcctcccaaagtgctgggattagaggcgtgagccaccacccccggccgatgcaattttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgccaccacgcccggctaatttttttttgtatttttagtagagacggggtttcaccgtgttagccaggatggtctcgatctcctgacctcgtgatccgcccgcctcggcctcccaaaatgctgggattacaggcgtgagccaccgcgcccggccgatgcaatttttaagaagcactcagtccagtatttttgccagcaatgatgaataacaaaggaacaaccagaacaaaaataacaaacaaacaacatttgaagaaacgttccaattttgggccagctgcagtgttccatctggattattgagttatggcttcacgattctgggtttatgactaaccattgtccattggtccatgcattgcccactttagttaatctatttactaacttacattattctctttttcttaattatgttgttaaacacgtgaaaaatgcaccctcaagcacaaatgctagaatctggtaaataacctgtttcttacctccaagtcatccttcccctcgtttcccattttggctggccatttttctaaatccacccacctatacacctgaaatgtaaccattttattttagttgcttttaactttattctaaagcaagatgtgcggtttgcaatttgaggagatattctttttagacctaataatgagttgctaatttccattcatattgcttttcattgctgcagctcactgatatttgactgctggctactatttaaagttgtgtgatagtagaactacagtgattcaaaccatttctgaataaatagcattttctagtcggcattgtgtaccttatcaaggttagctgatcacttgagcctctgctgcctccaccacctgcctatatacatatctggattgtaatttgtgaatgttaagatcttctctaagtaaacaatcttgctccggtttaaaatctcaataatttcattgtatttgtctattttgaatgctatactgtgttctttatttagagacataaaaccctaaaatttcaccacaaagataatatcatataaacattgatgacttctaaatcctttgttaattccaggtttaacaagtctctttcagtgtattccctcaggatattttctttttttgtcacctattaaaatattttctgctaccattggtgagaaacataataaaagtctatcgggaactcctggagcatatattataagtattttagagcttgcttttcttgttccttcttgcttatagcttaacagagagcatttctttctgtaagctaatggagttacataactgcttaaaatttattttgcaaaaactttcttacagaattcctacaaaaacttcctgacagaatttaaaagaaagaaaaaagccttgaactcaagatcgtgaagcataattgaaagctatcaaccaatgagtttggagcccttgacttatgtaatggttgagacccccccagttcaagagtcagatggactttgagtcagactgtggctctgccataagttttgtggtcctcaacacgttatttaaaggctatgtgactaagttttctgatctcaaaatgggaagaataagtacagccatctcagagggtcattgtgaaatttaagtaagagaatgcttataaaacatttagctaagtggcagatgcatctgagctccaagcatgttaaatattgtcaacaaattcacactggtccttggcttggagaaagaagttatgctctgacagagagttgtttctaacacttcatggcacatgtttataatgtactactactctgagtaaacacagaaaaacatggtacatacagcctcttatttaggcaaatgctcatgtgaaattctgttgacatcatgataaagcttatggacctctgaacataatgtatctactgttacagacattaaaatagagaccagaagattcacaaaaatggatagtactagacacttttcttttagaaactttcagggtggctttgggaaatatttaaatctcaaatttcccacattgactctaacaacatgcttaatactcattcttcaatttcacacattcactctctgagcagaattgcagagtgttagggtgtttcagatattcaggttgtaacatactttgaaatgttttgcagatttattggcctgctgcaaaggaacgggtggaattatgtaaattagctgggaaagatgccaatgtaagtatgaaactgtaacaattatctttgtaaaacttctactgatatgatagcaaatatttatattgggctttactgaattaatggtattagtgtattatttttcagactaaactaacatattctatgtgaatattaatgtggaataaaatatctctatcttaccaaaagccatgatattatttataaaatttaagaaatgtagaaacactctactttctaatgtattaattctgaatattatttttgtcacaaaaaagattagaaacacattaaagtattcaaaaataaaccatccaaaagattgtagttctaggaacatgtatttttcatttatgcatacatgtttttgtaagtgtacacaaaaccttcagttattttagcatcacaaacagaattgatacataatttcaactgagttcaaattaaacttaaaatatctataagaattcctttatgtggtgacataatggaaagaacaataagaattagttaataatgaatgacagcattctggcgtaagaactagtaactacttcctctgaaatttatgtattagtaataatgattatataaaataactcataaaagacaaatagagggtactaatgaaacttttagtttaagctgccttgaagagcagagaaaacacttaggtatgactttttgtctctggtatggtcctatctgtcttgatttctgcactgtccaagttgtcctgcatgctccctctaatcatgtaacctgatttatctccagcaatgagggctatggctctgactggctcctctcctcatccgagtgctctgattcaggacagatattctgtcttctgtcctgacttcttgcattatggtaatggggagaattgctcctttttttggcaaaataaatcacattcaaattgtaacccaagatgaaaacaggttgtaacctggggcagaaacatagacatcttgaggcttcttttgcaccatcctttaatcgtacctctaaccacaataatgcgggggtattaagctcagttatgccatcatatttaataataacaaatagtctttgttatatgaaaggatgaatagattaaagaatcctctatcaatgtgatagaaataaaatatgacatataatgcctaaggttgtgaggggacgctcagaaggctaataatctcagacaacaggttagttcactcatttgttattcatttattcaaaaaatatttttagagatcctaaatatgtatatgaaactcatcatatctgtccttatggagctttcaatctaatgggggatacagatactgctcaaatgatgacttctacatagtaaatacaaagcaaaatagttgaaatgaaacaaaacaaacttgtagtgacccctgattttatattcagttattaacataattaaatgtcatcctttcaggcatatttatattagcggaaatatatcagggagtgttaacataaaatgcagtgggaaacagtttttacatttcggtcactagaaatgaaaggaattaaactattctgtaatgtattcttctcctcccacggctttggtatcttcatccagttcaatagtccaacaccaaacaggtaccaaggtctgcaaaagcaccgatactttactgaacactcacagagaatgaaatgctttggttatgagagtttttcaaattatgtcatttaatggacagtataagcatggcataaccagcatgaacatttttgtatttgtgtttcaccagtattgagtatacgataaggaggcaagaaggaaaaggatgttttcaatttactccagtaaaatggttttcccatggagcagatcagggataaacagtcaaggtcaaacaatcagtgaaggtttaaattctgacagtgctctcacttgggtatgttcactaattccagttacatagtaacttaattgcccctcttattaagttaaagcaaatggtgataaacttttctggaggtgatatccttgaccatgtaggattctgtatatagaacatattattccaattcagtcataattgtgagctagtaaccacctctaacctttaaacacatttgctgctaacccaggattaaatatatgaggagctttttgctttttgctgaagtctgtagtttgatgttgaatcatgtagtgataatttttaatttttgcctcattttaacttgttcgtttaaaataatgtttcattttagagcttctaataatagctaacatttttgtagcagttaccatgttcaaggaactgttttcaatgatttacatgtataacctcatttaatccttatgacaacactatatgctagattttattattattttctattttctggatgagaaaactaaagcaaaaaatcttaaatggcttgcccaatatcatgcatctggtaaatagtaaagccggggattgaatccaaaaagcttgctccaaggtctgtgctcttacataacattataaaatatccatataagatccaaaaactatatccttcaagttatttctttctataatatcaccagaacatagatcctcatttttaacagcattacatagattttggcggacagaaaactgagacagctctgtggttttattgacatcttttattacgtttggcattaccctttctccttcttcctctctagtaatttttacctacttcccaagagtgtgtttaggattaacaactgtttggaaagactgtccctttacacaaaggtactatgtaactgcaaaacagtgaattatttaccctaatgaaagttagctaattggggtggggatagtagaagatgaggaaacaaaagggaactattccactttgttgaacatagtccccagtttaatccaaagaagggtagagatgacagaaagatatttggtagtattttgcttctatttagaggaaagttattcaaaagaaagtaactaaagaaatgtctttagttctgactatataattgtgggttaaacagcttactccaagcaaaagaaaccacagggtgagggtagcctgggctctgtttgtcagctcaaccacagaggggcacagcctgtccacacagacattacacaaagttaaagcgtcctccggaacttcagtttttttattatatccttccttccttccttccgttcccttccttctttccttccttccctccttccttctttccttccttcctctcactttctttttttcttcctttttttctctcaagaaagtctaaaactaaaatagaatgttcattgtagaaagtttgcaaattatatacaagcaaaaaaagaaaaacaagtcatttataaatacctctcccccatgaacactaaccagagataactggtgacattttgatgtttatttttctatcttatctatttactaattttcagtatgaaatcattgtatacatagtcacttaaaacacttatttttttttacttcacagactgccatgagcattttcccatgtcattaaattctttaacactacttttaatagttacactgcatttctttatgtattatttaatcaatcccctattgttagaagtttggtacatatccagttttactattgaaaatgacactgtacatgaaaaaattttatgtaaatattgtgaatatctttgattattgagtagacttttactagttaaggacataaaaatttttataaacatattgccaaattgccctccagaaagtttatgcctcatatgctcttaccagcagtatgtgatcaagggagggtgtatttacctattataccattgttaatattgaatacaacatacatttaatgcttaatacaaatgcatatgaatgaataaaatatgtatatttattctttgccaataaaaagaaaattatttttgctgttttagcttgaaattttttcattactctcaacactaaacatcttatatgattgcaaaatataatttttaaatagcatatccctgcggcccatatttttttaattttcctgtttgcctttttcgtgctgattatttacagacttataaaacatatataatatatatacacacacacgtataggtagacatatttgtataacataaatatgtatagagtatacatacagtataataccttgtgttccactcgtgaaaaacatattctttatcactttatcagttaccttatttgatgtatacactttatttaaatagtcatttctatctttttctttaaaatgttttcttttgcacttttaccgtaactgattattgctctgtagaaatcttcactgttagatctctcatttttaagatataaatgtgatatatgagtttttctatttttattttgaagtattaacaatctattaaaatattttaaagttttttttttttttttttagacggagtctcactctgttgcccaggctggagtgcagtggcgcaatctcggctcactgcaacctctgctgcccgggttcaagcgattctcctgcctcagcctcctgagtagctgggattacaggcaactgccacagcgccaggctatttctttttctttgtatttttgtatttttagtagagaaaattcactatcttggccaggttggtcttgaaatcctgacctcatgatccacccacctcggcctcccaaagtgttgggattacaggcgtgagccaccgcgcacagccctattttaaagattttaagacctaaactgatctctgcatcctggatcctgtccgagaacttctagacaagcctaacatgtagctcagagacagagataggtgaaaagtcaaaaaatgtttgatgatcacaatattctgcaacacacattaaaaataaaaccagttaagattccaaaatcattagtatcttctaatatttaacataaataaattaaaattagctactgtaagtcagttatcagaatagatataaagctgttttggattttattggaccctacatatgtcttgagaattacaagtacttctattttgctattatctttccaggtatctggggagaaactaaaattctaagtgttaatgcatagactaatatatttttgctttttttctctgcaagtatgaattcagttttatacttgtctatttagttatttatatatgtatgaatatatatgagagatgaaatattgaaacatctaatattacttaagataattaaaaagttgatatttgctttggttctttctctcttcttctccccctcttccctttttctttctcttccagtgggggtagggtagggcctacggaaagccatgtaggtaggaggaataaaggaaggaaggagaaattcaatacttgtcctaagttgaatacattactccctggattgtttggtcacatgcaatgatcaacattgtgggcaatagctgacaaattagctttcagggaaagttacaaaggctgcttctcaaagttatctttcttcgtgcctcacagaattacactaccactgatagccttgcaggtcactaagtgaattaaatcaagttaattattgatcatgctatttaaacaaatctttgaaactttgtgtgtaagaataaaacaacataggatttctgagacttaaaaaatgaagttatgagttgaaagggaagtcattgtaaagtttttttgcaacaagtattgtttggcttaaatgtcaacctcaggtaaaatttaaagtgggagaccttatcttttacgatctctgttcacagatttcttttgcccaggcagccaaggcctttctattgcctctaggctgcttagagaactatcctctctcaaattccctacagaaaaatttgactgagcacaactgacatttttgtaaactgtgtcagataattcaagattcacacatactttttttttattccatgtcagcccaatcagacagaagggaggaatttcataaattaatctgaggtatgccttgtcaagtcaggaaattggcatattaggctactttctaggactagcaccattttaataaaatactcctagaaaagtgaaaggaaataaaataggtgtgattcagaggttttttttttttttaataatcaccaaaattatatccccattgtgtataaaatgttgccctggaccatatttgtctttataaacagtgctgcatcactggtagcttctaatctgtttgactccataatttaaaatctggaaagggagttatatttctttatccaaatatttatttcagaatcttgcaaaattactttctaaattctaactgagcttttgaaaaaatggtgaactaattggtggtgagtcagtcctccctcactccagccatatgattttactcttccctgccctgcatactctcccctatgtacgaatgtctttgtgcaggaaaaaccaaggaataaaaatcttttcaaaaagtgagcatgagtgcgcaaaggctggattataaaacctcctactctagccatgaggtcatcaataaaatttacctggtgatcatgtacattttcatacttttatcttatcttttctcatattactttgtcttaattgtttgttcgaaactattagtatcggcctgccatggtggctcatgcctgtaatcctagcactttggaaggccacggagagaggattgcttgaggccaggagttcaagaccagactaggtaacaaagcgagaccctgtctctacaaaaaaaacacgaaaattacccgggagttgatgacttgcacctgtagttccagctactcaagaggctgaggctaaagaattgcttgggcctgggaagcggaggctgcagtgagccaagatcgcaccactactccagcagcctgtctcaaagaaaaaaaaaaaatatatatatatatatgccagttgaaacattgtacctcagatcttcagatctgtagacatagctattcactttaaaatcaaagcaaccactaggatattagtattttgtatagctcaaaatcagggtaaggaataaacaaatattaaatttatattatttcacttaatctacataacagccataacaatcctatcattaagtcattgtctgcctttttaaaaaattttatttcattctaagaaccaccctaccagttaggttattgtctattgttgggttttttatttatttgtttgttttttaatatattcctcctaggaaccccaacagcaacagtggaccattaggtccatgcctgactggtgagtaacctatggccacttgggcagaaagaaactggactttttctatgcaatccagtggtttctcaggttaccaacttccttaataacccaacacttgcctgtctcctgggtaaagccaacctagaataaaagtctgctccagcccagtgtttacttaggtgtcattggatccaagaatcatgaagccacggttaagaaattgcatgtaacatttatgtaaagatagagtatcacttgcaggagataggttgaaaataatatacaataacaagaataaatactctaaaaagagagagagccactatttactgctatctgaagcatatgaaataattaagttctaaagataatgatgacataaagaaatatttttaggcataagcatatgcagaacagaaagaaacaaaaatttcttcaaaaatttgacttggtgtaaaaaaagtccatgagaaaaaacagagattatggaaattatcaagaaataatctgattcttagaggctctgtaacactggaaaataaatggcaataagtggtagggcatctggtcaataagaattgaatacataggtagagatgcacgtttgtgttcagtgttttgttcagtgtagctgagacagatgacattgcaaacagtagtaactatatggtataaattatgtggtaacaacagatcatgataaattctgtgttctatgtatttcttgtagaaagtaaggataccaggtgtgtgtggtggtgggtgcttgtagtcctagctactcaggaggctgagtaaggaggatctcttgagtccaggagtttgaggccagtctggacaacatagagaggtgtcatctctaaaaaaaaaaagagaaaattttaaatatggacgtctaattcatattctgtttatatccgttctctagggctcactgagtaccactatagacttgcattctaattaacctaattctgattagttcaatggttttataacttcaaaaatctaaaaagctactcctttataccatggtttctatatttgtcttgcctcgtttgctacaacagatgtctagaatttctcataaatcttttttcatttgtgctcttatttttgaagattgatctacttggaaaacaggtggcataaatgataatatttcaaaaacctgaattgtgtgttaatgcttttaatttttgtgcccaacagacagaatgtgcaaatttcatcagagtacttcagccctataacaaaactcacatatatgtgtgtggaactggagcatttcatccaatatgtgggtatattgatcttggagtctacaaggaggtaatataatgaaaaagcatgaaaagcataatttattgtaatacattactacttaattcctatgacataaaacaggcagatttgaatataaggactgaaacatatatggccaggcatggaggtgcctgcctgtaatgccaatactcaggaggatgaagtcagagggtcccttgagccaaggaattcaaatctatcctaagcagcatagtaagatcctgttttaaaacaaaacaaaacaaaaaatgaatagtttatgaacgatatagtaactcatgttcctagccattctatggactatcattttcaccatatacttgatctaccaaataaaaatgtttaaaaatgttttttctattaaaagttgtttttagcaggatgatcaaaattaatagtgtaaaatgttaaaagtgtttgttttctatgggctccatgtatgtctttatattctcttgactttcctttttaactagatatacatagtatgttgctattggtaaaaattcattttccataagatcttgcagtggaattgcattatataaataatttcattttcctatctaataaagttgacctgttatgtataatagtggacactaagtaaagaatattttaataattttcttaaaagtgtatagtcattggcacaatgactttattgtttcagctggaccaaattggcataatggaaataaaggatgtattaattaggagtcatgtattccagatctcaatgagtgctttaataagtgaaaaacatgcatatttttgcaattaaattatttaccagtactttagtttactgtccttgtgttatggacttcatgccatccacttcacatggattattgctttggaatttcacaacactcttaataaagccagtgtcattataattaccaatttacaggttagtaaaaattaagtctcaatggaataaattacatgctacatcacccaactaataaatggtcttgcaacaaattgaatcaaggcagtctatctctagagcaagcatgagcaactgagctttaggacaagtgcccccagttgtttcttggtgatgtgcaatgtcatcctcatgtttatgtaagtacagtcatgtgcatcataacaaggtttccatcaacaataggctgcatacaatatggtagctccatgagattacattaccctatttctactgtatcttttctatgtttgcatatatttagatacacaaatgcttaccattgtcttatagttgcctgtagtattcaacggtaacaagctgtacatgtttgtaatctaggagcaataggctatgccatataccctaggtgtgcagtaggttataccatctaggtttgtgtaagtgcactctgtgatgttcacacaatgatgacattgcataatgatgtacttctcagaacataccctgtctttaagtgatgcatgactgtactttttgtgagtaaccacacatatttgcaggataattcgctgtgtttttgaaagtaaagtctgggcttatggaaaaggtttctttacattgacttagctgattcacacagagatcaaacccacaactatggatggatggattttcctttctaaccaacttgtctaaccagcccagactcaactgtttcaaaataaagcaaccctgacagttaaatttctgagccactaggagacttggtaacttgaatccatcattctttgttggtggtgtaatgttctcttgtctaactctgatgaagggtaatatataacattagctcatagcatagggtgtaattatctgatatagccccacagtttgagtgtgttttgaggcctaaggataaaggccaaactcgcaacctgctgaggggggcaaatagtgttttatagctccttaaaagtcacaagtgctggccggacgcagtggctcacactttgggaggctgaggtgggcagatcaccagagctcagcagttccaaaccagccttgccaacatggtgaaaccccgtcttttctaataatacaaatgtagccgagcgtggtggcatgcgcctgtaatcccagctactctgaaggctgaggcaagaaaattgtttgaactcgggaggcggaggttgcagtgagccaagcttgtgccactgcactccagcctgggcgacagagcaagactgtctccaaacaacaacaaaaaaaagtcacaagtgctgaaagggaatttagatttagatggagctaattagcaacttgggactgtcaagaagccctggggcagtcaaatttacaagttccatgaataagagaattatgggtaaacaggggcattgaaccttgagtttttagctggtctggcgtacaggtaattgtatggcagccctgcttgaaaattgttaacttttttaatgaatcattagtcccaagaaatcattgtacttctagagggagtttagaaggaccttccattttcaaataaataaggctcctcctaaggtggctgggaagagggaatagcaatacacaaaaggagcggaaaaaggtatacttcagggactgctatgcagtgtggctggggcaatgggaagaaacagggaaagctaagatgaatcccagattcctgactttgccagtgagttgaagagtggtgttatttattgaggtgagagtagtagcaagtttgagggaaatatggtgagttagttttgcacattctgcatttgtggcatgttcagtaggtcatgccaagtgggcaactggagctggaatttaggaaggaagtcagtgctgctgtcaacaacttctaatagtaagttgaggacagatggccatagtttgaaatatggttccagtcatttactaactccatggctgtatgcatactgtataaactttctatgcttctgcttattcagtaaaataatgataatagtaactatttcacagagttattttgagaataaaatgagaaaatgattgtatactatttggcatagcacttgcttcattctagtcacttaacattcatccatttctagataacagaaacacagaaaggtaaagaggcatggatgtacacaatatgtatattttacatatttctataaaataatatttgtatcccacagtgctgggaaaacttgaaagctgtttaatgcttggcttggtatcatttcctctgggacctcccctgtgctgctgcagatcgtatctttaaataggcgtgatattaacaataatgttgctgagttgtgataaataaatgttttcttactagcattcctacctacttgtatcatctttacttctctgcccatatttccatctgtgtagctcagacaggtgctttttgcataattaatcaagaataaggaacttcatagaagcaatcttataaagttgaagtctcaaaatacagagcaccattaattcagtcagtttatttcaggaagcacatggaatcatccattattttttatattattttcttgtatgagtccttgactggctcaaggaaacttgctttcttgttatctcctatttccagtagattataaaggtaccattattatttgtattaaagtgtgtttacttaaaattatgaaccataaatttttaaccaggctatttaaattgctattagtgtttagtatttttttaaatgaggcaatagttactattggtcttgttcaaaagaaaaacaaagatctgaagtgcaacataacacataattttctctgtcccttttgctttattgcttgtgttctacataagttgcactgaatggtccttttttattacatgtgtgttctgatataacttcatagatacatcacctagacagaatgtctgaagtgcaggatttctctaactagtgcatacacagagtgagtcatcatcctttctgctggatggtagtgttgtcattgttatgaaacactcaatctcatggggccatattcattatacattcatattttttcttggaaagttcaacttaagatgttatttattttcccaaatactaaaagtctgccaatgtcattctgtctgtggtcactattataaaaatagatgtttcagccaaaataactatgtggtttaatgtgtacagtgttttcgtcatagtgaaatactacaacaggatttttttgttacccagatgtatcaacaacttgaaaatgaactgcccgccttagaacacttttatgttactataattttaaaaactattacagggtttaagtcatttgacatagttgaagatgcttagttatataaattgtaatcattatcctgaaagtatgattattatagcaaatctatttcttaaaagatgaagttggttttattaggctcaataagttagtcatgaaagctcaagaaatatgtgttcttagtggtgatttcgatattgataattgtggagactaaatgtattgatgagtacattactacttccatttgaaaaattcactcagtattatattgccactttgggccaagggagaccaaaacatggttattaagtcttgccagatatatttgctaaaaagttaaggagttcagcattatgcacatgctatatgctcaattagttttatcaaattcatgagttggaatttagtttgtatctcccacattcttactgtttgtaatatttttaaaaagttcactagtgttaatatttctcataacaggatattatattcaaactagacacacataatttggagtctggcagactgaaatgtcctttcgatcctcagcagccttttgcttcagtaatgacaggtaagatcaatgacaggcagttcttatccttaaatggttttctaagagttattttttgactgaaccgcattttcctattgagttaaaggtaattttttactaatcttccacaagcgatttgtttccattattttagtgccaaatttgtctgtactgagcatccttctcactaaaggaaggccacagcaatccatggtgtctgcacagttactttttaaattaacttctgattgaatatttataatgtcaaagaacagataattacttgttttataattttatatttagatgtctggggattttcttatgttgtaatatctccctatctgacttattatagaaattaaatttggcaattccatatgtgggtaaattaaaccaaattaatcaagctatagaatacagataatagaatgttataacatcttcctttgcaatttcactataacctgattatatcagtggaaacatgaaatttatgctagcatagctagtcttctctcactttgtatacatcttaaattctcttatgagacaactatcttgttcaaagaagcaatactgtgtggtctgaagtctgttccaaggaatgtcagcaagacttctgaatttcaaccattataaggactccttttgtcttggtttggtcatgacttcagtctctttctatttaacttgtctgtcaaatgtttgaatagacgataagagtgaagcaccatgacattttaattttcacttagtgagaactagtgattttgctttgaagtgacagcatgtgtgtatttgtgttttttgaaaattatgtgactaatgatcagtcattattctcagaaaatgagatagatggtttgtgattctgctctgtgaaatggagttggcatacccttaataaaaaaacaaaacaaaacaatagattggcggcagttgttactctcctgatgaatctccaagtaattttagggacaaggaagaagttcgaaagcctggatattcagatctaatttttgtgttgaaatatattttttcctaacaaaacattcaaatacttgcaattttataggtttcaaagtgacagttcacttcttttaccaaactttttaataatgtctttgttgttattattttattctttttaaaaaatatgcccacaatgaaatattgccatttatctgatacattgtagggaaatactctaagaggatggaagcagtaccttatctatgtctactttacatagctggagttctctctctctctctctctctctctctctctctgtgtgtgtgtgtgtgtgtgtgagcgcacatttcctttagaagttagctattctcattcttaaggttgaattatccctgatcgttcattgaaagcttatttagatggatataaacagggactacagaaagtatcttaatcccttcttatacaaggcagaattttaaagatatgtttctgagcaaaaataaatttcagtgataaaacaatgtatttgttctcatatttaggcatttataaagtctaaatgctctgtagggatttgccattttttacattgttctattaaatgtaaagcaaagtggttgactaagaagtttcttgaaatagtagaggtttagctctcaaagagacaacatattctcctgcaggaacagccttcttcctgcccctccgccccaccccttcccaacaccctgactaacattagggaacatggatccctgctgccttcttctccttcccttatgtttttctcactccccttctttccatcctcttcctctctctaatctgccttttctcttttctctttgtcctccccttctcctgcctcctcttttccccctcttcctcttacttcccttcttcctccttctcaccatcccttctctcctcctccctttccttctcctgtcttctttgttcttctctcctttctctctctttttctccttgacattccccttctctcttttgctcctttctgtctctggtgaaacagaacatgtactttacacaaatagcagaacaaagaagtttggtatgcagtaatggcaacatctttcccctttcaagaattcctgtttatcagaactattagagacatgattagctacaaggaatgcaacatgttataattacaaagaatgacttcagtgctgaaagctccctttcaccagaggttaggcaaagaaaatttgtggtcattgaggttgtgtcagttaagtaaatactaatcacacaatccattcctcattatggcatttagcttttcatattttttgtgtcttattctaaagaggaactcttaattatgacatttatttgaattatttgtggggagaagagaaagaggaaacacttattatttattcaaaagggaagctaatgcatgtgcaattattaattcagagaatttggcctgtttatattcaagtattcagcatcagcttaccaaagtaaattgagttatcttttcttcaactgagataaattttcaaaatctgtgaaatttatgaaacaatacattctgatattaagaaacaaacatctttggtgtcatgctgtgaaatttgtacatgttaaatagcatctactgctgtactcttaaaagttctgtgtacttttttctccctctcagatgagtacctctactctggaacagcttctgatttccttggcaaagatactgcattcactcgatcccttgggcctactcatgaccaccactacatcagaactgacatttcagagcactactggctcaatggtttgtgatttttttttgtttacttttgattgtcttgctttggtttaagatagataagaagtgtattattattcattcaaatgtgttttggaataattaatttagctcaacattataaaatacatttgaaataattccccactaagaaaatctccaaaaccttttgtttatatagtaatacataatatttattgagtgtctgctattcctcaacactcttctgtgctctaattaatattttaaatattcacaatgacatctgggatatatcattattttattctttaatacgcataaactattatgctataaaaatactgaagtacagagaaataatttggtcaaggtcttataacttgtcagatgcagagtgagaattcaagcaggcaatcttactcttgcagtctgtgtaaagaccaaggcatgtactgtctgttagcccaatgaactcgggttagattgtaatggtaacttctgttgcttaaaaataatatacacttgggttaagacatttctcttcaaaattttaagcatattaatattgacataattttgtctgattactattttaagaatcatacaatattttgagtttcaaattttttaaaaaacataagaatattataaatgagtttatttaattaatccaaggaacactacaaggcacctaactccaccccactccccaccaccgccttacaacagatcaaattttatcatgattctctaacatgtgattttattccattgcatggcagaatgacataacactgtaatttaagcaggcaggcatttttcattcccataataaatattgggccttagtgaaggaggcgagggtagagatttcctagggtctatctctctatctctcagtgccttttaagcagtgacaacataaacaaaaggaaaaacactttgaaaacatttctttagtcaaaaactccagatctatttgtttatacaacaatgtgattctcatcagccaaaaaaagtacccttaataggtagtcttaaaagggaaaacaaatatagaatatccatgactacgtgattacccattaatttcttaacacacatgcaaagcaaagctatctttttgtgcattgtcagatttttgtggaattatttggtttgagagtaacttcttaaatgtcacctatagaatagcttagatacctatttgagtaaaaagatatttttatggcttaaaatgaagtataagattgtatctctgtcttgggatggcaaatatcatgtttctcctcttctaaaagacagtagtattttttccattactgtaacatattcattaataagtcagcagcattgtcaatacaataaatgtaggaaatatgcattcaattattatttgcctagatatgctatttttagtactgtatgaagaagattagagattaggaagcctttgaattggtttaacaatttccttaataaacaacttctgagaccctattgcctactgggtgctattctacccttgtggcctgcatagatagataggggagggtcaccgacctcagggatgatgaacgccttgctcagcctgaagcataaagcgggagtaggagacaaggctacaaagctgtaaatattatcttgaaaccatgatggcttactttttaatcaaggagtcagaattttgtttttctaaaggtaacttacaaaaacaatagcatgttttttaatagcatgaatggaagactaaagaaggacgaggacagagagacaagaggccactgcatgaaaatagggaaatgagaaagggacagcaacaaaagtagtggaagtatatgagaatatactgcaaagaatatttgagagagaatatactgttttgtaaatagaagaatccaaggacatgagacagagctcaagagatttgtatgctgggaaaactttgcaattaaagaagccagtagaataaaataaattgaaggtaggagaaaagacaaatggtagaggaagtctcaattgactgacttcaagcaaataattatgatgcagaaaaactgacttttatggttctaggagattcaaggcagactgcttagcagttaaaagccagggtgataatatgacctactttgcccaggacattttcagtttgctcctgttcttttactcttaaaagtgtccctgtttagactaaaattgattctgtggaacttatttatttgtgcttaattcctgaatggtgactttggtcaaactttaatgtccattcaaattctttgtctgtaaatatggaatctattaacaatagaatctattcacagggcgttataaggataaaattaaatcatatcgggaagtctattagaagacaattttaagagctgaattagcatcaatatcatcatgatcattattaggtatcatgtggtaccatgaaggtagcagtgggaggtagaagtgaggctaaaacctgaatgctgtgtgattctctactatctctttagcattttgtattattgactgccttttcattctctccctctacacttcataattctgtgagctcatccatccgaatagtttcaactgtttcctgtgttccagtgtttcctaaaattgtatttccaaccttttcctgtaactaagtggcctcaaaaataatttatttggatgacttccatttttattctagattaaaagaaaaaagattattgttttatataaaaatcaagatatgtaagccttagttttgattgtgctgttaaattgctttaaggttgttacaagtggtttaatgaccctttgttttaattggatttaaagtctaaaatcttgtgaatgttatagatcttgtttcttctttcaaacctgtccttcaatatccattttctgatttttatctattttaactttcctaacttcatccacccagttaccttggagttatctttgattccttcctcttcttcctctcctttatctaatctatttctaagagcttttacttccttgaaaatatctgttgaccttgttctttctatggttaccattttcctataggtcttcattacctcatctctggtttattgccaccattttattgtttactaactgatctccccatctctcatctcttcccattcaaaattattttatataatatccatgctagtcctatctttggcacttttaaagtgctattttattgactgttataaacctgagagaattactatttacattttacatttgatgatatatttgatgtcagataatagttcatagttaaacagctagcggaggtgagattgaagctcgaatatgtgtatctcgcccctgatattgtatcatttccattgtataatacagttcatcggctcaaaatctgctcttttgatggcatgtcccctgctctttgcagcctcactacaaactgggacatatggacatgccatgtagggcaacagcaaatcaaggatgtgggtctggtagcaggaagcagggacagatagagaagatggagttccgcaagcaatgagggagacctaggcagtctggctggagccagggaaagcagggaaagtgcaagcagccattcagatatttgctgagggaaaggcaggccagagctagaagagcacaatgcttcaggagattcagtcattcaggagttccccagtccacagaaactagggcagagtaaggggagaaattgtagaaatgatgatattcttataatgaagagggatctgatggactaagacaaaatattggcttgctcagagaacatttctgtcctttatgagaaatgggcgattttccagatacagtcagcctatggtccaaagtcaatggagtcatctgtctggagtcaggagtgggaggggagagaatacagatgaactgcgacaagtgagtatttaactgttaagatgcagattctaaagagttatcatttttcatatgatgctacatgaatcttttataaatccatttttatcaccgaagcacttagggggtttaaaattcttgatacaggtgtgcatggcatattatgttctgtgccccacttggcattaaccagagtgagatcagctaaccacttaacagtgcaaggatccttctcagaatttttctaggactgtttaatccagtttagacttaaaaagtaggaatcctgattccttccttaagatactaatccatctagcaaataccttacgaggaggatacaaaatggcaaagatgaaattttttcatctttgaggcagttttcatttgaagttgtaaaaagtgttttttttacagtatttttatgggcatttctaaatgaagtctttgatggttccacactttgatttatcaacttaatcttaaaacatataggaaataggaatatagatgcaaactagggtgtttactcaaatgcagttgagcttttgttacaattttaggataaaactaagaagtgtgaccacttggaagatgaaagcgaacaataacgcctcagatgcatgcagatgtttttgttttctttcttggaatagatgagaacttttgttttaaattttcttttctaacatatggagacagttttcatttgaagtttctcttgggatgatctgttgtctgtaaactctccttccacatgaaaggagaacatcaaaaaatgataataggaaaatgagactataagaagtaataaaaggaagttaggaacttactatctattaaataatgctagtgtgctcatctgggtgaaaagagtttcatagggagaaagggaagtagtgtgtgctgcaggccacatgagtttatgccatgttcttttggcagtgcctcttggtgtcatgctagaagttcatctgaaaatgcatgatttcaagctgcattcctactggggcatgtactcaagtgccaaatggagaaaatgtgctataataaagcccaggtgcctaatggtataattttaagttgtttaattgatcaagtatgcactgattaaatgatacctatttttacccaaatttggcagtaaatcagggaagagtttctgtcataaaatactaacatcagagttctaagaccggacctcaacagaatctgcaagaaataaactctgtgcttgcaacttgtatttatttttaactctcaagtatgcttactatttaaatcacagaataaagcactacttgacactaactctttttctcataattaaatttctttatacaacaaacatttagctttaacacctccagtattcccttgcaaaacattttttacagtacttgcaagagagccaatatttaagagagagttcaataaaatcaataatgactgaataaacagaataagactgtctatggcatatatcagttgaaaggtaaaataaatatcacttggaaaaatatccatgctctttcctcctcccacctcattgatgtcatactgaaatttctgaaatgtagactagtatcatagcctacctattggccatttcaaatagccatacctgtcaacacttggatgatgtttttcatatctgaagtgggttttcctatgcatttctgcattatgacaatgaattgccatatttatttataccccttttacacttcttttatcattatgttctattttattattctgctcttttttcttttaattaaactctgtaaacaagtgaacaacaatcagctcatggaaccccttctcccatttgagtgattgaggaaagctttataagcaactctctccttcatattggtattccttttaactgttctgcttttcggtttcgaatcactgagttctcattttctctctagagagaagattctctacactttgtaccactatgttattttttaaattataaattcaattcaatcattttgtaggtttgacaggacactgaaatttcaagggacatcatgctgcatgtgtaagttctacattaattatatgcaagtgctacaataaattctactcatgttaataccgatgtaatcccacatatttgtgaagataaggaaatccaatcatttcctataatttctgcatagtttcagttttatacatttttcccattcaaattacttaagaatttattattaattccccacgcccccatatatacatacatagaactatattattgaccttgagttaatgagtctaaatgtatctttttcccatcccgtatatagatagggttttatttatttttgtatttgtatatgtttaaaatacacatggcagttcagctagagaattccatccagtttggcagcactggatttaagcatctgtaaattcaaaaagttctaaagattattattcatccctggtctgtgtttgtgggagcccactgttggttgtttttctctgttcattgttgtaatatcaagtcagtggaaaaatcatggctatgcattctctttagccatgtcttgaccatttgtcaatatttccttaatccagatcatacttggtttgatatagagtgtcagttcttattcattcttttattatttaattcaaatagttttctttttttttgcactaaattccttgaatataatagtaatgaaatacattatttctctgttttcttgaatttcagaaacccgaatctcacatttatagaacaatttgatcccacaaagagttgcttttttttttttttttttttgtagtggagtctcgctctgtcgcccaggctggagtgcagtggcacaatcttgtctcactgcaagctgcgcctcccgggttcaggccattctcctgcctcagcctcccgagtagctgggactgcaggcgcccgccaccacgcccagctaatttttttgtatttttagtagagatgggctttcaccgtgttagccaggatggtctctatctctttacctcgtgatctgccggcctcggcctcccaaagtgctgggattataggcgtgagccacaccaagaggtgctttttaaaagaaaacatgtttaaataaaaaatctgaagtgttggtttgcgattaaaaaaaaagagatttttactttgctcagtgatcaaaaccaagtattcgtgatttactaacaatttgaaagagggccggggcaggggttggggaagacattgaatggaatttttaatgggccttgccaatttgagattaattagaaaaaaattaaatactttatgtggttttctaaaattttatttttatatatttttgaaaaaccataccaaagtgagattatcaagaatataaaagtccattgaagctctaaattaccgacaaaacaaacaaaagaaaacaggaaaataatatagaataaggagaagaaagttcatgaatgtatttccctcctttcttttcctttcaaagctttgcattaaagcaaagaagagattggatgggagacacagggccaacccagagaggctgagacgatattgactgaatacccatcactcggaatccaacgttaactttttatttacttattttctttttgagacggagtctgtctctgtcgcctaggctggagtgccctggtgtgatctcggctctctacaacctctgccttctgggttcaagggattctcgtgcctcagcctcccaagtagctgggattacagatgtgcaccaccatgcccggctaacttttgtatttttagtagacagggttgcaccatattggccaggctgttctcaaactactgacctcaagtgatccacccgcctcagcctcccaaagtgctgggattataagcgtgagccaccacacccagccccaacattaacttgtctattaaagaaggctactgtgaagctttattgggatattggccaattgctgtacatttgcaggagagtgattttcataacacctggggcgcacagcaatcagagctctaggcaaaactctagaaaaggcaatattgatctttttcacctcccgccaatttatttttctgttaaaactttttggcttctcttttctcttgcttctgcttcttaaaaagtcagtgctctgttcttctttccaggtgccacatattttctaattgaagtctttccttcatttctcaataaccatactctctgtcttctttgctttaatccaattatttctgaactggtatcatcctattacgcatctgttacctggttaattcacaattatttaaaaccaagacttaaaatgccgaatacctcttaaacaaggttttagaaacccaaataaatttttcagtgatacagtgaaaagaggttcatcatattgcaaacatttttacactgtacatatattatggccatctttccaggtcagtacctacagatctactaaatttttaataatgacatattatttttacaagtacatggatgtactcaattttctattaacccctgtatattgtcatcgtaatgataatgcttatcagccccataactatcttaataataatcacacttattaaatacttattatataaccagcctttgcctgatgctaaatgctatacatatatatatatatatatatatatgctgtatatgtatgctatataaatttcagtatgacatcaatgaggtgggaggaggaaaaagcatggatatttttccaagtgctatttattttacctttcaactaatatataccacggatagccttattctgtttattcagtcattgattttatagaactctgtcataaatactggcttttgtactgtaaaaaattgttttggaggaatactggaggtgttaaagctaaatgtttgttgtataaagaaatttaatgctatatatatgctatatatataaaatgttatataaatgctatatatatagcatatatacacatataaaaaggaatttaatgcttatatatgctatatgtatataaatgctatgtatatacacatataaatccacttgataataatataaattatcttattaggtagatgacgttggtagtcttatattacatatgagtaaattgagtcattgaaaagataaataatgtgtcaaaggtcaccattccagtgagtggcagtgaaagagataaattcagaaagtttatctagagcctatactgtcatattgaacttgaaccaaacactactggttgtttccatttttatacccctagggcaattacacaaaattcatcaaagtattaatacatcacagtatgtcaaaatcagtgctagatttttactatttcctaagccgtttatgaaagacatggtggttgaaaactccattatatagaaagagaatataaaatgatagcatctccatatctgaaaagatctacaagcaatttagtctagtcatgttctcacctgctctctggaattcctggagaacttgttcagtacctctttatgctgatacatatttctacattgtgtcatcttcatttgtatacacatctcatttcccacatctggcttatagttcattttttaaaaattctactgctaattgcttttacgtggaaatatcatcaaactatgatgactggattgtttcagtatcttaatttatagcttcttttctttcaaacaggagcaaaatttattggaactttcttcataccagacacctacaatccagatgatgataaaatatatttcttctttcgtgaatcatctcaagaaggcagtacctccgataaaaccatcctttctcgagttggaagagtttgtaaggcaagatatatttatatattttacttaaaacatatatatatatatatatatatatatatatatatatatatgtatatgaaaaaactttggcaaggtttaagccaaagttaatgctcattattcataaatggtatgattcatactaccctagatgtgtaatttttgagatccaaatgtaaaaaataagaaaaagaaaagaaaagaaaaagaagaaaagaaagaaaaaggaaagagttcacatttttcaaacattacagtttatttttccaacagtgcctgaactgttgccctggtgtgagttacacatctttggcagcttatttcttttattgaaggtctattcttttgccagtgattgctattcccagtaacatcactgcattgtcctgatccctggagcttaaaatgtttttatataatgttaaataatctaaatgaaagtaacttaacgtaatccctagagtaatttaagcatcatcagatgtatattctacatttttatcatcacgcacatcacatatgtaaaattatatatcattacatgcatcaaatcagttgaaattttgttacgttattactctattaaatattttctagacctgtaatctagtttaggttctgagagaaaatgaggtaaagaggaaaaaacaaacaaccacaatgcaaaatatttattttgaagaatactgcaattagtttttaatcttgccattttatgtaaattataaataaacacagatactctatgagaggcttccattttgtgccatcaaagctctcatttgactgaatacaagctttatggaataatgttgctactagaatcatactttaacttcagtatattatttttctgcttagatttgtctccactgaaataacttttcttaaaaagacacctttagcatcaactcagttattaaggggaagagctgttaataaatactctcagcaggaagctttctttggtcttgtacaaacttttcattttcttctatctgaacctatcacgtttttctttcaatctgtaccctcaggcttctgaacactttcagggacagaaatacaaaccatcattgcacttaaaagtgctaatgaaaacatggcttttgaatgaggccaacttgtgagcccagatcattctttacctagtgtcctagccaataatgctgtctcccactgatcccctcacccccaggggacagattctctaaaaagcattctcattctttcagactctaagaattcacagtaatttctcttgaagcctcttgcctagagatgaatgcctgttgtttggagtagtcctaatgtgttagtgtattgaagcatgccttatagcaacagtatcctgaccctgaaaagctgtgttgtggattgacattatttgtataaatgagctatgttaaataaagaataagggatttacaatcaattaaatgaatttcaagagtcactttctgatgaatatatatagcaagtaaatatatattttgtgcaccagttcaatgcttatttcttgataaatataatccatttaatagaaatgtatttgtaacaaagtaatgtcttaccctagtataaatatactgaaagttaatctcagagtgtattaaagaaaaatctagttatcccatatataaattcctatattaaaattataacctattctctaaacatcaaccatgtaatattttatttatattatgaaaaaacacctagagaactggaaaggcagagaaaattgtcgtaaatgagttttctcatcacacacacacacacatacacacacacaaaacctctgaggccacacagcaagattctgtcatgctattgttcttggttaaaaagctaacaaattgtgagatcaaaaaagaatatatgatggatgaatttattttttaaaaaaagaggttcttcattaattagtgtatctccactcaatcacatttttaaatgagcacatcttcagaatttctcactatacatatgatccattggtcaaatgtctacaatattttggttctaaatgctttctttgcagtttctcagttgcatcacatgctgcccatgtttctaacttaataatctaagattaagttgtggcaaaaagtgaacattttcaagtggagatttcactgacaacatgaaaaatgacttaaaatctttatttaaaatatgacaagatggcctacaaaacaataacaactttagcaataacaaaaaaagacctcagcatcattgttgctgtaatcttattttcacataaaaaagattattttgacattatttgaaacttattattcctttctgttgtttcttccccccagcgtcattataatactgtttttttcttttgacaagtaataacagaatgcacatctatgctatgaaacaaaattgagttcagtagatacaagtaaagatctaagaagcaacagatcatgttagaggaaactaagagtaaactgtgtatgcttcactgagttttacaaagattttttagtaacatgagagtcctttattctatttgttccaccagcatattcccacagaacatatttggaaatactcaggttttgttgttcttgctgttatagttcatttgttctcatttttcactgaataagttagcacagtaaagaactgctgacaatttaagagctcccttcatcttcagctactaactgaaaaacaattgttttattgacttgtaaaactagttttattgaccggtcaaagatactattagactaagtagtatactgtgattggtggggaaaagattttggcaatagagaaacattatataaaaatgggtaaaggattattctcacaacaagtgtgaatcttttcacttttataactcttttgtttattattttattatctaattatttcaacaacagcaacaaaatatgaaataatttctgcgcaaaatgcactatactagacaattagtgtagataatcaaccactgtcccttttctttcaaagcttttagtatagtgagggcaatagatatatcaacaaataatcataatgtgatgtgatagagttatgagctaagaactctagggatttggtgaagcccaaaaacattgtatgaaggaagtggtgctttagttgagttctatgaggaagtgggactacgctaaggaatggaggccaggcatttcaggcagcgttgtgacagttgttttttgtttgtttgtttttcgtttttatttttgttttggttttggttttagttttggttttagtttttgtttatagaacagtgaaatcttgttgtaactggaattcaagggatgtgtctggggagcaatgacttttgagattagagtggtaagttggttgataagaagttttgtttccatgttagtcagtgtgaactctatcctgtagtcaatgagggattataaaatgttttaagcagagaagtgacaagataggtaaatatagttagcagcaatttgaagaatgtatctggatcgagaaatatttgtgactgggagacctgttaggttgttccctaaagataacaggaacaaagagataagcactaagagtaagttcaagagatagttcagatagaaagtatatgtaggtgtatatgtagatttctataaagtcctcactttattactgctcttttattgtttgcctggtatacatagggctgaccaatagagcactcttataatgacggtaatattctacacctgcactatccaatacaatcgccatgtagatgttagtgttcaaatatgactggcatgactcatgagctaaatttttaatgcattttaattctcttgctcctatcatagagattttgatacctaccctgtagacaagtacccttttatccttggtaattgtgattcctggaagatacaacatggaccaggaacatgtgcaaagagatatattttgatatgagatggtaaataacaaaaaaaattatgagcacagatttttatatttggatatgaagaacttgatgtggttctgagatatgggggcacaatagccagttgaaaatataacctgaggctcagtagtctctggactcataaatttgaaaatcagcagtacactggcagatcttgaagttatggaagtgcctgacattactcaggaagatttgtagtgcaagatcaaagggcaaggatagaatccaatgggacaatgacatttaggaaatagaagagaaaagtgtctgcagaggcaattgagaggaaatggtgtcattgctgagtgggaaaactggagaagagtgttgtcacaagtcaggggaaaagattgcttcaagaagaaagcagttgtcaaaaatgtcgcttatcaaaaagaggtcaggtaagattatgattaaagactaggtattagattttgcagtaatgatatcatcaatgacttttgcctggatgatgtgaatgttcaacttaaaatcagatctaggcttacattttgctctacttcccattctctcagtttcttaacctaaaaaatgaggacagcaggcacctattgcttccataactattttaccaagcaaatgtaaggctttaataagatcatatgaatttggatgtgacagataactgaggaaggtgccaaaaacaagggtaacttagatatctaagtttacaagcatgtaacaatttactataagagattgacatgtaaataatgtaaatatctggtcacactacagtgaatttaatcccaaaaatcacacatatgcacacatgcatgtgcacacatacacacacatcacacatacatttggagccagatcagcgtacctgtgcttaggaatggaagaagttggtgttgatggtagtggtgcgtgtattttgcagtgttaggggcaggttagttaccaaaggtgatcaaagagatatgtcattttattagttttaaaggctgaagttacattattatttttctttatctttaggagaatttgtgctttgaagattgatcttatttctgaacatagtcaaagtaatttggagctgtatttggagaaagttgcataaatgatttgaacaatgcaaattttggtcaagagatatcaatgaagagagacacaataaataaactgacttaaaagataattttactgggcaatattgatcaatgagagcctgaggcgaataagtgccttcatccacagaatatcttttaaacttaatatgtttataattatacatggtagagcacatttcctaatgaattatttttagtagtgttcctactttccagtcaaactacttactctatttttccaataaattgtttaaccttgaaggatttctaaagtccttgtcaagctctacagttctttcattttgtgaaacagttaatatcttgaagcacgaaatggtgcaacttacaccccaaagaactgctctcgtagatggtaaataacacagatcttcttgatgagctattaaatgctaattgaatgaataggcaaaaccacatgaaataaacccactgaaaagatttgtgtctatttactttgcaagttagtactttcaaaatacattatttatgtctgtctgatgtttattactctgtctctgtgtgtgtgtgtgtgtgtgtgtgtgtgtgtgtgtgtgtgtgtgtgtgtttcccttcaagacccaccttttaagtcaatgggtggaaatactagttctttcggtgagacttgcttgcaatttttcacctcaaggctgttttgcattacttttgaattctattcatttttggaagagctgcccattatacttatgcaagtctactccagattccagctgtaggttatgccagttctcttttttgttttgcagtatttcctttccccatgccaggaattcagtttggatggccctttcacataacttgcctgggggtctcattaatagccctttgcttcaattccacttgcattgtctattttgatatatggtcctatttggacaattactgcctttgaagatttgtgtttttaggccgatgacactttccgtatttattgatctctgttgagctgtggtttttgtgcttactttcagcatgtcacttacaacctaaatgagagatttagtgcccacgagttacagatgtgcttttgcttcacttccatctgttttcctgtctgagaaattcctaggaaggggtttatactgtttgctacagctttttttttttaattgaatgaactctgattctacctgaaaaggactgcttaacattcctagatttacctaactgaatgtgctaaatcttagaaactgagttgttcaggatagtgtattacaccagtcctgtatttccaataatttttatgagtttctgaagtagttagaaaaacatgttctccacttctatttgcttagtcattaacggcaaatcacaaatagtcgtctctaaatactaggtgtatttttcagaaaaaaaaaattgccttgaaagcctctatagaatttatcccttaaaagttagtgtgtttaatagctgccacaaaagtttttgttgttctttttttttctcctctatcctttgccttagatgtttgagtttgtatatttttatttcatctaaagtatttcaagattattagtaggtgaggtaaaggactctatgttattatatgtcaagaattttggggggaatcctaagtatcagaagtgggaaaaaaaaacttttgaaaacagtaaagagcaagtgccaatagaccttcctctggtaaagagaaacggtatccataaatttctctttatgttaaaaaatgcttataatttaagttgccaaagaaagtaagtgaagagatatttgtttctacatgttatatttctacatgttctatgttacacagttgtttctacatttgtttctacaacttaacttaccggagttgactgccaaatatggttatgtgaaaactctcaaccgtatttttaaaattcatattattatttttgccttcattttttagtggtcagatccttttttaaaaatcccaatgaaccaggtacatgaaacatagttatggcattgcaagtattgcaaaagaaaacccacaggctaaaaagggtagttcaacaaagtttgtttcatttgatttaatgagcataacttcactatcttccattagttcacttaatgtatcaaaacatactcatttaagatcttcacaatatagtaatatagttcaatataaggcatacacttctaatgagtctcttgggggcttatgccaggtttcactttttgtttctaccatgtcatggtcatagtttcaaacttctgaatagaccaccctgagtttggattgtccttatcattattatttatttatacagccccatgcagatcatttgtactaagttttcaaagaaagattctaaaatctgtttctagaaataacccactgaagattgagacaacacagatagatgtagattggacagttgctgtgggatctattataaatgacaaatcaagcaaagaatatgaatgatggattgaaatataacaggcattaaatcaaaaagacaaaagtattaaatttccctaatcttatttgttgaatttgtaaaaatggccaacagaaagcctgtgtgtttgcctcagtgttagtttgggtaatggaataggtttttcttaatttataatactgtagtatttatatcacacttcaaaagaaggtgagtagtattaattcaaactaaaatctataagcataagtgttattaatgggtagaacagggagtggggcacacaaagaatgcatatatcatggtttcaaagtgtctgagaatttcattctcttgcttgcacaaagatacagaagagcagtattaggcaaaataactaaattttaagcagagaataatttataacctctaactccagcatcaactattttttaaagttcttaaactttgtcattatccagtttctattgatttgaaactggtgtccttcaacttaaactcatgaatagggttacaaatctctgcacacaaattagtagcttaacaaaatacttgttttcaaatgtcttggagagtaaactgattttacaaaatcttcaggatttaagagcataggagccgaaagtcaattattacattttccaaaagccactgttatctaatatataggttaaaatgacaatgtttataaagtactgagggatccttgaagaggatggtatatacagataaaatcacgtttaacagaggaacccagcatagtgacccaaagttcaaaaggcacactcaataaaagttcatgtgtgacagctgctagctactttacatgtctatataagatttataagggtttaagttttgctgggacagtagaaggaaaatataatgccatattaccctgctttaggtctgatctacctatcagtagatgctatgattagaagatcttagtaattcgtaacatgcaaccatcatacaatcaaatgactcagatgtactatattttaaagctgctgaaggattgcaaattgtggtttgttttgtctttaatttttttttctttttttaattaatcattttaaattaagaaatactgcaaacatataacaagtacaggaaaacaggcaccctctgtacttaccacccaaattgaacacatgtgatcaggcttgtttacatatactttctttgttactttcatctgcatctttgtgtagagggtgtcaaggcttttggaacacttaactacaaaaagtgaatgataaatagtgtagagacccacagaagtgcctggtgactaaaaactgctgattttgacatcttaatgataaatctattgtgttcgtgagatggttatattctttagaacttcacaaaaataagcaaggaggtgacaatttagtacaaaagtggttacctccctttcagccctcttctgggcttaaagttcttagaggagattgtgtggatatgcaaacaaatccagggactgagaaactggtcaacaaagtcagcccaactgacatttccctacaggagaaatacaactccttgtgaattgaactttgccatctcaggtcatgcttctggatgtctgtaagagttactatccagtcattaaatgcttataatccattcctgagtgctattatcccaggaactgtatttgcttcccttctgacagcaggtggctttcatctttggcttggatttttttgttttgttttgtcttggttttttatctttttattcctgaggggctagagaaggctgttggatgggtaggtaagattattttgttcaaaaaatttctattttttggtcaggttaaaagaaatgcagtacagtataaatcccttttctgtcctacaaatctagatgggattattctgctagttagaatgttctcatggttaccttaaatatcagtgataattgtaaatagaaagggaggaaatgtttgaaaatgaacatttattatcacttttacatagtaaaatgtttaaaagaggatacgattgctcatttttatgaatactgtatatgcctattaaaggaatgtcgttaagcagatattctgattatatatgtattcacataacaaaataatttcagcatatattctgtgatgggtaagacaaactttagtctctggcattatattcatgatcactgatatgtttgtttatatttattgaatcaacattatttttagtattcactgctgatcctctcaaaatatacaaatttaggcaaagaaaatttaataaatactatcaatatataagaattcattaaaataaaaatgtttttactagtgctcttcttatcacaactagaaagctgataaaaaaatgtaaagattagatacgttactttaaacagatctaaatcaagagccatgagaaagatggggaaatatcttacatttttaaattcatttaaaattatcttagtttctgataattccagatatacatcttctcactggaatcctactatacatgaacacagaactcattgttacattaggagaaagcgtcaatatttttgcttattcttattaacgtacagatatatattcataaatgttctgaggatattggcattaaaaacaggtcatatctagataaatctgtctgcatctgcagacatctgaaatcatccaataactggctgaaatatactttatttcttaacaatgatactcataataaaggcatcgtatataaaatataaatgtaagagcaattaccgacaggctttttatgacagagccactatatagaatatattatacattttcttaaaaggaaactgattatttaacttctttgccaattactaaattttttagtagttcttcatgtgcacttaataacatacagacactttggcctggcattaaagctttccttgatcttaccccaatttactttcataactttttccttcactattttaattgatctcagtcttcaactaaacacagtttatcctgattctcctagatgtcctggattgttccacccattgtccttttccctagtttccagcacagacagtattacctgaaccaatctctacatatgtagtttggtcccatctattattgtaaaaagttaacattaaacccaactcttcagtgaagtttttgcctttttcccactataatgaaatccttggcccttagtctataccattctgaaaatttttttcaattttatgttttattcttagttatttattaactattaatcatgtcttcattcaacagcaatagggatttagtgacatattgggagttgagtagagggaattttagggagtgcattgtctacaagaattaaaaattattcaaaaaccaactaaaaattattgtgctttttattattgccacatgccagtaattgtaaacagtgtcagtgacaatatgctaatcataaaagagtcttgttggtctagattttaaactgtggtttactactgtgtatctattatgtatatgtatatatggatatttgtgtggatagtaagcctccagcacacatgaactcagctacacacatgttccaagagtaagttcataatgatttggaatcatttaaaatttaaaacagtgagacatagtgcaaactaggaggtgtgatagtttgttccttaagtgccaatttttagttcttacatgaaatattctattgaatgttgttgcttttagatttcaaagttattattttaaaattgtgtgttataaacctaaagaacaaataaagaaaataataattattcctgagttttacagaactgttactgaaaatgtatcttttgtttagtgagaaaggaatgtaaaaaataattcactctgggtatcacataccatagatgcccttggtgttaggtgctaaggctataaagatacctctggtctctggtttcctttctttctccccttccccctttcttcaagcatagtatttataagatttcaaattctcttgtttgttgtagtcatttaaatgcctttctctagtttaatttcagagataaaagaagaaagtttctagatattcagacttgaaacttaacagttaacttctcattaactttacagaacatagattgaaggataaatgattttatataatttatacttaaatataaataaattattggaaaagatggcttcaatagtaatttaaataaattagtcttattataagcacagcagagctagttgggttaaatgaatgaaaaatcatgcttattcagtgttcacaggtgtattagtctgttttcacgcttctgataaagacatactagaaactggggaatttattaaaaaaaataggtttaattggactcacagtttcacatgcctgtggaggcctcacattcatagcggaaggcaaggaggagcaagtcacatcttacctggatggcagcaggcaaggagagcttatgcagggcaactcctgtttttaaaaccatcagatctcgtgagacccattcactatcacgagaacagcatgggaaagacccgcctccataattcaatcatctcccacagagtccctcccacaacatgtgggaattatgggagctacaagatgagatttgggtcgggacacagagccaaaccatatcaacaggtatatattaatttaaaaatgaggacataaatttttatgctgaattattgaatagtgtaattctgtttatcgtgtaattgatttaagtgtttatgttttactaaatgcttaaagaacatttttaatgaaccatttcagagtaaaaataaagtatggaaaatatagataaatattctttaaaagatttgtttttgtttttgttttgtttgcttttgagacagggttttgctctgccacccaggctggaatcagtggcacaaacatggctcactgcagcctcaaccccctgggcttaagtgatcttcctccttcagcctcctgaatagcggggattacagggacaccccaccacacatgactgaatttttaaaatttttgtagagatgagatcccactatgttgaccatactggtctcgaactactgggttcagctgatcctcctgcctcagcctcccaaagtgctgtgattataggcaaaaggatggtttttatatgtgtattattacgcatatgtttatgttgcatggatgtttaattagtaagacattaaatttggaaaagacttttaagcctataaagagacatattgctaaaggttgcaaatattgtttttaatcctataaataatatacaagccagtaccagcattcattgaactcaagttgcctgagactatgctaagcattttatagactttttttccccatttactcatcaaaccaaccatatttcagctgggttcagtggtatgcacctgtagtatcagctacttaggaggctaatgtggaaggattacttgagcccaggagtttgaggcaatgatcttgcctgtgaataattactgcgctccagcttggacaacatagaaagacttcatctctgaaaaacaacaacaaaaattaactaaccgtatttcaagagatttatcatttttatcagtgagaaaacagagacttaaaaaaaatagtctcttgcaggtcatgaagcaaaaaattggcaggtgggatttgatttcaagctgcctttaccattgccttgtatgcatctactcatccaatagagctgaactgcttgtatttaattcatttaactatgagaaaaacatttaatattgagggctaatactgtctttttccttattttaaagttcaaggactcaatatctgggttcagtgtctttgtaaacaatgacatcaataagacactacctgtaatagccaccagttttagtgagtggtagaattgtgttgataaatatttatctttattttttttttcatgtcagaatgatgtaggaggacaacgcagcctgataaacaagtggacgacttttcttaaggccagactgatttgctcaattcctggaagtgatggggcagatacttactttgatgagcttcgtaagttccttctttccttctttcttggaaaggccttactgcctaattaagtaacttggcatttatttccctttggctccaaatgcctgattaattttacctgagcaaaccttacaggagtggttcttactaaaattcacacgcaaagtacacggaagtgctctaggtctgggcacacgtcataatgcagtaactcttctctttgtaagagtcctcaaagtaagtgaaggaaacaaaactacagcaagacacagaaaggtgtgagctctggaactacacagttcatccattctccatgcagtctttcattttgaaaggagccaccttctataggtaggaaaatcttggattccttattccacgggtgccctctgctggcaagtacaggagatttggtgaacactgtccctccgacttgttaatgaaagaataatcagaagcagtagacagcttcttctatttcacttctcctcttcactccctcaaaaactccttccaagtcctacaatgatttttttcttttttgtttatgtataatgttagcatcattagcttttagcttcttgaacttgttcttatttttgccatgtaatgtaaaaatgataatctatatcatggaattatttcatcagtattgtgtattttccaacttaaagtatacattgagtaatcgtggatgacctctcctattgtatgtaagcacattcacatcttaatcttttaaagaatattatttgcacataacttactgtcaatacggcactaatttgggggtagctattttcttattgttaccaaataggtaaatgaggtcaggtgtggtggctcacacctgaaatcccagcactttgggaggccgaggtgtttggaccacttgaggtcaggagtttaagaccagcctggccaacatggcgaaaccctatctctactaaaaataaaaaaaaaaattagccgggctggtggtgggcacctgtaatcctagatactagggaggctgaggcaggagaattgcttgaacccaggagggagaggttgcagtgggcagagattgtgccactgcattccagcctgggtgacacagcaagactccatcaaaaaaaaaaaaaaaggcaaattaattactaagttgacacaattataggacagaatttttttacactagagggtaaaaattacttattttttggtttatattttctatgaaatcagatttccaattggaaactaccttggagattatcaattgtaccataccatacatagtcattgagaaaaaacaatcttatatttgatttctcaaggcataatatagtgcctctgttaatcgtataaactgtttagattttcagagtttcagttgtgttattaacaaaaaagcaatgtaatactgaaaaataagagtaaatatttatttttcccctttaatagaagatatttatttactccccacaagagatgaaagaaatcctgtagtatatggagtctttactacaaccaggtatgttcaacaaaatgcttttaatgcttcagagaattgtatatgtatgcaagccaatatagttataggatctttttgtccctgcgtttgtagtagcatatcgtaaactttttttttcattttaccttttcacttagtgttccttaaaaatcatttaatatcagtgtaaaaaattcttttttttctttttaagccagtatagcattagctataatgattaccacaagttatttaaccactcctctgaacatggacatttctgttatttccaaatgcctactgttgcatataatgcttcagtgactaaacttgtgcatataccttccccataggaacaaacgtatctgtgagataaagtcccaaaataaattttctgtgtataaaaggcatatgcaggctgggctcaccagctcactcctataatcccagcactttgggagtccaaggggaggatggcttgagcccaggagttcaagaccagcctggacaacatagtgagacccagtctctacaaaaagtaaataaaaaaatagctgggcatggaggcacatgcctgtagtcccagctactcagaaggctgaggtcagaggattgtttaagcctggaaggtagaggctgcagtgagccatgatggtaccactgcactccagcctgggtgacacagcgagaccctgtcaccaaaaaaaaaaaaaaaaaaaaaaaagtgtttgcgtatatattaatcatagtaagtatttacatgatatgtgttgtcatagtgatagtactaaggaaatacgtggataaatggttaagttcattggtaaggctataatcatgagatgggacactcttaacctttaaaacatcatcacatgctgtcctattatcatttcccagttaccctacaaagacaggtgtggctgttatgactatttcactgctttactaatttaggcaaagaatgttttcatcacttgctcaaagaggagcggactattagtagtaaaaataaaactgaaagtgaagacaatttcatgttttctactcctgtatttctgtcttctttttgcataatgctttcctgtacttatcattgagaccttccgacttccttaaaagttgtactagcatcggtgggcacgatggctcatgcctgtaaatcccagtactttgggagaccaaggcgggtggatcatctgaggtcaggaatttgagaccagcctccccagcatggtgaaactccatctctactaaaaatacaaaaaattagccaggtgtggttgcgggcgcctgtaatcctagctactcaggaggccgaggcaggagaatcacttgaacttgaaaggcggaggttgcaggttgtgccattgcactccagccccggcaacaagagcaaaactctgtctcaaacaaaacaaaacaagttgtactagcatctgtgaaactttctcaaagaatatgggggccccacagacttaattttatttaatattcagtaacttaaatttgactatgttcaaagcacaccctttctcctgttccctgttacagcctatattgttggaaatagttttcacattttccacagctctgctctcaaactttatcaatgtatattgacatcagtataggaggaattgaagatactgatattggtactgaagaaaaggtcttactgcctcctagtgaataaatttttaatctattttatatgaacaatatagtttaacttttttctgtggcacaatcctcattttgttcacaataccttattcataaactgaaatgcactattggttcagaatagatcagaaaacaaaatactgtttggttaattataagatacagaatatgaatgttcaaatatgagaataaagaagatatcctaggaagctgctattttggactccattttcctgttaatttatatcctaatataaaaaggtacaagaagtgcctctggtcaagtatctcaatcctagttctcttggcacctttccaattgcagaactttctttgaagtcactgtgctccacacacaaggcacggatatgtgccaggaaaatatagccccaagatagttcgtttttttctcctattaagtttctgcccacccagagtgtgaagttacaagttagctctttgttcttcctatactttattgttttgtttttaatgccatcctaaagaccaaggtgacattggaatgtatgtcatatcctttgtccaacaagaagacataataaacctgcaataatggcaatgccattaagcatgaggcatcatacctttaaaatatcctaggcagattctgtgatttctgtggcaacgccacctccattctcaggagctagttttcttccacctacctatttaccattacctctcaaaggttcccattaatatcattccaagaatattaataattgagttactatgctagagaatcattagcttatttgttaatgctaagttattattattattatttttattatactttaagttttagggtacatgtgcacaacgtgcaggttagttacatacgtatacatgtgccatgttggtgtgctgcacccagtaactcgtcatttaacattagacgtatctccagatgctgtccctcccccctcccccccaccccacaacaggccccggtgtgtgatgttccccttcctgtgtctatgtgttctcattgttcaattcccacctattcgcaaggacaaaaaaccaaataccgcatgttctcactcataggtgggaaatgctaagatttttaatatattttttagatcataaaggttgatctcatttttgaaaatgggaatgattaaaagttttcaactcaaagaaaatatcttttaatttctagaaataaagcaaaaaaagacatctgaatagtgttaatttttagtagtttgcaaaaatttgaaaaaattcctttggagttttttgcctcttaatactttctctaatcctgtgtaattataattaagtatcagatgagctactgtaatacataaactcataaattcaaggaggaccaaaaagaaaaagattgtttcaacattttaaaatcagtttaataaaaatcatataaatatatcatttagcaactaatgtttatggatattcattcattgtaagaaaacaaacgagaggattattattcaaatatttaaataattctttttaataagtaaataatgtcactttttattttgtaagcctttggaaggcattatgccataataactttaaataaaatggaagaacatgtaaataaatataacactctttcatgcatattcctctttatcctccagggtttgttttatataatttctgtttatctatcaggtgccaatttagatgacacctcctccctgaaaacttacctggcagccctatactgggtacccatgcatgttctactttgcttactatatttactggcgatgaagttattattacactttatttagaattgcttggctgtaagccacttgaggacgtaggcacattgtgtctacagtacccatcaaatttaatgtgctaagtaaattttgtccacagcacctgctgatagtatgtgctcagtcaatgtttattgaattcatcagtgaatgattgaatgatgatgctttttttttccagctccatcttcaaaggctctgctgtttgtgtgtatagcatggctgacatcagagcagtttttaatggtccatatgctcataaggaaagtgcagaccatcgttgggtgcagtatgatgggagaattccttatccacggcctggtacagtatgtatccaacttaataatcaaattattttcttaagctcatatttaattcttaatttaattgtaataaattctgctattcaccagagccacatgtgctgtaataacatttatttgcagtgaagtattagcattttcatccttcattgaaatttaacatttcagtaagaattttagttactttgagaaacaatggactatgtcataagtatctaaccacggggacaatgtggagcttatccccaacatgtttatgtttatagaatcattggaaagatttagttatctagaatgacagctattctaaattagatggaaatgtcaaagaagtattatttctcacatacagctctgcagatagctcgagtcttctaatccccacttctactttgaaaagaacacatcataatggttcacttaatttatctcttttttggtatgcatttatcttttcttcacttaattgtaccttagaataacatgcactttttaaatgggaaaggaattttagaaaaccctcagtcaaaaatttttttcaaatagtatgaatcatgtttaaagcacaaatgatgtaagtaagaatgtattttagagtttatacaattgtttaaaacaaaaaacaactgcagttcaaaatgctgttacatgcattttaagtgaagggatttttaaaacatttgttgatattattatgacagtttaagttattttaacatcaggattatttattgacctaatattaaagaggaaaaaaatttttttttcattttggatttattctgaatattactaccaagaggtttaaaataattaccaaaatatctgaggaaaatattgacttaactcttcaagttttactgaatattatcttttcatatgttcattcttaaaggagaaccagctggtagctatgctttccgaattctgtttccatcttcctgctatataacttaattaaatttgggaagtatgctatacaaccatctctattttccccttaataattccccaatataaatttgtttcaaggatggtttctaacttgattataaagtaataacgatgtttgtggaaacatgttttttttcaaacaatatgattttcaggactcatttttttaattttctctctttttaataatgtgataagaacatttaacatgagacctatccccttaaattttttaatttaccatccattattgttgagtataggtacaatgttgtacagcagatctctaatgcttattcttcttagctaacagaaactttgtgtgcattgattggtaacttcccattttgctccctcctagcccttggaaaccaccattctgctttttgattctattattttgactattatagataccttatataagtggaatcatgcagtgtttatttctctgcaaatggcttatttcactcaacataacgtccttaagattcattcatgttgttgcatagtgtatgcagaatttccttgtttttcaaggatgaatgcagtcccattttatatatatacacatacacacatcccatatatatgatatctatatgcacatataaagatattatatatgcatcacctgtatatagatatatacatatatgatgcatatatcatatataaatatatgtatgatgtatgtataaatgtatcatatatcatatatacatttatatatgatacaagtctcatatatatgtatataggatatatgatatataatcctagatatattgtatacatataacacacacacatacacacacacacacattttctttatccattcatctgttgacagacatttaggttgtttccatgtcttgactattgtgaatagtgctgcaatgaatctaagagtgataatatctcatatatctttgatatcttaatttcaattgttttagataaatatcctgaagtaggattgctgcatcatgtagtagttctatttttaattttttgaggaactgccacactgttttccatagtggcagtaccattttgcattaccactagcagtgtgcaaggcttccaatttccccacatcctccttaatactcatcttttgtttttatgatgttatccatattatccatcctgacagatgtggagtgatacctgattgtggttttgttttcaacttctctgttgattagtgatgaataattttcatgtacccattggccattcgtatgtcttctttggagaaatgtctattgaagtacttagcccattttttaattttgttttgttttgttttgttttttgtttttttgtcagagtctcgctctgttgcccaggccaaagtgcagtggtgcaatcttggctcactgcaacctctgcctcccgagttcaagcacttctcctgccttagcctccagagtagctaggattacaggtgtgcacaaccatgcccagctaatttttgtatttttaatagagacggggtttcaccaggttaaccaggctggtctcgaactcctgacctcagatgatccgcccacctcatcctcccaaagtcctgggattacaggtgtgagccaccatgcccggcctaggtcattctaatgcttttttaactattttttattcattgaatatcacagctgtacttactcatttcatttacttatattttaatagtaatatagcacttaggatatggggatattattctaaaggttttacaaacattaacttacttaatactgatcataatcccatgaaacacatgctattattattaattccattatacagatgaggaatgtcaggcaccgacaggtacagtaacttgcccaaggtcacaaagctaattagtgatagggctgggtttcaaccccaaactccaaattcttggctatttactatcatactgtaaattcaaggtcattgttcttacaataactcccagttattagttcttacactatgatgttgcactacaaaaatgttaaattatatatttttaccttccctgggagattgtgtgtgtgtgtgtgtgtgtgtgtgtgtgtgtgtatgtgtgtgattaaaattgggaaaacagctctagaaggatcaattttactctgttaatactttggggttaaatattatagactgtcacattctgagccttttcttactacatgagttttttggtttggggttttttgtttgtttttatttgtttttaataaagactgtcaccattcaggccatattatttttcaattatctagatattataggagaatgaattggaagctgagactattcacattaattacaacaacaacaaattatttgcatatgtagacccagcagttgagtcctataatactcagaaatagaaaataagtatcgaaatgactacatgctgatgcatcctggttacattattttccaactcgagtgtaagttaagatgctttacaagtggtggttgtcaccgccttccctgctgctgcctaaaagagctgtgaatgtcatgcgaggcttaaagagaactcacgttttacatgactgtcctcataagcacacagacacttctctgaaacgtgagtaagagactccccgaaagtaggaaaataaaaatgtcagtgggaagtgtttttcatcaatgagaaaataaacaccaaattatgttcaacatactggtctcttctgccgactactcagaatatagtctttatgctgtaagaaattgtcttgaaaagttcaaaattatttagcaaatagcctgcatctaaaccatcaaataaatacttaatttttactttctaacaacttgggaaaacaaaagcatgattaggactaaagaagggtcatttaaggaagttattactcaattttttctcaacattaatatttatcatacaatttttatgcctttaaaaatatgtaaacacatttgcacctgaagttgagctctgagaaccatgcctaataaagaatctttccaccgtagcccctattaaggctgtaatcagtaatagagacagaaagaccaagtctccttctgaaagactccaccaagaaaactctctttcatcaaatattatgtccttttatagaacttaaagagattttaaacatgccagttactgtcaaaatttatttatttttacagttgtggttaaagaaggaggattttctttttggttgtactgagttaaactgttatatctatgctctctttagataagcagaaaccacataatataaatttattagtatgagactaataatgttgaggtatttttaaatatttttattgatcaaccctatccaattgattttgtgttagtatagtgacaatcatttctactaacatgtttgcaggctttatctagaaatccgtggtagctaaggacatcagctatttccaaataactagctacttatgtattctctttgaaatcactgtgaccaaatttgaaaatgtctgaaatcatgcatagataggtagccttttacttcattgcttcttcagtcatttttacaacatcttgtttcttattagcactcaatgctattagtgtgcttttctacattatgttttatatttagaatactgatgttgaatttaggagcatcatatatgtgatgtgaaaatctgttatacaaatacactttaccattaataacactacacattaaatcattgaaattatatttcacagcgtatcagataaactatgcctgtaaaatttgagaatgtaagaactggagtgaatgataaagaccacgtaattcaccctcattttacagggaagggaatgaatacccagaataattaaataactttcccaatatcatattgccaaaaacagtggaatgaagagggatgttgaattttctgatcagtcttctctctctattcgttaatattctgtaatatgcacttatttcctaatatttatctgattgatatactgccgaatgtcccacctaaaattagctgcattgaattttacattatttcctggcattctttcttatttgttttctaaaagcagcccaatttcagtaatttttgtttatataaagttatgattctatctctctaaatatccagaatattttgatcaaactcattactgaacacttcttatgatccagacactctgataagcccgtatacgttatctcactacattcttaaaataaacacacagagtaggtattattatcccaattttatagataagaaacaagcccagcgaaggtaaacatatgttcatgctctcacagtttatgaattgttatgactggaatgaaacttactctacttaactccaaatcaaaagccattaacctaccttttgttctaccttcaaagggataacaaatgagcaaccaaacagaactttatgctatttttccagagatttgtctattctctgcacaagtaataatgaattttgaaactttactacacttaccatttctcttactgcaattcagaggaacacatcttactttaataaaagtattgctgaatactttgctttctatgaaattgttagaacctttactaaaagccatattacacttaagttaaagctttaacgtaggttattttttaaaaaattgtttttacattttctgcatctgtattgctattaagattgaattctaagttgttctcccagtggtgagacttctgttgacattatcactcagttaaataaacactacaactttcagtgtgtcaagcttactttaagtttttggttttgacagaatgctgtacttctttgacaaaaagtcaaacctaaactcctagcttaaccatgacatcactgctctgcaatgttaataagcctagaaaagcaagaatgcaaaaggatatattatagaattccttcacttcaaatgattcttctgccctctggtgtccaaatagaatatttgaacaagccatattttgttcaggtggattttttcaatcattattgccctgccaggttttggtaataagaagttccaagtgaaataaaatattaaaaagtccataatacagtgaatcaatcatacaggtcagatatagaaaccaaattgaatccagcccaaaataacagactgctagaaaacccagaatctaagaaagatttgtaaaggcagaaaatttccaacttgatagttggttttttataactgatgtactctgcagttttattctgtgtagccaagggatttttaagatttatgcataagtgtaaagtattagtaaatatttcctcaaaagtgagtttcagttttaaaccattcccttatcaaaaaggtgaggagaaaatacttgtttttgaagttcaaatataaaatgcatgttttactttgcttgaatcattttgccaccatttttaaataactactaaatgtctgattttgtaaaaataatgattcctttttaaattccatttgctcccaaattgttaccgcgttaaatgttagttgttttagttttacttttacagatgaaagcttacacgtggatttcccaactaagtctccattttttggtgggaaataaaaggaggtagttataggtactttttaaatatttcataaattcattttactatgtggacactgatgaacataaatgcatgataatttttattaatagctcaaacaccagaaaagcctgttctttttacttttttttatctaggtagtttcaaaaaaaaaaaataggtggtgaaaaatggtgattctaaggattcctgaaaattttttggttcaaaaatttgaaacaaagccatatttaaggaacatcataacatggtaagaagcatcctgggtagagtacctagagactggacttctcacgccagcattgcctcttccactgtccaacactagagacattaaataaatgctcattttcagctcaaaatctttttttttattcaggggtggaggttgtggttagttttcttttgtttaatctttttttgataccaactttaaatacagttttatttaagacattgcattttccacttacaatacaatgtttataaagtgcaatgttatttcctttccttgtgctcatgttccatattcaagtattgagaatgcccagtaatttagtatagcagctcgaccgtaaaactgccatagaatttgatacaaatttgggttcttcggtgttttaactatgtagaagaatgctacatctatagttgggttgtcttaatcaacctcttcagtggtgggccctgaaaagcaccaccagatgcaggagctctaccaccaggaaatccccctggcattcctcctagcatgccttctgcactctagtccagtttggttatcatggacttgaagacttctccagctcttgctgtgcatgttcaaattcttccttctctgcagtctgattcttgtcgagccagttgataatttcatggcacttgctaagaatcttctgtttgtgctcattgttaatcttgacttgaagtttctcatcttcagcagttgctttcatgttgaacacatagggatcaagtgaattcttggatgacaccttgtccctctgcttctcatcttcagctttgtacttctcagtttcctggaccataggctcaatgtcttccttgctcaaatggcccttgtcatcagtgagagtagacattgaggatgcccttggcattaatatcaaaggtgacttcaatctgatgagcaccatggtgtgcaggaggtacgcctgtgagctcaaacttgcgaagtaggtttttatccttggcaatgacatgctaggcttgtcagagtaggtagtgaaggtctgtgtctgcctggtaggaatggtagcatcacacttgatgaggacagccatgactccatcagcagttttaatatcaagggaaagaggagtgacatccaaaaacagaaaatcttgaacattttgagatgtctctagataggacggctgcctggacagctgcatcataagcaacagcttcatgagggttgatgctctcattcagctattttccattgaagatgccttggagaagctactaaatcttggggatacaattaggaccaccaaccaggacaatatcaggaatctgtggtttgtctagtttgacatctcaaatggatttctctatggggtccagaatgccacagaacaggctcagcattcaattctccaaattgggcacaattaatggagatatagaagtggattccttcatgaagagaattgacctcagtactggtttcagtgctggaagagtatgtttagcaagttcacaagcagtatagaggtgccagacagctctcttgttctcacggtgtccttccatgtgtgcactataactcaccagtaaaatggttgacatttcagttgtgaaagtcctctccacctaagtaggtgtctctggctgtagatttcacctcagagattccatcctccatagtgaggatcaaaaacaccacctcccaggtcaaagattagcacatttctttcagctccaacctttttttttttttttttttgtctaaactgtaagcaatagcagcgacaattggcacattgataattccaagtacattgagaccagcaatagttccagcatctttgatagccctgatgctgagagtcattcaagtaagctggcactgtgaccacagcattggtaacagtcttcccaaggtagacttttgcaatttccttcatctttgtcagaaccatagaagacacctcctatgggtagcagctttttgtctctctcatactctacttggaccttgggcctgccagcatcatttaccaccgtgaaaggccaatatgtcatatcaaactggacaatggcatcatcaaatctgcatccagtcagacatttggcatcaaaagccatgctggcacggttcattggaacttgattatttggagtatcactaatcaattgtttggtatccgtaaaggtgacatagtttggcatggttcggtttccctgatcattggcaattatctctacttttccttgctggaaaacacccatataatagtaggtggtgccaagatcaataccaattgcaggtcacttagacacagatgtttgtgtgcatggtcagctcagatttcaaagtgagacacagaaccccaaaagctgctgctgtgttcaatgagacccttgtttaatattccttttatgttgggaaaacaaacattaagccgcataaaacatcaaaaacactaagctaacctccttcttcctgtcttccatggttttacttctgaatataatatgtccttttagtgagaaaataaagtaaaataaaatatcctataaatcttggttaacaaaacttgactaagaatattctgtaaaactttattaagaaaaaaatattttcaactaccaccaatgtaaaataatgaaatatctctccctctgcaagatttcaaatctttgtctaacaaaaagccccatatgtacaactcacattggttttcactggagaaaatcaatggcaaatgctaaaaatttcctctctttgctgtagggcctttattgttccccctttttgctataagataaaacctccaaacttgagatatacgtgtagatgtgtctgacagtcatttatttcccactaaatcattagactttctaacattgtaagagtcattgaaaaattataaagttcttttgattctgggtccactgaaaaattcgtcttacaaatgcactaccctgaaccagctctgggccctggcataccgttcggttgtagaaagatcttttttactctaacatatcaaggcatcactgccatgcctgagcttggtttctgattttgctttacagaagtaaatcttggagaagatagatcataggataataatacataatatcaacaattgggtttccatagtggacttgaagtatgtaatgtgttcttcaactagaactggaatattgcttagaaattccaatttttaccttgcttaatcttctcaacagcaggggtttgaggtaaccatggattccacaagttcaaaactttttagctaccctgttttctctttctgccccacctaaactattttacttgagctttagcatgattctaaatacactcttttcctaaggagctgatggttctcagaatatatgtatttcttaacctcatacattagattttaattgtaaactatgctgatcccattaagtaagagttttaaaagacatgttttatagttgactttcaaacataggtgtaactgaccaaagaaaaaaatgtaattcaaaaataatatccagaactttctattaatttgtctagtgttagactatgatagtcttaccaaaggagactgaaaactacagagtatgatgcaggaattctctcataatgtctcacactatcttcccatttgtgtacctgaggaatgtagctaacatcttattgctattgtttgtttcatttaagcaagtctttcctaattaattcaaaatctgtggaaaacttttggggatatctcattataggcatcagtggctcactcatgtctctctatcatattgaattcacagttttattttctctttaatatttgctcactccatcaccttccacttattggataacaattactttatcatctctctaaattactgaggatatctctagttctgttcattcattcctggtgttggttctagaagggagaagcagaggcaggactagactctggatatcctgagtccagattcctaaaacagattacactaaaggacacgtatcacaaaatatcactatcatttccctttaactgtgtgtaggccatgtttccctaaaatggagatagtcaaggggcttccaaaaggaattaaccttcccaactggctttcagctttattttccagagggcaaacaatttgcttttaaaatgaagttcttcaaatcccaggctatttactatgttcaatagtgttttgctttttctggcatagaaattcctttaagagaaagggaaccttaaagaaaaggagagggagagggaaggagagaaattacctctgtatgtttgccccggcctctttgtctctgatatttaatacagggtctttccttgcctttatctgttgtaggttgactcttcgatgaataagcaggggtataagacggcaactgttacatttgcatttttactctataaataaaactcaggcttctgaaaatgaaagcctagttcagtctttcttttgccatgtcttccctcacattagtcattcctctgacttgtttcaaaggaaactgcaacctgtagagaatagcctgaagctgcggggagaaaaaacctttgacagctgtctggggctttgccaaggggaaaagttctctctttggataaaaaccatttttctcctcttatccattgcttcccattccactactaaaggccctagacaaacacgcagacttgccaagcataacatgatcacacctagccagctatggcagccagccatgggagataggccctgaaccagggctggttgctgttgggtttccactttcatctcagggtgtgtctaggcaggttctattttctcttcttcttttgtgctggtattaatatttccagcacaagagaagaatactgtctttgagtattttacaacagcgggtagagacacagataagtttcctgatttatttcctactctcctaggagctaatctggcaaattaagaaaactggaggcagaaataaatgtccccgtatggtatgttcaggtgggctgtgttaatacctagaaattaaaagtacatacatacggagaaaaacccactagatttctaatacctgagatgtatagctgccataggagaattttctagaatttgttaaaggaaaataactgaatatgaatgaccatccgctttagatgtatcatttccctacactttctcttttcttttacgaaatttttctttcctactttactcttacctacatacattgcttggcatctcattatttttagatctgtgtgcagcacagctatatgatatcaacgcaaaaattccactggtttgaatgtactgaaataacaatatttgattcaaactgtactatcctaaacctcagagagtaactctaccaaatcattttcatttgtgcaagcatagtggagacgcagacctgagatatcatgcatagcaattgagaggataaagatcttgtccaaacactggcaacatgccatgaggaaaagctgccataagaaaaaatatatattttcaaagatcattttatagtcaatagaaaccaggttttccttcctttttttccgccttagattttattacacttaaaccatttttgtcggagcaatgaggaaaattcatatttattttttctaagtgttcatattttcattcagctatactttcttgcattaaaatttctaattatttaacaatttgatatcaaaaactacggcttgaatgtcatgatattatttctttgaaaactttggctactgcacaactacagctgcaaagtcaaaagtgattttttcttaagttggagggctttttaaaaactgtgtgcaggcaaaatcttgctctgggtttgattttaatgatacaccaaccagattgaaccataggcattataagcctactatgaattgtctttgactgagcctcaaacatgcagcctataattggacaagagctttgtatcatttgagctccatatccattttgagtccctgcttaatctatttaatgcaaggttcttccattattgagttgacggattccgcttggctgaaggttaagtgctggaaataatgactgaacgtgcagacttagatctttagaccaacatccagttaagaatatgttaagtaaatgcaaagtggataatattctaggacgtttctaatctctctggtacagacctgggacaaataactaaatatccagaaagtatcagtttcttaataccagacattgaaaatttttgttaaagataaagatattcttaaattatttatagaaaaacattaacagacttttagtacaacctctttgatatttcttctaattcataataagccattatgattttattggtataaaatttggggtcaaagtcaaatattgggactagttctagtatcttcagctccctaagaatgaccctcttgaatattttgagaagtacattatgtttttggagccttgtcatgattctaattagtgccaagtttaaatggttcagttccatggagactgtttccaacttctctaaaaactgaaacaaagaaaagcaccattaaaaaaatctgtccttactgtcaatcattttattctctatgactgcatcaattgactaaagttttcctctccaaaagaatgcattagtccattgagaattcaaatgtgataaaagaatcgttctatacgaggtaccttcctaaattgcaatatgtttaaacataaaatagatttaggatgtgggagaggtgatattttctggaaaaaaaaagtctaattataaggtgttttttcccctttatttttggataaaggcacataaaattcatttgatttgaaccattttgaactttttactcttaccaccagggggcaggtcatgctaactattgatttagtggatgctgaaaggcacataaggcaattttagaaagaagtataaaattccctaacagtttctttgcagactctttaggagaagagctgttgaattgttcaaagtgtaattttcacactaatcataaaagaaactacataattacaatttcaaactattaaatactttgaaattaatttttgtgaactgtttgttccttttttattttttaattaaacatggtttcatttgaactgaaattataaattactcaaaggaaattgaaaataatggctttccacgtgttctcatgtttatagatcagtttcttaacagttatttcaagttagatttcaaatatcttcattagaaacaatcttcagaagaaataatcttcataagaaaagaattcactatggaaacattataaaatgcagaggtaatttagaaaatttttgaaggagaaaactgggtttaaatttattagaggcacgctgcatttatttacaagtacacatgattccatattgactctgttgtccattcatttaatattattgatgataagctatacaaattttattggaaataagtgtgaacttctcaggtgcataaacaatgtctttactttcctccacatttattttcagtgtccaagcaaaacctatgacccactgattaagtccacccgagattttccagatgatgtcatcagtttcataaagcggcactctgtgatgtataagtccgtatacccagttgcaggaggaccaacgttcaagagaatcaatgtggattacagactgacacagatagtggtggatcatgtcattgcagaagatggccagtacgatgtaatgtttcttggaacaggtaagctaaaactagattaggattttttcaaaaggaatttttcattattagacaaagagaagaacaacttcaaaaatatttattggtcaaaataaaaatgagtaattattagataaaaccttgtcagcatttcttaaaattatgtagcttttaattgataatcataaatatctcccaacttcaaatctgagatttcaaaatgtatttgacagcaatgtgtctactctacattacatgctcaatacatatttgttgaatgattttgaactacaattaaacaagtagggcaaagtaatgtttattttcaaactttgcctttccctctctttgcaagtatattcccaaaagattccttcacctgattttgagaatcactgacttagttgacttaagatagattttcagaaacattaaacattactttgtaaagacctttaaatagaaacttcttggagattatctttcttcttgaattttgtgcattaaaatgtatttcctagactcagattttaagcccattgtattttttctttgtctgtcaactcagtaactataaaatgattaaaatgtttttataaaaagaaaaacttaatctcaaaaaaagtaaaagtattagctaataatgtcatgggaattctactggcagtaaagataacatgtatcattaaaacaaaagcactgtattccatatcatattatataacttaatggatcaagcatttcataaagaattaaaaattaagaattttcaacaaacaagactttttattagaatagatatttaagagttcaaaacaattttagaataattttatttttaaaaattatggatcttatagaagttaggtttattaggaagtatgtgtgtgacggaatcagaggacctttgtcattgattgtcaaacctgattattttgaagatggcaattccacaaaccagaaaaataagggatattcccaagacaaaagagatggctgttgaagggtcaaaagtagaattaattagttgctattaattcccacaagtttgacgcttaatttgtactgtccacccaaaactaggtgttcaacagttcactgcaatgaatgtcatttagccactaggtggtaatatctaacctttactgagaaaattatagactgctaagataggtttttaattttgacatttggaaaaatgtacatttaatattctttaaagatcccagagttatttaaaaacaattaaataattcagactattttgtgcgaacaggatcattattatatacgttactatactccaaccccagtgctcagaagtttaaaaatgcctatattatataaattaaagtgggattttttttttctttttctaaactgttcttttaattttctttctgtactaacctgacacttcatttaatttcaatgtaagatgatgtatttaagatacctcttttaaatgtcaatttttggtttgcattatcaaccttgtattaagttgaacttaaataattttaaacaaaccttccatttctcatctattaataaggattctgaagatagaatacatttgaagagtgagctacaatttccctcagatagcttcaatgatttttttgttcatttgacaacattattaaaagaatatatatctgtctttcatggtgaattggatataataactacttaataaatatatattacatggaaggaagagagagaatttgttattttaatatatttttaactttttcagttaaggtccaaaacgtttgctctattaacgtttcaaacaatatttaaattatacatatatatctatatattacttttgttaagaatatactctgaatatgcatcctttaacattctctctataaatgggtgttctactagctaaaagctatattttgggaggacaaaacttaaacattaagcttcagttcatgcatgtttcatttaatctgttttttgaaaggcatttaaagagaagtgaggggaatgatttgcaggtttctagggatatgcttaccactaatttttgagatagaaacaatgggatcatgggttatgcattttttcagacattggaactgtcctcaaagttgtcagcatttcaaaggaaaagtggaatatggaagaggtagtgctggaggagttgcagatattcaaggtaagactcagtccagagtgccaggagaaaagatgttgaaactgagtagcgcttgttatagggcacccttgttttaatacatcatcaggttacctgaagaagcctttgaaattagctttcttagttttcttttcccaaagcagtggaaaaagttttataagcgactaggaatgggactcaccttcctctgtagaataccgctgaattcagggctcccgggattgcctctcattactgcattctctaagcatatagtcagacaaattgccacattaaatgaaagcctggggtctcttttactatccagatgcttttctactttataaattttacttttcaatttttccccaattgaatttgagaaaaatagaccagtgtataaatcatgtgtccctgcttttctgtaaggaaattaaaaaaatatataggttgcatcatagtaagtcttcatgtatgctaaactcctctcacccggcaaaaagagttagtagatctagaagaatagttctccagatttggagaatgtctttgacttttaacaataactctcaattgtggcatgctttgtaaatcctcagtaaaattaagtttacaattatttgctgattgtaacatttgaaatactttttttctcagaaaaacttttttaaaaatatgctttgtttattataacatttttattgagacagtttattaaaatggattgtttccatgtaaataatgctttaaaagagaataaagccttcctctgtgaggggctcaagttaattaacatgctgagttccacaggatcctgtttatgttgtgatgataatagtggtcaaggagttaacaagaacaagacctgctatctggtgtctaccaaaacaaaatcttgggtggttcctaggggaaggccagatgtcaaacataagtgtgaacccagaggccaaaaatacagtgcctataacacacataagcacattagaacaagtctcgttcaatggtgttagacagtggtcaagaagaattacttggattctgctgttaaaattacataaatgaccagcttttgttttcttttcttattgtaaaatcagctttattgaggtataattgagatacaaacaaaaaactgaacatattgtatgtatataatttgataagtttggccatgtttttaaaattgataacaaaaatgctatttgatagaactttctcactgaaattttttttcatatatttctttaaatctttaacatctaatactgcttgtcaattagcaaatatgagctggtgctaaatgaataaatagtagatagatgataggtagatggaaaattttttaagccatcttgtcctttttagtttgttagcttttgtgttcatgtttctgattttatcttgcatgcattgagccatatttttttacaaacaaaactagccttagttcatattgtgaaatcatgtgcaccagtattgtgtagtgttccgtaaagaatatgatcatccacaaggagcactataacttctcaaaactctgctacttaaacaactttttgaaccactgatctaagtaagagcagaaagaggtaataaataattatggagatgttcttgtcaacactagtttgacttatatggaagcagttaagataagcagatttagaagaagaacacttgtgagtaactgggaacaattttcaatgcagagtattttcttatacatttaagtcacttatctttaataagatactacaaaataactttttatcatttctgttaaggtacaatcactacattttggaagaaaatagcaaacaataagaactttatttccttatgtaacagagacttgatgtttacttcagtgatatatggcatcagataaaacaacatattgtttaatataaaaacctgttaatgattatctttattgacatttaacttctattttcagcactcatcaatcatcttgaacatggaattgtctctgaagcaggtactttttaacttttgtatgaaagttaatcacaaaagcaatgggctgcttgaatcaaactttatttgaaaaaaaatccattgaaattgggagttaaattttaagaaatttaaaacattatttgtttctcttgtaattcattagagaccattgtttcagccttgccttgggagaaattgagccaaattttattaattgaatgatgcattctccccttcctttggatcttaaaaactgaactcactttcctagtctcatgagaatgtcattctatcaagcccattagacattcatgtagaatatcaaccctaaccattacaaagggtttttaatctgggggtctaggagttagaatatgaactgtggtggcagcccaacagccaaccttccacatatcacataatatcgaactctcagaatcaatttcctcaacagtaaagttagaaaaacaatatccacctccagagtttgttgggagtttaaagaggatgcttcatgcaacattctaaacagagagcaggcacataagtgtaaagtaaatggtaactaattataataatagtaataatctttaacattatttcataactctctgatatgatattccaaattacaattgtttcaagagattcaaactgcactattatttctatttgcacccccaagatataagaaagccatatgacatgttcaacatcaaggtgttgctaaaattgacttaatctattactgttcctatggcagagtgatttttttaggaaattatctaaatagttttcttcttcagggctttgtcatttatttgttcattcacttatcatttatttcttgaaggcctaaggtgcttggagggtacatgaatgaatgaataacatagctcgccattaacctccagaagctcacagtatagctgagtgtcaaaggaagacacttacactgcacagtaataatagagtctagaaagacagagacaagaaagtggcctaaagggagccagaaggaacagggaaagataactgaaagaagagacatacagcttgaattatgaaggatgtcatagttaaccagatatattaaaaggagaatggaatggaggagtatatgccaaccagaaggggagaatctttgcaaaagtgtgaagagtgagagactatagcttattgtaataagtttgtgtacaattagagtatggatcatatgtgtgttcaaagggcaggaaggctagaaatgaatctggagaagtaagacagaacaagattaggcacaactttatatatctttatatatcctcctaagaagtttagcagcatatcttaaaaacaatgaaagcccctggatgcttggataatgctcacctgtagtgcagctactcaggagcctagaatgggaggataccttgagcccaggagctcaagtccagtctgggcaacatagtgagaacctggctcaaaaaaaaaaaaaaaagccattgaaaaggaaaacaaacaaacaaaaatacatttatgattaagaaggagggtgttataataagattttctttttagaaagattagtctggtgtggcagtgtggaagatagactgggtactggggtagagatgggggttgttggaaaacaaaatcaaagccagcagaaataggacacttacaagtaatccaggaaagaagtgataaggactgaaacaaagttagtggctgtagcaagggaggggaggaaatagattagaaaattctgtatgagagaatggaaatgaagtgatgacagactgaatgtgagagaaagaagattcaaagacaactcccagatttctgtcttggatgacttggtggatgagagtgctactctccaaggtagggcaggaggagtagatttagggggggttattacatttatacttatattgttttcaagatatatctaagtcttttgtacaatataaaaggtaaataaataaagcaaaaagacggaaacccaacatttaatgcaaaaaaaaaaaaaaaaggaatcacaaaggagacaaatgtcttaatccgaaatgaagagggagaatagaaagcagagaaagtttcaaggaacatatagtcattagtgtcaaacagtatagagaatttcagtaaaacaaatactaaacagtgttcattgcatttaacaactaggaagtcttaactgacagtttaatgggtgctaaaggtgtaagacccatttctgtaagttgagtactatgttattatgccaatacctatttctaacatagatatcccccctctaactcttgaaatggtccactagagtggaccatgagttctttgaaggcacagattgtggcttattcacttgtatcacccctccccctccaccgctactaccacagatactcaaaagaatgtataagggaagtaatgcattactttcaggacttatattgaaaatgtgattttgtttgctgggtttttcagtatcatgcagcctttcatttgtgatatagcatccctcaagcctgtttaatactttcttcagagtgataacaaatactttctctcccactaataactcacattctttcaaggatcagtactttaataacaaatgaaatggttaattgaaatcaggggaatgctttataaatttattttcagtcgtctcttatataaggagccatgggaagtcttgggaagaccgtgagctttgcctatagcatctgtgctggacataatctctcaaagtacattttctagtattgagaaagaatttgacatcttaattcctgtctagcagctggtttttgaccttctgaaattactgccaagcttgtagaatgctgtccatttcagcatcaaaatcttcaaactaccatctaaccaggatagaaatgattgacttattttactcctcattatgtttctgtacaagtgtttacaatgggcaggacacccagagaaacagatttatatgtattatgtgatattcaagaaaaggaaattcttaagactagtctgaaagatgcttctaattcatttgttttgcccgatttgcagcaacaattgtacattggttcccgagatggattggttcagctctccttgcacagatgcgacacttatgggaaagcttgcgcagactgttgtcttgccagagacccctactgtgcctgggatggaaatgcatgctctcgatatgctcctacttctaaaaggtaagaggcacatggagttaatataaaggcttcctttctacaagctgaatatctcacattaatgctttgtcttatagtttaagttaaagagaaaatatattactaacatgtcctatggaaggaatattaaaatcaaaatgttgttttatatttttacataaaacttaattttgaaggagggtaaaacagatgctctgaaattctgaaatatggaacttcaaacaattttaataaattctatatattcttttctttcatttatgtcaagcactattaaaggtttgtttttattcactattttgccttttttataattgttccttccttatttcttatttctaaatatgtatatactgatgcccactgttttgcaaataatatataaatatatatgattgtacaagcacagattgtatgaaacccacagtgcagcctagtgacttggtataattttatttttactctaataattataacttggtcaatttctgccactcatataattaaacaacaaacggtttccttgctgtttgtagttcattgctttatgtgctcttagaaataatgctattttgagccaacaattccaagctaggaatttgttctatatacacatgtgcaaaagtacaacaaagttatatgttcaagaatgtttatttcagcattatttttatagcaaaataactggaaacaatatgaatgcccatcgatatgcctgatgctagctaaatatactatgttaattattttaaaatgttgattatagtaacattattttctaaagtattcgaagtatattttcctctaggtgaaatgtaagcaaatttatttttaggtctgtttttaaactaacaggcacatgctagtctcattaccacaagtacacttttttctttttggaattttattgatttctcaaattctaaattctaggaaattacaaattgaatgtatagttcaacagcaaatattacttaaaattagaaaacattttatattccctgaaatccatgaattaaattgaaatgggtacatatgattattagaaattaaaagttaaaagtcacccacattttgttatggtttttggccaagaacttgctcattatagtctttggggaatgctttcctagaagctgaaaaacaagaatgctcattagttggtaataaaccttcagtttgatgaattgaccctgttccttaagaagctaagatttaaaaacattcttgacctatgtaccttataccatcataattttttcttcttgtatttcccaagactgtatctctgatctttcagacatgccactgtgatgttttcccttacctaacataatgtcatgtgagccaaaagatgtgtataatggatgaatcttgtcatctgttgtcatctgttcagcattaccctcaaggaacactatagatatcacagaacatttactggtacttttctgatctctgaagtgacaaaataaaatagccaaagcaaatgaaagtatgctgtaagagtgtaagacctgcttagatgtagcagggattttttttaataaaataattactcctttcttttaaggaaaatatgtgatgtgatacaaaagccattgtttattattattattatgatcataactatgagaaaaacaatttgagctactcatcagcagatagaaataacaggtagtcttttataccacactgaatttataattctatttcaagttacagtatttagtttgttgcttaattaaatctatgcaataatgaatctttacatgacaaggtgttttgtatttgtgtatatgttcctagccactgactgaacgcttttatatattattatttctcaatgactgactaaaaagagagttcctaaagagagtagctatcctcattttaattatataaaacctaggttgtatttttatttaaccttttttgttgaataatttgtgaaaaaaatagagaaaaagaagcgtagttaaataaaattcatgtcatctcattgtctgaaaaggatttcttctatttggacctcattaccagtagttttttaaatcaatgttagattgattggaatattgacttgcatttaagttgaactgtaagacaagcatagtactgcatctgccactgttattagtattagatgtagcctttctatatgatggtaatcatgcttgaagttctaataagtttaatcccctttccgcaggagagctagacgccaagatgtaaaatatggcgacccaatcacccagtgctgggacatcgaagacagtaagtacagctctgatatgctttttctcccatttaaaatgctaagcccactctttgtatctttttattatatgacttaaaccatctattatataagaatatctccattttgtgtaatgcatgtgttctggaagagcaacaggaaattttataaatcaacccctgtctacgtgcctaattgaataatcctttgttatatcattatttgtttcatatgtcttttaaaattcctaaactgtagcttttgtttcttttttactaccttatccatccttataaagtttgaaaactgctattagagataaaacaggatataacagaaaacatttggacatttagagtaaactcaaatagacctcccagaagtctggtaaaagtgtaggtcttattagaaaaaagtttttaggtagtctatactttatttatattcacctatcaaatcatatattcacttaatcaataaatatttattaagcgacttccatgtgcatgtaattgtcctgggtatactatgtgactaagaaactccttagagagcttatgaatcttttgggaagtgtcataaggcataattagtgataggggagtttagtgaaagagagatcaccaaaaggctgtattgtttagaaaaattaatcacagaatagaagatcttgaaagaaggagaaggccagtgtgggggaaaagagaggaggcctggtgagtgagtctgagaacagagaaaacaaatctataaaagtatgtattccagagctgcagctactttacactctcaagctctgccttaagatcgaaaatatatgcacacacacacaccaaacacacacacatgcacacacacacgaacaggtggaagaagaacacatttatcacaatgttactaaacaccctaccagtgatgtaaataacccaaatttcataatctataactggtggtctggtagtgtttgcttgatttaaaaacaaaacagttatttttaacttataacttaattcttctgaaaaataagccttggtccagattagtgtgcttggcttcttgttctaatgtgtaggtgattcattgtgatgtccgttattttagttagcaatcattactgtgcgatacatatgcaattatctacatatgaatatgaaatttatcggggatgattataggtattgaggatacagcaatgaacaacaaagaaaacaacaaaagaatctgtgcattcacgatatttatattcaagagtgtgttgggggagagagcagacaataaataccaaaacaagtaaaataaatgctatgtcaaatgataaattttacaaagaaactgatacaaaacgtagttgctgccttaggcacccacaatttttgtcttcactttaccataccctattcatgctataacccactgcacacagtcttttctaataatcatcatcatcagtctatccaatctattcttgtcaaggtcaccggcaatttcctccttgccaaatccaacggccaattttcggttctcatttttacttaagctctaactccctcttttttgaaacactttcttttgccttccatgcatttgtgtgctagagccagttcatgtggcctcatataagttgattgcttaaaattttgaaattttgtgagctgattttaaaccactgaaagcttgaatcagacatggtgggagtatttacaacagcaaaatcagcaagcgctacaaattacgttatttgttgttttgttttgttttcagagaaatgatattccagcatacctatgtgcccttgtaccatatccttctggttaacctcttacctttcagactgccttctgagtgttcttaactttccttttcatctcaccttttaaatattggagtgtccccagccacttttccattctctgtctactgactccctaatactgtctatttcaacactatcagaggctatttcactcccaaattcatagtccaattctgaactcacccttacgtaccagacacagacacttgtatgcctactaaagagctccacttgaaagcctaattagcatttcaaacttatgtctgagaaagaattcttattatcttcttcaagacttatttgttcagcagactttcctatattaataaattgcacacaattcacccagctacttatgtcaaaaagcagctaggagtcacttttatattattttctttctttcccatcctatcaccaacctctcagttagtccttctggctcatggccaagctttcctacttctcatcatacccacagatgccagcctaactgaggccacagtagctcttcagtagctacttcactggtctctctgcctccacacttgaaccacttctgtctgtaccccacttagttgtataccccacttactagccagagtcatctttttaaaaacttcagtcagggcatgtcactcccttactcaacatttttcaatagcttcttagaacaattggtgaaaaaccggaaagctttcctatggcatgtaagatgcttcttgacctgatcgctagtatattctctgaccctctctcacatcactgttgctagattcacttagtagctttctctttttcaaaagcatcaatgggttgctgccttatgtatgtttgcattcattgtcctctgtacctgaggaacttgtttttcagatgtttacttagctccatctttttatatcaattaatcttatagttaaatgttaattcttcagagacacctttcctgatcatctcatctaaaatacattttttttttgcccttggtattttctcatctcctttattgttttgcagcagatattccttttttattcatttacttgattactttgtctatgtcactagaatgtaaatttctagagggcagtgaatttcatattcgtcctgtcatattatcctagcacctaaaatgatgttagtgtgttaggcacacaataacagttgtgcaatagacaggtaaatggaaggatattcagatggatagcatttgagctataccttcaggagaaagttagattttataaagtaaatgaagtaacaataattaaaatcagaaagacctcacatagattgggtaaagtttgtgaaagggtctatgtgattctattaattttatttcttactttataggtgctaggagctatttcatattgctcagaaaagttgtttttttttttaaataaaagtgattgacacctgtatagaaaattgattggagtatgaaacactagaggcaaataatcaattgtgggagttagagtagagattgtaatgatatttacaaattaaatgacttgtttctaatccaccataaatgtgtgctgcattttattagaaagtcaagtcttgaataatgggcaaagatgtttcttttcttctttattttctttcattattgctttaattgttaaaagctacaaaattgcatgattatcagtgacataaaatcagcaatacatgcagaaaaatagttcaacaacattaaacagatcaatcttgcactttaatgacaagctatatatttattataaagaggtattctaggcattttactataaaaatttttttgactgcaatctagaggaaaaaaaaactccacaattatcttacatgtaataagaagctattttaactatttcaaaacactatggtatataacttttacacatttaaaatttaggtcatgatagaacaaaacaagttgaatattccttatctgaaatgcctgggaccaaaaggtttttggattccgcattttatcagattttggaatatttgcatatacataatgaaatatcttggaataggacccaaatctgaacacaaaatttatttatatttcatatacaccttatacgcatagccttcaggtaattctgtatagtatttttaatattattgtacatgaaacaaagtttgtgtacattgtaccataagaaagtaaaggtgttattttctcagccaccaatgtggacaatctgtggttgcatggcatcaccatcattcctgactctgaatttatatgttaccaataagcaatcattttcttacacttattcacacataaactgtgtgttgtgtccctgccttttgactgcaactatcaagtagaattttccacttgtggtttatgtctgtgctgaaaatgtcttggattttggagcattttggatttcagatttttgaattaaggatgcttaacctttgtgtatgatagtgtgtgtatgtgtgtgtgtatgtgtatataatatgcatacatctatgtacgtttaaaaacttttaaagtggaaaacttaaaattcaaaagtgaaacaaacattattggaagtaacaataaattcattttcattttcagtgaaactgatgcagagatgtcagacattatttctattaatttgaaaaaagagttcagataatgagctcactattacttttccagttgatttcaccaatttatcttttactaaattgaccaattctttggttaagtcagtctaattgcatttctcctgaacccttgccccatatcccaacaatcaacctacatcgtcccctactttgttgacaaaatccctttctcaggaaaattgtatctgttattataagatggtgcatgtctttcttttccatgactggcaccagtgatctttctgtgcattaggaatttattaactgtaaaaatcacagctataatctgttgaattggtggagatagttgatagactacaggttttaaatggaatccacacattttgaaggttagatgaggttaattcataatggtgtcagcatgcttgacttaatccttgctgataaaacacaaataaattcaaaattagtttcttgaaaagaagcctaactaatatatgtgcaattatgccatttgctgctcatttgtatgcttaggtttaggattcacttggtcccttaaaccttactctagttgatgtctatagtgctaagtaagccaatctgtaaaattgagatatctgaatatatgatgaaatagtgcatatttgggccaagctgagcagctgtcattttttatttgatcaaatttgagctagagctcttagatcacacaagggacacagcctttggctactctagatggaatgtatttcagatggtgcattgatttatgagaataaggtgtctgagacactgttcctttaagcatcctagtaactatctcatagcaaatgtatattgggtttaaaaaatccctcagtataaaaaagaaaaaaaatggtagattaatacagataaggcccagatattgagtattagtgcatctggctcatcatcatcatcatagaattttgtcaggtgcagatcactataacttacttttctgatatcaaaattttctgttatctgatcagctctgtggaccaattcatgatagaaattatctttaaattaaagcaaactgcccctccagaactatctacaaaattgtttatattttatattaacaaaaaagtattaaagcactaaaagatgcaaaagatttattcagctcaaagaaaaaaatctcaatatatagagtttgatattatgaacactattttttaaaatcaagtgcaaatagctaatatattgatgaaagaataaaaattacaatacagggatcaaattttaaaaatcaatctgttgtgtaatatttgtctcaggtaacaatattataacatgaatttcctttctctttaataatgtatatgattctttccccatggcatctgttctgaatcagtctgttttcccattgcttttaaaatcaggtcaaggttaatctcttattccatgtttgctttccaggcattagtcatgaaactgctgatgaaaaggtgatttttggcattgaatttaactcaacctttctggaatgtatacctaaatcccaacaagcaactattaaatggtatatccagaggtcaggggatgagcatcgagaggaggtaagctgttgtcatcaaagaatactcactttgagggaaatagtgtacgattgagagatgttcaacttttaattctgtatgctactctcatcattatttgattaaaaaaaataacaggttttactcactaacaccaaaggtaacaatagctttgagataagaataggccaacttcacacaaatgtattcgtaaaatatatttgaaagcagactgatttttttaaagaaatttacattttttttccaaattccatatttcatagattgcctatatttaggaacaaatccctgactaataacaagaacaccgtatttttcttcccacagtagcacagtgactacattttagttcacattgtgtttaatttagatcatgaaatgaaacattttgagggttatattaaaacagaaatatctatgtttatcaaattatatgagcaaattagataagtatccagacatgttaaactaaggacactataatgaataatggaatgaacacaggattcagaactgcatatcttgagttgaaacatggtccttaaacctttggtaatgttcctgagcccccaattttctaagtgaacaaaataaattcaaaagttactataaaattaagtgcaaaatgcatatgagaatgtagaatttcaaaaaagaggctcttacaactgtaaaatatgcatataaaattacagataccctattagtgagggtattttacatgtggatcaggaaagggtactaatcatgtgtttggaaaatactggttctacctttggcttgactcctgagaattcatgagcagatcataacttctctagaactgagtttctctcttatgtaaataaatcaaatttctctaaaatatcagccttattgaaaagtctataaacatttaaaatagtacatgtaattaagtcaaacattagtacataacagtggatctcaacctccagtaattttgtttccagagtgccaatattgggcgatgtctggagacatttttgaacatcacagctgggtgggtgggtggccaagtgggtgcccctggtgtgtactgggtagaggtcagagatgattctaaaaatcctacaatgcacagtccctcacagtaaaagaaaaatctcactccaaacgtgaatgctgctgagaggttaagaaaccttcaagtaaaaaaatcaaattttatcataagaaattaatttaaagatatagctctactgttacatgaagaatttaatataattctcttcatctgacagctacaagaataactttttctaaatgttaactctttacatacttaatacaaaaataaaggaataatttcatgctttgttaagtcaaatttcgccaataaaactagattcgtcatcattcctgacttctataagtcctaagattatggcagattcatagttacactgaatatttattttaagggtcccattttttacctatatattgaaatattatttgatacagaaatgattatttaatttcaaaatataaggcatttatttactatccaagaaatattgaaagaatgatactgaaattttttaacttgcagattttttgttacattgcaatgttttaatcttaagtgtcacaaaccaatattttgaatttcatagcgaataaagttggataattgcttttcagttaaatataattctttaataaatggcttttttcttcatgggaaatttaatctgatttttaaaaatatgtggtcctctgcttgagttcagctctcagctctagatacttacatttgcctgtggttgtttgcactcacatctttcattttcttgaaaattctgtgcattactttaatttaccttttaaaagtatattatatattcataatggtaccatgctccatgaatttcaatggagcagaaatacttatcgaattttacttaaaagaagtatctttgctgtaatatttcaactggtattttcatttatctttgtaaatagagagtttcacattgtccagggtatgcaatactgcttcctgagctgaggaaaagggcaatatccagattatacttgaagcatttttcccagcaggatgccttctgcttcttacccataaggtcacagtttggaatctttcctccactcaaaaacagcctgcgggagggaccatgatctcctgtggcacagaggctgtcaccaggttattctctgccaggaggagaacatttccttactgagctgtttcacagttgggtgctgtacgggaggtcatgagtcagttatctgctgactttcttataaaactgttcttaaaattgatgatgtttatgctataactagcaagtcaattggcagtccccaggcttctgttgaacttttgggatctgaataagtaaacaaggccatactatattttctctgtgcattttaataacattttaaaaaatcttcaaatacttgcattattccacttgtaagccttattttatttttgttctttttattctaaaagcaatataaatgattttaaaattacagtaacacataaaagaactatgaggccactaagtgtagataagcataaataatattttgatgtctattccagcttttttttcactcaccattgcactgtgagcattttccattatcatttaatgtcacttccatgttttttctgtctcccacgcatcctaccctgatgccgtagttatccataggtattccaggtgttctctcactagatcatgttcctgcttaaaataataataatgaactttgttatatctgagtctttctctgctttctaactattttcttaggaaaaaaatcttagaagtaaaataaataagttaaagacatttgttatctttatggattttgataaacaacagcgtattgctaatttcacataaaaatcactgtattagtgtctgttatgaatccctgaggcaaaattatggttcacaatttaagaaaatctttatcagtttaatatgaaaaaatgtattgcattaatatctacttctttgaatattagtgaatgtgaacttaccttcttatgtgtcttggttgttggcttcggttgtatttggtgaattgtcttgtctgtcattgcttactttatattggcatgtttatttaataataattgtaatgtcatttatatattacagatattaataatttaatgttatacatatacatttattttattttacatttattttgtttctgacaatttctgactttctgacacattttatgttttatataggcaaatctgttgatttatggctctgtgatatctcacctgttatgcttaaagactccttccccaatgagacagcaattatatatttttctagttattttatgatttttttacattttgcatattgtatttacatgtacccaaagatagtaaattaatctagtagttatttaggtatgtgtatatttgattttttctttttaataacgagctcattgctccagcatcccctttagtaagttttcccttttctaatgtttacttaaaatattaattgtcggttttgtggtataatagatggatgatatacagtgtcatgtaagtaaactctgataaatttaaaaacatgtatacaaatgattccattccagttcattttcctttcttccaaattaaataagaaaacttttcagtctatttcttaaatacagaaaaatttttgcaacagttttgcagacatttgttttctcacacaaggagctttctttattttttaatcctaatttccctctagtaatattttgtgtttgttagagaaaggggatatttttgaagccctgatctcttccaaggcacgtgcagtggttttactatgaaagaactgacaggtgaattatctgtaaaagaactactattaggctgctattataagagataaagtccctgacctttacctgctgcttaatacttaaatgtcctttgtcccttccatgttactcttctcatgttagatgaattgcccttcactgaagatctacatttaataatgccagttatattatccttgttcacattaggcaaatggatagttgaccccagctcaaacgtggttttaatttgtaaagttgagcagtttttacttatcacttctagagtggagaaaattccaagagtttaaatcaatggccagagattacattatctctttgttgaggagctgaattttctaaattgactgtgctgacatttcactgttgagatacagtctgcataatgcatcctatttcagcaaagaatgaaagcattacagagaaagagactggaaagtaggcaaatgttaatcaactacttagtttctgggtcacagatttttatctctaaattgcaaaaattctctgtaaatatatctattcaaaatgtcttttattagagctgccagtttactgaaagcatattattgaaattttagcaagaaaaataatagttaaatgatctaacagacattagttagacctagaaagctgaaaatttattaaatcaagtatgatatctgtaggtcaaaaaccacagaacaaatccagcactccacggaagaaaagaaagttgaaagatcatgaccgtgtaatggaatgccaggtgtttatggaatcctgagtcctgtggggacagaactagaggggaaaggatggaagggaaccagacctcaaagtacaacaacataaacaggatacaaaaagataatagcaaaagtaatgatgaagtgttacacaatatgggtgagatcaagtcataatttcttcctgtcagaagattaaagagaacaataaaaagtcctagtcagagctgtgataatctctaaaagccacattaaatgtaatttaaacataagcaagagtaccagttatgtaaaggaaatctagagatgaactagaagtggagatatccactttgattgtcatgctaataacctcaggccattttctattaagagaattacagtaataaaggcttcaaaatattacctctcaagcagcatggcagtagtatgtaatgttgctaataatacttcacattttaaccttcaaagagctttgcttttaatcccccaaacacaccatatgctgtgccaccaacttgatagatgggagaccaatgggggaagaaaaatgagtcatcataggaaacagagtagagaccagaaggttaggttatgaagctagcattttgagacctaaagtgtattaaattttaaaaaattacaatgaaattatctaagggaaaaaaacaattatacgtagtgtattaaatttgagattgtcagttatgtttaagattggccatttagaactctcccaattcaaattcacatttattttaggcatgagacttctatggtttctgagaatgtaaattaattcaaagttagtttgtattacaatagcatttctaaatgtctgggctttaagaataaatccataagaaaaagaataccacatccagcttaccaaataggcaacataagagaaacaaacaaacaaaactctgatggtgtggattcagtgcagagcaaaggcaggcctggagaccattcagcctcattaaccagggatctgagctgtgacctgcctttggcctcaaatggttccccgccagctgcacttctctggcacagagggtggcttgccatatacttgttagttaactgggctggtagccagagatgtttcttttccttttctcatatttccagaattggggagattttttcctacatatttttcacataaagatgcagagtacaatccacccactgtgaataaatttaatttagccatctttatgcctccttgatttccatcatctaaaagtctacaatacaggggcagatgtgtaaactgggaaatcttccagaacttctttgttgctgttgttgttgttattccacttaatgctgaaccactcaacaatactccacattaagcagggctcttttgtgggtaaacatgcctctagttttactgaagataggttcattattcacaccatatcatgagccagtcaagcttaatgttagaattgtcttttagtaataatgcttcaaaggctggagagcatcacatttcagtagaagttctttgtgttcattgtgctttctcacacttgaaatcacattaccatgtcatagcatacaaaggcatggcaaatatttccacaaatgacagtataaagtatcacatatatatacagtatgaaaattcaatccacagcaaagagagaaattcagctttcaatgttgctaatcttctgactagggtcctactcaattacagctctaacgtccaaaagactatacccgtacctttggctttgactttaaagacgtcatcatttatggctttcatatgctactcacagaacgtatttggtgatatctggaaagcagtaaattccacttggaattattgttctattctacattataggtagtagcatgtactgaagctcgttttctatacaatgtgttctatacaattgtaaatgttgcattcttgctccacatttcaggtgctaatttatgatcttgatacagtaatttgtatatgaaatctctgtaaagaaggccacttgatggtttccagtttttcattacttttcacagtttttcattcctatctgcatattgagagaaaaaaaataactgcattccaaaggttcagttagacttactaagattcaaatgtgaaaaattaaggatatagtttgggggctattacttttgttgaatttttttactctttttaactatggctgacaatattatgcttgatgacagagacagagagacaatgaatatgtctttcatattcatctaagtaaaactatgtagcctgttttcatttgctcttagctctctctgtgtttaatttattacctacatttttccaattctgcagttgaagcccgatgaaagaatcatcaaaacggaatatgggctactgattcgaagtttgcagaagaaggattctgggatgtattactgcaaagcccaggagcacactttcatccacaccatagtgaagctgactttgaatgtcattgagaatgaacagatggaaaatacccagagggcagagcatgaggaggggaaggtcaaggatctattggctgagtcacggttgagatacaaagactacatccaaatccttagcagcccaaacttcagcctcgaccagtactgcgaacagatgtggcacagggagaagcggagacagagaaacaaggggggcccaaagtggaagcacatgcaggaaatgaagaagaaacgaaatcgaagacatcacagagacctggatgagctccctagagctgtagccacgtagttttctacttaatttaaagaaaagaattccttacctataaaaacattgccttctgttttgtatatcccttatagtaattcataaatgcttcccatggagttttgctaaggcacaagacaataatctgaataagacaatatgtgatgaatataagaaagggcaaaaaattcatttgaaccagttttccaagaacaaatcttgcacaagcaaagtataagaattatcctaaaaatagggggtttacagttgtaaatgttttatgttttgagttttggaatttattgtcatgtaaatagttgagctaagcaagccccgaatttgatagtgtataaggtgctttattccctcgaatgtccattaagcatggaatttaccatgcagttgtgctatgttcttatgaacagatatatcattcctattgagaaccagctaccttgtggtagggaataagaggtcagacacaaattaagacaactcccattatcaacaggaactttctcagtgagccattcactcctggagaatggtataggaatttggagaggtgcattatttctttctggccactggggttaaatttagtgtactacaacattgatttactgaagggcactaatgtttcccccaggatttctattgactagtcaggagtaacaggttcacagagagaagttggtgcttagttatgtgttttttagagtatatactaagctctacagggacagaatgcttaataaatactttaataagatatgggaaaatattttaataaaacaaggaaaacataatgatgtataatgcatcctgatgggaaggcatgcagatgggatttgttagaagacagaaggaaagacagccataaattctggctttggggaaaactcatatccccatgaaaaggaagaacaatcacaaataaagtgagagtaatgtaatggagctcttttcactagggtataagtagctgccaatttgtaattcatctgttaaaaaaaatctagattataacaaactgctagcaaaatctgaggaaacataaattcttctgaagaatcataggaagagtagacattttatttataaccaatgatatttcagtatatattttctctcttttaaaaaatatttatcatactctgtatattatttctttttactgcctttattctctcctgtatattggattttgtgattatatttgagtgaataggagaaaacaatatataacacacagagaattaagaaaatgacatttctggggagtggggatatatatttgttgaataacagaacgagtgtaaaattttaacaacggaaagggttaaattaactctttgacatcttcactcaaccttttctcattgctgagttaatctgttgtaattgtagtattgtttttgtaatttaacaataaataagcctgctacatgtaaaaagaaccaaactcacaatattaacataaacatctttcatattttgttagtactttcaaatgttttcaatttgactttccctctgaatatgcatggtgtgtttcctgtctgtttaagcagaactcacctttccttcttgtaacacagaacccttagccttcttctgttttgccttttcacgccctttatagtgtgaaatgaaaaattagtcacttcctcacatggaaggcagcttttcagaaaataacagacattgctcgtttctcatgcattctacatatcttgaaagaaaagtctgtgagaaaaccctgtgattagagggcaacttaatgcaagatctgtggctctatgttgagagcattctctctctgttatttttattttatttgcattgcttacctatctcaaagtagtcaaactgatatatgagattgagtactcccttttgatattatactgatgaatatttgtaggtgtttcactataaggaacagctaaggaataattttaataaaagtgaaccagaacaaatcactcatttaaaaagtaattcagaagaacagtgtggcatgatcagacttctaattgaatagcgtaacaacagtgtttgtaattatagatttgcttggacaaaatattccaggaactcatagcgagctcaaagcaattaagtgggaacatttttaatttaaaaaaaatttccaaatatttgtgggtccgacagtaatgatcaaaatatgaatgactttggaaaatttacatgaagctcaagtgttaggattgacttatgaaaataaattttatttctatccaaatttgaatgtccaaaccattttttagttacttctttctaatcctagttattcagacaaaatttggaaacttattttatgaccacatctaatattctggctgctttggatacaatactcttgatttatgataattagttaaaatatattaaaaatattattagtaaaataaaatttcacacaataaaaaacaacatagagtacacatatttatatgtatttttaaagataaagaatatctaaaatgtgtttttttcttagctttttagttgtctagaacatttagagaaagagtatgaatatattaaatccacaaacacactatatacttcctcaccactgactattttatcaaatttgccttaaaataatgaaaaagaaaagtatagttaatggtttcaaatatgctaagaaattgactctgcggaggggatcttaaaatgcctgtttactcatgttttcgtatttttcttgtctctaatacttttgtctttgtctgccttgtgtgttcttttctgaatttcatttcagcaatttatgctgctaaatagaatcccgcatgtctgcattcatttacattcaacttattgtaaattttgagattttatttagaaatgaattgtctaattaatttatgtagagtccttttttccaaagagctcaaaacactacatccacattattgacttttggaaaccaaccaaattacttaagaaatggaaaagtagtcacagagaaatttagtaatttgcaaaagccacaacagtagtggaagaattaaaattcataaagtctcatcattctgttggctaaaataatgctctttacaatatgctggctacaaaatggtcttactcttgaattttgcttttggttcatattttggttcttcatattctagtatgttttgttcctgctgaattttacagactcagctaaacaataagttattagtagtcacttgttttcattatcataattgaatttccaagaacaacttgatatcattcagctgtccaaaaaataataagagcattcattaaatactgattttcttaaacttaaatgttgtatttcatatttatttatataatacaaatggaaatcaaaactgaaatagcctccctttagaatgtcacatttttcttagaaaacattttggaattggttaaccttattgggaatggataatttagaaacaaaccaaaaaaaaaaaaagatatttgaagtgtttttataggagatgtatttttatcatagtaaatgatcacaattttaaataattcatcttacaagtcaggtaaaataaaatcgattcccagattccatacattaggagtgcaaagacaggatcatacacatgacttatacctctcatttaaatattttatagtataaagtatttatggaaagggtttgagatagatgatttttgggaaagggcaaaatgtgtcagatgccctagttaatcatgtaatttaattctggtattgtgagtggttagcaatcaattttgaatttataattctgctattttaaaagaaatgtagtcttgtagtatgaaataattaaaaattgttaaatgtatattttggttgtattataataaaatgcaaacatgactgttctatgattataaaaa

SEQ ID NO: 203 - DNA, 70836 bp, Homo sapiens
  source 1..70836: mol_type = genomic DNA
ggaaagtccaccttccccaacaaggccagcctgggaacatggagtggcagcggccgcagccaatgagagagcaaacgcgcggaaagtttgctcaatgggcgatgtccgagataggctgtcactcaggtggcagcggcagaggccgggctgagacgtggccaggggaacacggctggctgtccaggccgtcggggcggcagtagggtccctagcacgtccttgccttcttgggagctccaagcggcgggagaggcaggcgtcagtggctgcgcctccatgcctgcgcgcggggcgggacgctgatggagcgcgccatcagcccggggctgctggtacgggcgctgctgctgctgctgctgctgctggggctcgcggcaaggacggtggccgcggggcgcgcccgtggcctcccagcgccgacggcggaggcggcgttcggcctcggggcggccgctgctcccacctcagcgacgcgagtaccggcggcgggcgccgtggctgcggccgaggtgactgtggaggacgctgaggcgctgccggcagccgcgggagagcaggagcctcggggtccggaaccagacgatgagacagagttgcgaccgcgcggcaggtgaggggctgccgacccgggggaggcaacttgtttacgcgcgcgagccgcggaggatgcggtgtaggggggcggagatccgggacccgggcgggcgtcttccctcggctgcggagggcagctggcgacctggggacgagcgcggggccacgacgccctcccatcccccggccagcgacctgcctgggctcggctcccgagggcctggtgctggccgacgggtcagagcagcatcctcgcaggtgcgggagaatggaattccagggttgcaaagaaacgccacttcccctctttcattgttttcgggcattgattctcttccaaggaacctttccctctttttccttacgcacatcacctcctgtctgtgctggcgtgacagctgttttgagaaaggactttagcaaaagacgtctgcattttctttcaaacacaactctgtagtgcccccggacaaggattgagatcagtgtctaattgagatctgcggaacacctgcatccgaatcacctggggttgctggtgaaatctacagttttctaggccctaccccagttttactgaatgagacattccctgggtaagagcctggcatctgcgtgtttaacaagcacgccggataattcttgcacgctaaagtttaagagctatagtcagattcttgaatattggttcttgaacctaagagccatggttaggttcttgaataaggggtttactgtataaacatttaatatagggttttctttgagtttctcagcattcaaaaaatgttacttcaaggtgattgttttaaagcacttttcaaagtctagacacaatgtaaggcatgttaacagtaaatttgggggacagccaatcttatcacacccgtggagaaagtgatgtcccattttataaatggagtgctaaagggagcattaagtaaattaaactagggaaggctgggctctggattggaacatattttagacttatagtcattactagatcgtaacaagttagatttaattttaaattaatattagaactttgatctatatatctggagactactataaataggataagtactaaaattctctaggcaccatttgaatatataaacatttgtaaatatatatatataaaacaaagttttcttaggtttgctaatgagtcagttttcctggaagagtgtttttgtttatcataaatttctgaagctcctgctcaaaatgaattacatgaagtagagttgagacgttttctttttcttagaattcaaatccacttcaacaggtacttactggttaacaagagcccaaggatgccctgggtggcagaggttaggcaggtagttcctgccttccaggagagtgtgcagtctaacagtacggatgaaacgagaagacctataacaacattacagactagaaacagtgccagtgtcagggatgtcccaaggtttttgtggtgttctactaggtgaggtatgggagtgagggtaggtaagaagataagagaaggttgtggcagaatgagttggttcctgaaaaatgggtaaaattgtaatggaaagtcactggacttgaggaaacagcaagaggcacagaggccggagattatgtttggaaaacattttgtctctgtgtatgtctgtgtgtgtgtgtgtgtgtgtgtgtgtgtgtgtgtgtgtgtgtacgtaagcgatatagacatgcacatatgtatgctaggcagggagaagtagatgaggatagaaaaaataggttagagccgactgtatatgcatatagtctgatgctaatagcatcattgtcacttgggagtatgttaaaactccggagtggggcaccaccccacactccctgaatgagagtatctgcattttaacaagatcaccgtgtgattcacatgcacgttaaagtttgagaaatgttgggtagagtatcctgagtgccaggcttgatcaaaattacacctaaggaatgtttctctagcaatagtgtgtactgaaaacttgagttaagaataccaaaaggagagtgttatagcagttcagatgagaggtttagtgtaaagtggtataggacagaggggacagagttgagatatttgatgcaaaatctaggttcctggcaagtgaatgcattcttcctttcttggtacccttgtccagagattgagactgcgtggccagaagttgacaaaagaggtttaagggagcagggaagaaaaggtaaggggtttggtgttggacatgtgactcggaggtgcaggcaggacatccagagggaggtaggcgggtggaaatgagtgactagagccagtgagaaggcagcataaatatgaataggtgaagctgtgggaaagggaaagctcatgagaaaacctcaggaaatgccttttattttagggaggaagatgagccagcaaaggagacagaaatacagctggctaggttggaggtacaggaggaggactgggaagaaagatttggcgatgagcacacttaaagagtttaaatgaagcagcagagacaatactcaaattgcaagaggttaaagattcaggcccttctgccccaatccctcctttcctcactgatgaggtaatttttaggagaaggaacctccgaacttacttatgtactgaaaagagggagcctgtgtagatagaatgaaaatgaaaggggctgggcgcattggctcagcctgttatcccagcactttgggaggccaaggcgggtggatcacctgaggtcaggagtttgagaccggcctggccaacatgatgaaaccccatctctactaaaaatacaaaaaattagccaggcatggtggcgggtgcctgtaatccgagctactcgggaggctgaggcaggagaatcacttgaacctgggaggcggaggttgcagtgagctgagatcgtgacactgcactccagcctgggcaacaagagcgaaactccgtctcaaaaaaaaaaagaaaaggaaaatgaaaggaacaggtgatgaggtgaaggtagttagagaagatccacttagcaaacaggaggatcatttctttctcataaattgcagtgaaaacaggaattttggcttgaagagcatacatgatcaccaaacagaattgcctaggaagagatagagcccagttttggggtctgccttgtagtgtggacttaagatagtgtggaatgtttgagaaaccttgaataagttgatagtcaacaggagataaatacgcagtttataaaagttttttctaaatgctcttaaaaaaagataaaaacccagagaatattaattagttcagtaataatagaccggtaattctgtttgtttcaaggagtattaggggaacagatttgaattaaccaagcgtttactatgaacagctgtgaagaactgcagtactggcaaaacttttaaaaaggaggaggtgtggaattatctttatttttgcatgttgtcttttgatactcaagaagcaatccgagattcaccagttcattgatacttttctcttgatggaattttcaagtttcattctaagtgcttactctgcatatcaagcatgtgaatgagtgaataagctatttattttctttaaaagttagctaaaataaacttgtttttctggtaccaatctcgttgtccatgttcttctgctaaacattacattagttgatatttaagtgggatggtcattgcagaaagttgggaagaaagtctcatcacctcactgttagattttacatatgtttatgtaattttgtgaattaccagtcttctgacttcaacacaaatagcaaattgcaaagtgttacttggggttcttgggatgggttgggaagacattctgacaatctcagaagttctaaagaactagttttatcttaactatcactaatttgcaaagtacatgttcctttttcctctggctctaattcctctctaacaaaagtatttctaaatttgacattaatctctggtgcttcttcaatttgtgcatctgcaaactgatttttttattaaatgagataacatgaaaatatttgcaaatataagatgatataatttctctttttttcctctgtcgttttacaaagtgatctgatgtgaaacaaaggtacagaaatctagtcttcctcagactttcagatttataatcatttttttgtttgtttttttaactactaggacccttgaatagtagcatatcagaataccatgttgaaaggaagctcagtcatatagtcctattcctattcactcacccaactccagacttttaaagttaactaacagtcacctttaaggaagaatttacacagaactttcaaagcaagtaataagccaaaataaatatacttcaggcaagtaatgaactatcctttgtgtctgcaattgtctttagcttaattgatgccaggactgtgcttagactatgtggacagggatgggagattgctttttatctgatctcaggtccctgcattcataggcatcttccagattgcagagaggacctgtctttatcagttgctgtgagctgtagcttcagcgtgtctctttactccctaaacattgcctgataactccatttgcttttctccttttttgtaagaggggaacttcttatacatttttattacaaattgttttaaaatacaaaggagaaaacttgtaagttgcagagctaaatgtgaggggaggagataaatttgtgtgtttaattccattctatttgtaaatgaccattttgattaaaagtctttcatagggccgggcgtggtggctcacgcctgtaatcacagcactttgggaggccaaggcaggcggatcacctgaggtcaggagttcaagaccagcctggccaacattgtgaaaccctgtctctactaaaaatacaaaaattagccaggcatggtggcacacgtctgtagtcccagctactcaggaggctgaggcaggataatcaattgaacccgggatgcagagtttgctgtgaaccaagatcatgccactgcactccagcctgggtgacagagtgagactctgcctcaaaaaaaaaaaaaaaaaattatagaataaagtagaaaaggtactttcaaaaatgttttaatgtaacaggaaaaggatatctgttacgcttatgttaaacctgtaccactgaaaacttagattgtatgtctttaaggtctagctgatatgccaaagttataaagtatagttggtaatttttgatatatttgttatgatttggggcatggctagtcttgtcatatgtttaagtaaaggaggtttgacttgaagatttacttagtaggtgaggaccaggaagtatagtctaatcagtactactttgtttctaaacaagaacatatgcctcctttagtgagggcacaagtttgggcaaaggattctcagctacgccaaaaaaacaggttcaaccaaatcacatttatagttttgtgaaataacgccctctccccaacccccagaaaggatatttgaaattttaaaataagcagttgttaatgtagaaactatttaatccatacaatgttctcctatcacctgcttgtcttctttcacatcggaaacttccacaggaaataaaagttcctttaaaatgattttatgaagaaatttagcatacacttatcagaatttgataaacttaactgtaaataggcaggtgttctgggtaacttaagtcagcacagtttttctttttttattgcgtattcattgtggcataaagtcatttctcctggattgaggacataatcagagcaattacaggatgaacgacatctatgagatttctgagaggaataaaaagctgcacgttttagtaatatagtagttgccacttatgcaaacttacagttaacagaataatgagttaaaaacctgaatttctgctcctgttcaaaattttgtatttggtgcataaccttaggtaaatcacatcttttcccatcttctcagcctttttggtggtgattgttttgtgtagataatatgtttgtcctaccaaggtttattcattcaacaaacatttatttagttttactggggcccaggtactgctaggccctgagagtagataaatgtcttttccgtaggaagctccaagcctgacagatcattgtgttaaagaattaactatcctcgaatggataataagtgacataaaagtagtgtgagtgaaaagaatggaagtggcaagttattgagtcccggaatgagaaaaatatcaaggacagtgtaggcaacagaatagtgtgagcaagggcacagagcagggagtttgtacagtgagcacagagcagtggttcctaagccagggctccaggacccctacagatctgcaaagataaaaatggggatccatgagactgccagtattttaaaataacctaatggaaattaaatatttaatagaaggtacattaaaaagtgaagttcctttgctttgaactagaattatataaaaccttatatagtaattacagttctttcaagaaatgttgaatattttgattggttcttaagtatttcctctaaagatgggagaatttattatacacagtgttcatttggcaggtggaataatttaagacatggaggaaaatatagacaagagaacttttgaaaagttcaccccatggaaaggggggagtgtggagctgggaaggagaggggagagagggttgggctggtacaagaggcagaaaaatgagattaggaaagtacaccgaaaccaaattgtgaaaggctttatgtgccacaccaagcagtgtgacctttctttttcagtgggcacagggaaccttggaagtttatcagatctctattacagaaacaaaactgtgggaagaagagaggggaaagaaacctgaggcaggaaaatgtgttagaaagcattttaaggtgttctgatgagaaatgagaatcttctagagcaagagctgtggtaatgaagaaggcaaagattttttttttttttttttttgagacggagtctcgctctgtcgtgcaggctggagtgcagtggtgcaatcttagcttactgcaacctccgcctcccaggttcaagtgattctcctgtctcagcctctcccaattagctgggattacaggtgcatgccatcacacccggcttacttttgtatttttagtagagatagggtttcaccatgttggccgggttggtcttgaactcctgatctcaggtgatccatccgccttggcctcccaaagtgctgggattacaggggtgagtcaccgtgcccagccagaaaagatttaagagaagcttcagaaatagaattaagagtacatggctgttgtttaaatgtagaggatgagggagcacaaagagttgatgtctgatttaaatgttaggtaataggatggatggctacccttttaagtggcaggaatagattgtgggaaagaagtttcctgagcctgttatggtgataacaagtagatcctgctgaagatgcagaactaggataggggagagatggtgaactataaatcctgtacaggtttgggggctgtcatactatagatggaggtgaagctgtagacattgaccatctaggtagaacatgtagtacaaacaggaaaatgcctgctctatagatagaaaactataaggatgataggtgaggccgggcacggtggctcacgcctataatcccagcactttaggaggctgaagcgggcagatcacctgaggtcaggagctcgagaccagcctggccaacatggtgaacccccacctctactaaaaaatacaaaaattagctgggcatggtggtgggcacctgtaatcccagctacttgggaggctgaggcaggagaatcgcttgaacctgggaggcggaggttgccattgagcagagatcgtaccattgggcgacagagcaagactccgtccccccaaaaaaaaaaaaaaagaatgatagatgaggacccaggagggactggtcctgtagaaaccaggaaagaaaaatgtccagaatgaggagctggccacaacggtggcttttgtgaagacaggcctgatgaggggagtgaatctggcagttaggaaaccattgaaaatctttcttgagagtggcttccaaggattggatcatgggtgagagttcagggcttgctgaggaatcatccaaataaatgcttttgtaagctacagcaaaatgtaagtgagagacagaagtctccaaagtatttactgacagagatgttcaatatgccttcttcatccacatcataaatttaatttttctctatggaaatgactaaggtaaaacagtgtttgcacaactggtcttatgagactcacctggggtgcttgttaggctacattctcccagtctccctcttaggatgagacgtgggaacctttaatggtttttaacaagcactccagattatttttatgatcaggtacacttgggttacactgagataggtgaaataaccatattttgcctatgaaaaaataactcgaatgaagccatgaggagaatgagaggagagccttggggatgtacacccaggtctgacttaggctttggttctttccactggaaaagctgtctctgcagttccttcaattcttgaataagttaagagtttttcatcttgatcttggaaccctcaaaatagggcaagtggtcttggggagataaataaccttatattcttcctgttttgggaggtgttcatttttcactttttatctctgtttatgtttcttcttctttctggagacagcatttcactctaacacttaggctggactgcagtggtgcaataacagttcactgcagccacgacctcctgggcacaagcaatcctcccacctcagcctctgagtagctgggactacaggcatctgccaccatacccggctaatttttaaagtatttttgtacatttggagtctcagtatgttgcataggctggtctgaaactcctggccctccaagcagttctcctgcgtcagtctccctgagtgttgggtttacaaaggaaagccactgcacctggctgtgtttgttctaaatgccataccttttttaagttcaacttttatttcagatacaggaagtacatgtgctgatttgttacatagtatattacacccaggtagtgagcatagtacccaatggtagtttttcttttttttttttgagatggagtctcgctgtgttgccaggctggagtgcagtggcgtgatcttggctcactgcaacctctgcctcctgggttcaagcgattcccctgccttagcctcctgagtaggtgggactacaggcatgcaccaccacgcccggctaatttttttttatattttagtagagatggggtttcaccacgttggccaggatggtcttgatctcctgacctcgtgagccaccgcacctggccccaatggtagtttttcaactcacccccggccagtactctgcagtgtctattgctcccatgtttatgtccatgtgtgctcaatatttagcttccacttataagtgagaacatgcagtatttgattttctgttcctgtgttaattcgcttaggattgtggcttccagctccctccatgttgctgcaaaggacatgatttcatctttttatggctgcatagtattctatggtatatatgtaccacattttctttatccagtttactgctgatgggcactagactgattccgtgtctttgctcttgtgaatagtgcactaaatgctgtatctcattgctatcctctggtcatccctgcattcagcctgaggactttgttttttagcattatctgtctacttgatgtttttcttgatctacattatgccaatgagcacctctttcttagactgtgattaggtatagtagcaaatctttattgctccggtggtgcttcttaattccaaccacagcagaaggggtgcctccattccagagacatgcttctggggaggagcccataatgaatactacagctggcttgtaatgcaagagagtcttggtcaacttgcggctttactttgaatttatatacattgtgcatcaagtgatatagaagagataaagttgcatcttgtattcctgaccaggaatataactatacatgcttacagtgtgcatggtctttaaagctgataaatacacataatgaattcatagaacaactgtacaagtcatcctttaaacaactatttaggccgggcaggtgggatcacacctgtaatcccagcactttgggaggctgaggtgggcggatcacctcaggtcaggagttcaagaccagcctggccaacatggtgaaaccccgtctctactaaaaatataaaaattagccgggtgtgatggcgggcacctgtaatcccagctacttgggaggctgaggctggagacttgcttaaacccaggaggcggaggttgcagtgagccgagattgcgccattgcactccagcctgggcgacaagagcgcaactctgtctcaaaaaataaataaataaaaacaaataaataatttatggagagtctgctctgtagctggaggtgtatgttccaggcagaaggaacggtagatgcaaaggccctaagcaaaaattttgcatgatgtatttgaagagttgagggggtctgtctatggatatgcaaactctgaaaagcctgttagacagtctaaatcaggtaggtggttaggtatgtatgtctgcagttcaggggagaggcctgaaaccagatataaatttgggagttgccaggatatagatggtatttaaagctatgagactggatgagatcaccaaaaaaattacatgtaggtagagactattttaagagataggaaagataagaaggaaccagaaaatgaaactgagacagaatagcatagaactgagtccaaaaaaaaaagagcgtggtgacctggaagccatatagagtgtgtttcatggagggcagaaatggctggtcaggtgctgctgggtggtcaagtgaagcaagacctgaccacgggatttatcagtgtgaaggtcattcttgactctgacaagaaccattttagtgaggtggtaggggcgagaacttgattagaaatagttcaacatagaaggagaggaagagattaggagacagtatataacaactctttcaaggagttttgttgcagaggggcaagaagtagattggatgcttgaggaggagaaggattcattttgtttgatctggtttggtttttaagttggggaaaatagtagcaggtttgaatgctgctataacaaaatactgtagactgggtggtttatagacaacagacctttatttctcatagttctagaggctgggaagttcaagatcaaggtactggcagattcagtatctggtgaagactgattcttcacagaagcactcctacatggtggaaggggcaagggcatctctggggctgcttttataaaggcattaatatcataagtgaggaccccaccttcatgaactaatcacctcctaaagccccacctcctggtatgatcaccttggggattaggtttcaacttatgaattttttggtggggacacaaaagttcagtttatagcaaatgctgatgggaatattctagtagggaatgactgatggtgtgggagtgacaggagacatttgcaggagcaagacctcacgaatgcgtaagggggagctctgttgcttaagtggaggtgttggcggtagatgggagtgtggacagttcacttgcactaacaggagggaaggtggaacccatggtccaggtactgttgcatagatagaggtggtagggggaaacaagctgatttctcctgtttttccctatgaaataggaagcacagtcaccaagatgtgtgagcttgaaagagctggcatcagaagtttgaggaacagggagacatgaatggttaacatggttcagtggcataatggatagactagggaagggtgttatgattgttgagcattgttagtagcctttttgaggttggtggtcgttaattaaagtgaggatagtcaacatggtatgtttctcttcagatacgttcaactgcacagatgtaggagtgagaaaggggagaagattgactttaaccagttcttccagagtgtgacatgtgagaggcagggtagggagttgaggtgtgtgcaaagtagtgcttaagatgaaggactgtgggattttaactggttaagaaagaagtgagggcatggtggtagtgaaggttgtagtatcagtggcttgtaggttctcatagggtcagaagtttcttggagtcagggaagtagaggaagtgagctgaaaagagaggggttggtggttagggggttgcggtgatttgtaatgacaaggtctagagtctgaccacaggagcagctgaagcaaggtagatagatattgaaaacccaaagaattgaggcagaagtatgttaaatatgttaggtggtgacagtaaaccagcagctgaaatcctccaggatggggctagttacctaagggtcaattagatgtctactaggaggggtaagggacaaaacagtctgatcctgaggattttcagagaggagaggaaaaaagtggtctggaaatggcaatgagatacatggagtccacttaccccattctgagcaagggttatgggagaaaaaaattatctgtgcttctgtagggaagcgatatcctcagggaaagcccggtttctatgagagcaaaaagataagtgaacgatcagggaagacagtgtttcaggggaaaggctttcaggaggtatgtaggtagaagaggacataccaggggacattgtgttccttatgggaattagagtgtggaatgaagggtgacctatgagtcaggggcttttcataagttacataaacagataaagggcatattgaaattgtcttggtccaaagacagtggtggcaagagtggtagaaggccccctcttcctttctacgaatagaggcctggacatgggctggttttcttttgagcatgtgggataagtgcccaatatcttagatatctgttaattttaaaaatatttttaatatttacaggtcattagtaattatcagcactttagatgggagaattgctgccttggatcctgaaaatcatggtaaaaagcagtgggatttggatgtgggatccggttccttggtgtcatccagccttagcaaaccagaggtaagaattttctgttaactgttgactagaaaacttaattctaatgagtaattgctgatattaagaagtttggggccctattgcccaggtttgaggcctgtctgcctcttacagtttgtgtccctttagggcaattacttaacttttctattcctcagttcccctcttgtgaaatgagatggataataacatcttcttaggattacttggggcattaagtgagttaatcctataagtgagcagctgaggatactatctgccatatcagcaaagcacattatctgagctataaatgattgtttattatcatcacaagatctctaggaataataagataaatataaataaaaactttattgaattttactagttagaaatctgtgctgcaaaatcccataaattattattccctaattataagcagaattcatctgaaatttttttgtaatgtaattccaggtaaatttgattatttgcagaaaaagtgtacttaataatttggagctctagaatagtagaggggaaagagcatagattcaaagagacctcgcttccaaaattactctgtcacatgacttcaagcccctcagagctttagttgttctcatcaataaagtgaggacacagcctgcccgcatggggtacagatgggggagattaaataagagaagctgattttcctcacctttagtttcaattctgatggattaagtctctctgcttttctggagctttagtctgttgtttaaattacttaaaaataagtccatcttttgagtggtgactactaacattgaagcagtcacctctgttttccagaatgcctgtggccttcttttatatcgagttgttcttgtaggacactccctagggtagtcttttttctcttttgtcatcagtctttttctttaaaaagcttcctagctgatattaagtatggaaaagacaaaatcgtacatgaggggtttgagaatgacctgaatattggtgaccaaactttccaatgggaaactgctaccagtgacgcatctataataacagactttcctgtgctttccagtaaacccagcccaaatcttttctggtgcacccaaactgatatttaaggaaacaacactgccaaatttccacatttgctgtgtgctgaaccctgagtagactttataagtggctactgtttctcagtatactgaaaatatattttgagaatagagaacttctattgtattatgaattattaatacaaatagcaatttgattgtaaattacattaagtttataattgagtatggtattcaagtgaattactacttaagataaacttgtttatttttcttctgctgggattatgcttgggtatgcatgttttactttatttttaaactagacataagagatgatcagcaaaatgagaagattgtaagctgcttacatctgaggtaatatcacagtgtgttgtagtagttcaaagcatgtgtgtgtttgcaaactgaaatatatataggtacaaaaagataagttgcatggtatggcaaagtagaatgcaaatagttgtaataacctgagtgctagtaagtgtgtttgagttataagcagctagttgtatttgaaggttttcttacacatagccgttatattagctgtttttaaaactacagttcaacattcttactgtctttagttcgcaccattttctgtggtttattagggctcccttgttttcagtgtcctctctcacacccacccacccccaatcctagatcttttggataaaatttttgctttgaaatgttgaatcgtaggccgggcgtggtgactcatgcctgtaatcccagcactttgggaggctgaggcgggcggatcacaaggtcaggagtttgagaccagcctggccaacatagtaaaaccccgtctaaatacaaaaaattagcaaggtgtggtggcaggcccctgtaatcctagctacttgggaggctgaggcaggaaaatcacttgaacctgggaggcggaggttgcagcgagccaagatcgtgccactgtgcaccagcccaggcgacagtgcaagactcccatctcaaacaacaacaacagcaaaagaaatgttgaatcgaaagccttttcagaaagctcactggtcgcttttcatgcaggaaaagaatcctgatacctctttgcattatctagattttcattttctacttcatagaaaaaaaaaaagaaaatctgaaggtattgaaacagctgcgataacatgatagattaactagattttactgctgccccaaattcttgggaccatttcttgagagtggatgtttaatatgtagagatactgatgatataacgttgttcccagcattgtaacatatactcgatgctgcttacacagtgtaatcctcatagtaacccttctgaggttgataagttggtcccattttgtaaagaggaaattgcagctcaaataaatttgcttgaggttgctgaccggctatatatatggatgaagttggaactgagcccgagattgcctgactgtactccattctgcctgctctgaagcccttttgccaccttgtatatacctccctttctttacaagctcaggctcttcatagactacagtggttctgagactgtttggtgtcaggacctgtttatactctaaaaaattattgagggctctaaagagctttttatcaggctggagtgcaatggtgtgatcatatctctctgcagccttgaatcctgggctcaagcaatcctcctgcctcagcctcctgagtagctgggactacagacatgcaccaccatgcccagctaacttttttttttgtggagacagagtctcgatattgcctaggctggtctcgaacccctgggctcaagtgatcttcccaccttggcctctcaaagtgctgggattacaggcataagccaccacgaccagcctaaaacaaatgtttaaaaaacatgtattttattaaagaaataacaataaacccactccacaataacgtaacatttttatgaataataactatattctttaatacaaaaaatttaatgagaaaagtagcattttacatttttgcaagtctcttaaatttttggtttaatagaaaacagttgtatccgcgtctgccttaaatatattgcattgttgttttgatttaactacgtaaagaagaaaatccagccacatacaaatgtagttggaaaagggaggaatattctagtagccttttcaaataattgaggccattcttttttaataatctgccaaaacaagtggaagttttttaaaggttagttgcagtgtggaatcagaaaccatatcaatgaacattttatactctgaacactaacatccattggtctgtcttgccttttactcatgcatgattttataacttagaaaatactgactgagttacatagatcttttaaatgttggcatatttccttatagaatattttttaaaaaaacaaatttgttgctgttaccactgatctcatcagaaaagtctgtaagtactgggaagctgtgaagcgcaaattggcagatccaagttgttttgttttgttttgttttttgtcttttagagacagggtctcactctgttgcccaggctggagtgcagtggcgtgatcatagctcacagtagcctccaactcctgggctcaagcagtccttccacctcagcctcctaagtggctaagactataggcgcttgccaccaagctcagctaccttttttttttttttttttttttttttgtagagatggagttttcttattttgcccaggctgatctcgaactgctgggctcaagctatcctcctgcctcagcctcccaaagtgctggaattacaggcatgagccaccatgcctggcccaagttttccagtattctagaattcacttaaaaacataaattttatcacaaataccgtcagatgtgttctttgaagtaaaaagttcactttgttcattttttagaaaatgtctaccaaatacccagttgacttttgagtaaaattggagctcaatgaacaaagctgctagttcagctcacaactcagttctagaagtgcttttcctcaagacatgctttagcatgtggagaaaggcttgttacatacttcctaattagtcatgcagaataataaaaagatgtgttactcagggtcaagatttaatgaaatcagtcatttttattgcttcatcaagaacatttgtaagtggaactgtctctgtttttttcctttagttcaggtgtatgacagtgaagaataccattgtattcttagtttggttcctgaattgtgccaaggcaccggcagttttagtcagcattgcttttataccttcagggcaaatagcaacctttgtgaaaaggcaaatcacaccttgtttgaaaactgtgtgctattttgcacccctgaaagaatccacgaaccatactttgaaaattacttaattggtatatgatagaaatataagaatatttgtgaaattataaacatattagcaaggagagaagactgtattgtgagcatgagtcatctgttattcagcaaggtgtgtgctgctcagcatctagaagttatgttcaaaagttgaacatttgtccagttcagatttagaaaaaaaaaaagttggacaaaacaccacaaaaggatcatcaaggccgggcgcggtggctcacacctgtaatcccagcactttgggaagccaaggcaggtggattgcttgaagtcaagagttctagaccagcctgggcaacatggcaaaaccccatctctacaaaaaatacaaaatacaaaaaaaaaaaaaaaatacaaaaattagccaggtgtggtgacatgcacctgtagttccagctactttggaggctgaggtgggaggatcacttgggcctgggagacggaggttgcggtgagtcaggtcacaccactgcactccagcctgggtgacagagtgagaccctgtctcaaaaaaaaaaaaaaaaaaaaaaaaaagaaatcaaaaactgccatttgaaatgctgtgaactggatgcatagagtaatactaccttcaaaatgcatctggtgcagtgttttcttaaggtccttaaccttcataatagttaacttttttaaaagtagttaacttcctctctcagaaacccagtgtgtttggttgtaaaggctggtgtagggaagagggccagttgtagcaggcagaaagagctggcatggatatatagcaggtgtcacctcccaggtaacaataaataggttcatggcttcctgtggggactcctgtgttagaatgtcagtttctccaagctttcatcaagaatggtatgaaagttgggcacagtggcacgtgcctcctgagtagtcgtcccagctactcaggaggctgggcccagttgagcccaggagtttgaggccagcctgggccacatagcacaaccctgtcttatgacgaggaaacagatgtaactcagaagaccagagaagatgtattctctgcaactatcaaagttacttattaatctgagaagctgaaggataaaggatttgatagactgtataataatttttaagttattgataaaggaattgattatggatcccatgtacttttgctggaatactaaagccacacaggaactttttagactgtgtggtattgtggaggagggactaggattcaggagcttcagttttagtcttaattcttccattaacttactgtgtgaactggctaaattatttaatcagtagagctttaatttccttctctgtaaagttatagaattggactacatctctaaagataatctaacttcatgcatcaggtacagtcacatacatgaaacacccaagtaaattatctggagaaatttttgaactttcccttttactacatttaaggattcttctgaaaataaagaacaaattcactaggaattaccattaggtacatacttgcctcctggcttgctctgatgttcttaaccttttctgatccaaaaggcttacagaatagtgtattttgttgctttagtgggattttgattacgtcaatggaaaaaataagctcctggaagataagggaaattgacagttccactaagaacagatgttttaaattacatttagaatgaattgtatgaattgtgtaccttgggacacacatctcatttgccactatctcctgaaaagagtgtggatacataaccaagctaaaaccgttaaggtgcatgtttgtgtgtcttagaataaataatgcacctaaagttcactctattagctttaacagatgtgcttaggttctaagcataatatttttgccagttaatagtagctaagaattttgtttttaattttcagatgtgaaatctgatttgctttcctctagtaatttatattcagattcaaccttgataaaagcactaaggaaatttgtctgtgattcctcactgattgccttaaaattttgttttgtaacacatgagcatcgttttttctttaggatctctgggctacatttggatcacttcaccaaatctaagtagattgaactatctacttctttatgtcttggaactcatttttaaatatgaagaccttccttattgttattcagaatgcatattgtaattgtgtatatataactaatttgtacttagatgaatacctttatctttatttagagataccatatttgttttctgttttggttttctgttaaatatgccctttttttcctcttaagaagaacaaacaactctatcgtctaaacttagataaggtttggggttttgctttattttaggcatgtttctccccaagggacaccgcctttctgtttcagacaggtgcagaaacagacagctctgatgctggtgctctccagcctcctccccctccccatatcagactacattccactaatataagggctttgaaaagtgggactgcctttgaaaagggtacagctttactggttactgatttgtttagaaagagtctattagtagacccttttaagtatttattaaaagaggatctgtaatctcttttaaagcttctcttacttttactgaaagctgtccaagttgttttgcagtttttcatttgcacgcaaactagcacattttgagtctgtgtcatctaagatggcagtttattttgaagcatagctgtcaatcatgtagcaagccaatatttaaataattgcctgggttaattgcttttcttttaattatagaaatgaaacagtgctttaatttaattttgttatattaatcccttagcatggctgaaagcagtgctgtgaactaagctaatttatcccagcattgcatgtcaccaaaggagaaactgatttggccctgttttttttattttttattttatttttttaggaaattgactcttcatgtacattgtttatgtcatgaatatatattaatctaggtgaaggcagagatagttattaaaatcagtgttcttttatcatgactgtgagaagtatgcttaaaaagctagtctggtagtttcccttgaggcattttgttttgtaggttgattaaattagtgaaaaaaagaattaaacaattgttatcaacttgatatttctctgctcttgagtactaatttacattttttaagataaataccaaatcattgcagaggtttttctcaacatttaagcatatagcatatcacttgggatgcaatctgactaatacccggatctgctgaacaatctcattacccctcccgttagggcatcatcatctaatggtgatgccccttcccttgtctttcaggtatgattcctggagaccctttacttttatcaaacagtcttccttttactttccccaatgtttccagggaagtaaaaatatatatttccataatacaacaatgttgaagcatcttttttttttaagtcacaaatagtcaattctgatatctagtagtgtagtcagttgctcattttggttaattaagatttactgtttatgttccattcaagtgtatcatttttgaagaattaaaatatacagacatatacttgttaatttttctttagcactgattgtctttattgattaataaagtactttcaatccgttagagtttttatgttacaatcaaagaattttaggcttgatagagctttctgataaatcaaaaactgcagcagtttgatatattctacactgaattaatctttatttggttttgaggccttgtttttaaacagatgtgaatccatgtttgggaaagaaataactgaccttgcataattaagctttctgtctgctcccgcctttaatttacttgtggagcaggtattctctagaattcaaaaagcttttgttatttttgaaattttgtattcatgaataatagttctctcctgaagtttccaatagagaataaaataaagctcacaatgaattataggtagtcacatgagctagactgagtttatatttttgcttttaacttttttctttcataagtatacatgtatatatacacataaacacatacaaattaccttagaagttcaaagtaagcagccctggatcataaacttttgtttgagtagcactttatagtttgtaaagtgatatctattcttagtcatttacatagccctgtgaagtaaatattcttattaaccctaattttttgcatgataaaatcggggatcaaaaaggttcagagatttatctgatatagtaaaggtgagactcaacccgagatctttgtacttacatctttccctctttccaacatttaatgctttttaaaataccttaatgcttaccaatttatttgtattttctctactaataattcttcatgtgctttatggagattaattactcaaagacatcttgcgtacagcatacttagcacgtagctcagcacattttgagcatctaaactgcttctaggacaaccctagtgggatagtcacaggcaccaaaacttaacacatccaaaactgaattcagcattgcgggattgcaggagggaggcgtgcagaattgtgcactgcccaggacagatgtgattcttgcctttctagaacttataaggtactgtgtggagccagctagggaggcaaatatgaaataattatagtacaaataatgcaattgagtgtggtaactggcacaaggcaggatagagcacaaagaaagactctaacaagcataagtgcttacctagcctgatggtcaaagaaggcctctcttgtatgatcaggagttactgaggcaagagatggatagagaggagggggaggattatgctgggagaggaaatagcctatctcaaggccttaaggcgagagttatcatggcatgtttggggaactgagagaagttgaggatggcaacaggaatgagggttgggagagagcagccgaaatgagcccattgaggtgggccaggatcaggttatgcagggtctagtaagctatgttagacattccagattttatcctgagccatgagaaaccattgaaggtttaagtggaagagatcactctgactgtagaaaatggactgaaacaacagcagaaattgggagactatttctagtctcccacactagttaagagactgcatggtagtcatccagatggggatgatagactggatggagacagtggaaatgagtgaagtaaagtgacagattcaaaagatgtttaacgaggaagataaaattacaagaccaaaggaggatttagtagtaaattaagaacaggtatagaaaggaagaacatgtgttgtttagatatgagttgggagagaccatgagagctctccaagcagagatgctaaagaaggcatttgactttatgggtcttgtgctgacagaggaaaagtctgggctgaagttaaaattagaattgcttgtgtcatgggaactgagaagatcaatcaccttgaaagaaagtagggtgagaagacctatgaccaaagctttgaagtccaacattttaaaattgagagagactgataagttagagaaaattgagagaaaaagtgtttcaatgatagatttgttttagtaggattttagggattatcctgctttccttcagatttttgcatctgctacttggtgtgaagactttatgaatatgtataaatataaatacttccataattagagataactgatttataatgcaaatgcctcttcaaacaactccttgatttgttagtcttattgaaagttttgcagcaaaacagaacatcagaaaaccctttccactgtcaactggggaacttggaaagcagtgggaaaaagcaggaagcctgtggatgcccaaagtgataaaagcattagtcagtggttgaagaccaaaaaggaatcccttttaagttagttgtggagagcgattttgagaatcaagtgaaataaggaaacgtgagacattttgtaaaacagtgaagtgttcgtttttatccgaggtcacatagtaaatgagtagtagagtcagggacccaggggatggggctggatgaggtgcagtcagctggtctggttggtatggatacatcttgattttatgttttggatgtgtgctgttgccccatcaccttggtttgcaaaacaactagtatggctaggaaagtaattgttctaggcaaaggagacttccagataataaaaaagtcaacaatttagcatttttaatggcatatttttatttttcttttttttttactttaagttccaggatatagcagaatgtgcaggtttgttacataggtatacatgtgtcatggtggtttgctttacctatgaacccatcatctaggttttaaaccccacatacattaggtgtttgtcctaatgctcttcctccccttgctccccacccccgtcaggccccagtatgtgttgttcccctccctgtgtccatgtgatctcattgttcaactctcacttacaagtgagaacattaatggtgtattcatgtatttcacatcttcccaatcttaatgagttgtatctttttatttgtaagttgtaagaattatttatttgtaaatattgtaagaatgttattgtattatcctagaaatgctctctggggttcttaggtgggacagggatgtgtgcccctttaataaatattctaggataattggtgttttacactctctttcttcatggcctatgttcattcttccttatctctacattcagtgagtctgcatcttgccacactctttttcttaccccctcttctcctttttaaaccttgttgcttcttagcttatacacagaacttggcttttgttaactatcagggccagtgtgttcctggttagggaacacactggtctcaccaagtctcctgaacccttttcaattttcagttttatagtgggtgagttacttctggatacaatttttgggatttgagagtgtttaatgcctgagtcactaatcaagaaaatgctagtgtatgcaaatctggcttccaaaaccgaatgaggaaaagttctttatagaaaaatcctaactaggccgggagtagtggctcacgcctgtaatcccagcactttgaaaggctgaggcaggcagatcacgaggtcaggagactgagaccaccctggctaacatggtgaaaccctgtctctactaaaaatacaaaaaattagccaggcatggtggtaggcgcctgtagtcccacctactcgggaggctgaggcaggagaatcacttgaacctgggaggtggaggttgcagtgagccgagattgcgccactacactccagcctgggtgacagagcaagaccccatctcaaaaaaagaaaagcaaaaaaaaaaaaaaaaaaaaagaaaaatcttaactaataaatgcagaaagaatgacaaaattagaaattgctattctagttcttttattgaaatagtaggccatcaagcaatactaaaatggtaaaaagttgatgggacactttaaatggagggatcaggctgactcccccaaactcaagtgattgatagtaacatcattaaaagtggggcatgcaaacactatgtgcctcctaatatggtatagcataggggccagcaaacttttcctgtaaagggccagatggtgcttatcttaggctttgaggatcatgtggcctttagttgcagctggaaagcagtcatagacagatacataaatgaatgaatgtgtggctgtgttccaataaaacttttcttacaaaacaggcattaggctggatttggctcatgggctgtagtttgtagacccctaatgtaataggaagtgcgtagcaccagatacgaaggcttcttgtcaaaacaactgaacctgcatcagatcaaagctccaagtctaatcatacttttcaggaaatataggaaataaaggaacaagttaaatgacatgtagaatcctgactgtgggacattctataggacagataatctggtttctcaagtaaatcagtgcataacaaaggggttgaaagaagttcctttgtggagggaaaagaatcagatgtaatatgtagacttggaattcctcatcataaagtagatctttgagataataggagaaattttaaaatttgatgattttactccagtaaacaagtatatagtaggtgagtggagatagatgaaacagttggcaaaatgttgataattgttggaactggatgatagatacatggggatttattaatctccacattctatatgcttgaaattttttataaccagttaaaataaagttgaatgtactccaaaaagtgtgtgagtcagttggggagaggggttggctgcatagaaaaatagggaagaatcaaatggaaaacattttttcttatggttagaggaatttttgttttttaatgctggtagtgctcattttagtagtagtacttcctttattttctcatatgaaattccttcctccactttaaaattaaagttattttcacattttaatttcagatagaagtccctgattgcaagtgccactggtattcattgtaccacttaggttttgttaagaaacagaaacggaattactttactaaactgctttatgattacacagatagactctgggagtttgctagcaccttttattttaaattatgaacagggaaaaaacaataaagaaaataaatacaaaaatttagactttttaaaatgacttaagggagaagcaagtcacacaataagtttgagatgcagagcagcgaatcagaacaaatagctgcttacatgaacaaatcagtgggatgtgaaaatgcatcaccgtaacctacatttttttctaccaagagatttgcagctgactatcgggtgactcattcctatgcttagggggtgaggtaatgctattgtgaagggtgatgtcatctctgtacctgaactgcatgcatatattgcttctgtggctctcaaggaaaagctccatctgctttcacatatgcagcctgaaagacttgacaagattggcacaaaggtcagcagccatgtgtatgactcataagcaaccaattagcgaagagcagctatttaaaagtgaacttttaaaatcacaatccagaaatatgacatgatgattcattattgaatcataatgccttgttgttgttttgtgttttgcacttactgagttaatgctgttgagcatttaacttttaaaataaggaagttttctcagtatggtcaatgatatcaaatcttgaatctttaaactatatttttaattgaagataaggttggttggtcagtctgttggttgattggctggttttacttttggagttgcagagaccatccttagggcaaaaatggattctatttcatattagtttggcagttgatttttgcacttaggagacattgtattccctaaggacccgctactgctttagaggaaaagaggtttttaatggaagaggaaataagtcaaaataaacgctatctgtttactgcagacacacttaactcctcttcctcttttagtcatgcacacctgctttctctgtttatactttaacctaatactactgttgagatgaccaattaaaatatctatttttaactttattatttgaatctagtgttctggtaaataaaatatagaatatttaacataatatggaggtagataatggtaaatacttgattttctatctgatatgtaactcaaaatagaagatcatatcggctaaatactacttattgttattatagggtatgtgcatactctgacctaaatttgttctaatggcaacttcaagttggacattctacaaaagataaaaataaaggttttaatttttgagaataaaatttgttatctattatcaggaaatagaaggaaacaaagaataaaatagttatgctaagactctaaggtaatattaggtaaggtatataccagtgtcacttgagaacttactgaaaatcaaatgttttttcagtaatgagtaataggaacccttaaatgtctagaattatggtaaaccttcatttaatggtatggtcttgagtttgattatagagctcctgcaagactcttgagtacctttcttttgtttttaaactcttgtttggaaataatttcaaactacagacagttgtacaataaacgtggtaccaaaaaagaaaaaaaaaaaccttatgtgctcagactttacctaccccaacctggttgcctgctttatatgcttgcccgtgtcctcttgcccactctcactcttctcccccattccctcatacacacttgtttttcttgaaatatttgaggataagttaaatatgcatcatggccctttactcttaaatacatcagtgtatatttcctaatagagatattctcttacataactacaaaagttataagcattatcaatttatattaatacaatgccttaccatccatatgcaagttttgtcagttgacctaataatatcctttatagcatcctctatgcctagtacagcatctagtctagggtcagatattgcatttatttgtcacattagcctcttttaatctagttttttttttcacagccctttctttatctgacattgacatttttgaagaatatggtttctctgttatttttaaaatggaattttccttactttgtgcttgcctgatgtttctttgtgctgagattcaggttgtgcattcttggctggaatactacataggtgatgcagtctctctcagggcatctaactctcattgatgatttttacttttggttatccaatcaaggtattatctccactatgtaatatataacttttgttttttaatttcttgtaactaataagtactctgtaaggagacaccctagaacatgtagatattctgttcttcatcaaagtttccacctcagtttagcaccattgctgactctggtatgacccagtctttactgtgatggtggcaaaatgctaatttttccaactccagcccttccttttccctcatatattatttattttatctgtttgctattggtatgaacatgtgaattcctatttttaaaaattcagtacttaattattttggtgcttaattgtcccagatttggccagtggccctcacccttttcaagcacatccttgttttttgaaagaataagatggtaaaggctcatctcacatctacactgccccagccctggaatctgccatttctctgaggagccctggttccttttggtggagaatgaaattagataacaaaatttgggcaccgggtatgagtgcactacttttacagccactgtataaacataaatataaacattagctgacctggtaagtatttcttggaggtacagtgaacaatttttgaggatatcacggtgtctcggattatagtgacaacaaaaaggaaagttaaggaatgggaagatttttgtcactaaacttacattgccaaaattttcttagatttcaaagcaaaaaaatacatgatgctaggttgaaggctagataggatttctgtggacaaagttggtacagaaggatgttccagaaagaagaaatgacattgacaatgacataactgaacaatatcagtaactttaaatgttgtgtttaaataaccatgcctgatttccacccattgggggagaactaaaagacagggatgaaaggtttatttaaggtcagttttagaggactttgaatgtcctctaaaggattttggatctttaggatttggggtctttagtaagaagataatagctgttgaagatttttgaatagtgtcataacaagcttaactctgactgaaagagattaatctggaagatacatagaagattaaggaaatttccagttaagaactgtaaagaggctattatagtagttaaggcaggatttgaactggatttgaactggaaaataataaggatttgaactggaaaatgaaagaaagaagtgaattagaatagtggtttttaatctgtcttccaaaaccccaggtttggggcaaagtagatgtgtgagttgaacaccaaatgagaactctcagttactgtatgcgagttttcaagtaagtatccctttaaagaaagcaatctgctgcttaaagaacaaaaaactatgtagaaaaattttgttaactcttacttctctcgtattcctgtttcctaaagttttgagcctggataatcaggaaaataattgtgtcattaattgatgtaggtcaaattatgcgttttttaaatgccaaaggtcaatgtcacaaagacatgtactaaaactcttactgaagaaataagatattcttggccagaagtcttggaattatcctggactcctttcttttgctcatgccataaagagaatccaccatgaaatcctattggctttacctttcaattatatcccaaacctgactaccttaaacagctctactgcttatcaactaacctcttaccttctgcctgctctctctgcctccactcttgcctctcagcctgttcactttccttgtggtttttcaaacatgatgggtatgcttccatctaagagcctttgcaaagcctggcctggcgtggttaactctctcacgttaagactttgcccaaacgttactttctcagtggggtctaccctaagctctttattgataatcccctctccaccccatgcgtatttaccattctccctttatcttgttccatttttttaacggcatttatcacctaacataccatataatttacttatttattaagttgtttgtctcgtgacaccagagtttaaccttcacaaaggcagtgatttgtttgctttgctcgctaatctatcccaaccatcagaatgtgccaggccataggtaagcccttaataagcattgttaaaagaagggagggcaaccgagaacacaaaaccagtaagcttacttactaggcttctatctcattgcagatttgagaaagcaaatgaaagaagggatgggacactacttgaatcagtatctctaaacctgtgttccttggagctgagtctatgacagtaattggccttgataaaaatagccctagaaaatactgcatatattatctatttacacattaaatattcatattacacatattacacataatcatgttacacattaacatactaattgctataagagctcctatagtaacctcttcttgaactcacttgatcataaaactctcttttggtaactcacctaccattatgggacccttttggcccatggtaaactgagtttgagaaaaatcttactagagtactatgtgtagggcctgggagtgattggcagttcttttaaattacttttggttgatggactgcactgcttcatgtgctactcagaaggaggctggagtacatcaggatcaagactccagctcttaattactattattcttttaaaggtatgatgcttctatttttctgggagaaataagaaaaaaataataattaatgttatggcccttttaaaaagttagcttctgttttaggtatttgggaataagatgatcattccttccctggatggagccctcttccagtgggaccaagaccgtgaaagcatggaaacagttcctttcacagttgaatcacttcttgaatcttcttataaatttggagatgatgttgttttggttggaggaaaatctctgactacatatggactcagtgcatatagtggaaaggtaagtgaaaatgctgaatttactttggggaaatcagagtaaattagggtagaaaaagtaatttattaaactacacttattattagttgagttttattgtaattttcccctgaggttgtcatttgttttaataagagaactgtgaggtaggaaggggaaactaataacagaataaatggcagagccaggaatagcaggaggaagagaattcataaatatggtctactgtgtctcaggtgtttttttttttttttttttttttgagacagagtctcactctgttgcccaggctgatctcagctcatggcaatccccacccccaccccattccacaccccctcaggttcaagtgggttcaagcgattcttgtgcctcagcctcctgagtagctaggattacaggcacatgccaccatgcttggctaatttttgtattcttagtagagacagggttttactgtattgccaggctggtctccagcttctggccttaagggatctgcccacttcagcctcccaaagtgctgggattataagcaggagccaccatgcccagcctcaggttcttttttttatacattattttgcaatcttcacagtcttcctaagtgtaactttcgtttttttttttttttttttacattttgacagatgaagaaccttataaagattaatagtaatcctaatgataagaataattgatactactcatttatagggtttgatcctataataaggtgatccaagaggaaagtttatactcattttacagatgaagaaactgagactttaaaaggttcagaaacttccagggtcacatttaacttagatctatctgacaacaaagtcatgctgttaataatctagactttctccaacattagctcttaggatataatcataatataatctgcttctaagattgggtcttataaatccattatcaagagtagctaattaaaagcatcctttcaaccaggcaaggtggctcacacttgtaatcctaccactttgggaggccaaggtgggtggatcacttgaggccaggagttcgagaccagcctggccaacatggtgaaaccccatctctgctaaaaataaaaaaattagctggggatggtggcgcacgcacgcctgtagtcccagctagtcaggaggctgaggtacgagaatcacttgaacctgggaggtggaggttgcagtgagctgagatcacaccattgtgacgtgtaaacggtttatatacagacttggactaaaataaggaagaatagaaacgtggtctttttactcttgcatttttcaactttaacaattccttatctaagtgttaggcccatagcactttcttgctcttgcagatgcttttctgccttctccacccacctgcatctgcattgtgttgaggaggccatgccatcctatctggccgttttttgagcaaagcacttcaatctctgtttacttcggtagtctcatctgtaaacaacaggattgaacccgatcacctggttttccgatttgatgtgctgctacataattctggtattgtagaaggtatgcttttcgtgaggattttagtttggatcatattaactcttccttttttctttagtgaaaatttgaggcagttacttttgaatacaaaaagctctcagaaaagtttcaaatttttaaaaaccaaacacttttgttatacagaaactctaaggttgattttttttttaactcacctgaaattttattaatgatattgtagaaaagctatcacaagtagctatccatttcttcttgtatattctatggaaatctccaaagtaaggctaaaattatgtaaatccttaaaatcattccctgaaataaatattcattggtactgtcattgttctaaataactcattttaggagttggtaatctaactgatgcttcttatgacttgagtacttcatacacatttccttagtttcctttcactttttaaaaattacagattcctttaatatctctgatctattatgagttgtctccttttactaattttgtatctaattttgtcttttcaggtgaggtatatctgttcagctctgggttgtcgccaatgggatagtgacgaaatggaacaagaggaagacatcctgcttctacagcgtacccaaaaaactgttagagctgtcggacctcgcagtggcaatgagaagtgtgtattcagataatgttgctgttggtattatttagaaatacacctaataccaaaatttatcagatttctgtttgtggagattttgactattttgttgccttaaaagcatatatatatatatttttttgatacggagtcttgctctgtcgcccaggcttgagtacagtggcgtgatattggctcactgcaacctccacctcctgggttcaagcgaatctcctgcctctgcctcccgagtaccggggattacaggcacgtgccaccacacccaactaatttttgtatttttagtagagacggggtttcaccatgttggccaggctggtgtccaactcccgacgtcaggtgatccaatgtgggtcctaaaataaaaatggtttcatggttattaacaaattctgaactgaacttctcaccatatgcttcgggatatgataaccacaggggttctcatatgataactattagtttagtctcaggttaatgattttttttttttttttttgagaccgagtttcactcttgttgcccaggctggagtgcaatggcatgatcttagctcaccacaacagctgcctcccgggttcaagcaattctcctgcctcagcctcctgagtagctgggatgacaggcatgcgccaccatgcccggctaattttgtatttttagtagagatggggtttctccacgttggttaggctagtctcaaactcccaacctcaggtgatccacccacctcagactcccaaagtgctaggattacaggcatgagccacggtgcctggcctaatgatattttttatagcaatctcatcattcaaagttctttgaatacagaaagatgttaagacaaaattgatgtgtttctttgagcttgaacttatttgactctctaattatgtctagtaggtagtttcatagtttgattatctcaattttaaaataataatcatcttattcaattttcttgaagtattaaaacatttatttagcctaatacctttctgtttccttctttaaataatgaaccccttatgtaatttttatatttaaatatgtgattaaaaaatgtgatacctagattagatacgctgattctacatcaaatgcttgattttttttaaacctaatatttaagttttaaattgcctttgtagtaaaaataactttagattccatctttatcttttgaaaatgaaccagactttcgggttttgtctgatccgatgcagtgtaattcagtttcctttcctgaaaactgttttctcaaactcagttaagaatgcatttattctttctactttggactatgaatagggctttgcatttacagacaacttgaccttctttatcctgactggattttgtttttttaagtgtttgagtgcttactgggagctcagccaccatagcagcagatgtccaacttaacagatttttgagttaccagaataggaaggatctgggtttctaagatccatgattctttaaaatataattatttccataaatgtcagaattcttaactatgccattttatatctaagtgaaaagacacaatactctcagtagttgagtgatttttctatttactaattatagaggaaacattattactgccactttaggataagactgctgaaacttacttaggaaagggtaaatgacttgccacatcttgttcagtggagatccaagattggggctgaggtatcctggatcacattgcctttttgaggccatgttttagtatgaatttaagactggtgcattcatcttgacttttacactggtttgttagggcatattaattttgctgcacttaatgaaatgtatcctgcctttaattaagaggtaaggcagactgtgtgctacctcattttaaggtgacattgatgtgtttggggaaaatcactctgatgtagaagtacaaacatttgtaagtttttgagagaaaatctgtcccttagctgttgtaagggacacatcaagtcagtccacaaccctcaaaaccattgtgtctgaagggtcaggacaaagttcttgtgggccctcttgtggcataaatcagtagagcactcttttccagaaggttatgttgttagttttctcatcacataattttagtatttgcttcttcaatctagaagagttctatattattttgtccctttctttaaatgtaaatttctaaaacacacctttgtaaatttaaggtggaatttcagtgttggccactttgaacttcggtatattccagacatggaaacgagagccggatttattgaaagcacctttaagcccaatgagaacacagaagagtctaaaattatttcagatgtggaagaacaggaagctgccataatggacatagtgataaaggtttcggttgctgactggaaagttatggcattcagtaagaagggaggacatctggaatgggagtaccaggtacctaacaccactgaggatttaaaatacggttcttcctctcccagtctgaccaaacttattgattgggtggaacgaaattactactacttggggctctcagcttgttctctgtgcttttataaatttgtgattttaaatggtattttatgggttggaactatataactactgcttgaattatttaagaccttttttccatttttgtttagttttgtactccaattgcatctgcctggttacttaaggatgggaaagtcattcccatcagtctttttgatgatacaagttatacatctaatgatgatgttttagaagatgaagaagacattgtagaagctgccagaggagccacagaaaacagtgtttacttgggtgagtaaatgtatcttatctaacgatagtacacattgacatctagattttcttcttacattgttccttcctacttcaggagtgcctgtagtagttttaaatcctaatatcatctctgatgtacgttgcccttgagatttatacttcgatttccattcctgctacttttccatttgtccaattctgaaaatttttttgttgttgttggagatggagtttcactcttgtcgcccaggctagagtgtgatggcatgatctctgctcactgcaacctccgcctcctgggttcaagcgattctcctgcctcagcctcctaagtagctgggattactggcacctgccaccatgcccagctaatttttgtatttttagtagagatgggatttcaccacattggccagaatatagtgcacctgacctcaggtgatccacccacctcggcctcccaaagtgctgggattacaggcatgagccaccacgcccagcccaattctgaaatttttaattactgtcgcatattctttttctctgaggtctatattagaaaggcttagaaatattctcattatataacatgatttcaaattactcattagccaagaatggtggcacgcacctgtaatcctagctactccagaggctgagatgggaggatcgcttgaccccaggagttagagcctaccccaaactataatcatgtcactgcactcctgcctgggtgacaggacaacactctgtctgtttatatatatataattatttataagtaattacatatatgtattacatatataattatttatatgtaattacatataaaatatatagttaggtatatatcctcaaagtctataattttctgtatttgtatttgcatccatattagtttgtgaccctcccctctttaagattagatttctttcttttttatcagtgcatctgtacaactgatctaaaaaataaaactctggtgtgcttctgggcaattgaaagcctttaatattataaattttgaaaactcttggatctaatttgaactagtctgcatcatcaaatactcataaaattctataagctctgacaatgtgccatccacctgttggtttgaatgaaaagcaagaatttgaaggaataacatgtcatttgtgttatgatagtatttaactgaattgttagcaatatttctagaattataggtgtttaggtaaactttcttgagaaagttacttagtgtaagctatttgttttgtgagagtacagtgacttatctttgaatttttctactggaacaattttcctgtattactgaaaatgtgctattattcagtgagaaatatcatatggaccttttgtgtaactttccctccctgtttttgttgaataaacattgagtttatctttgagtgcttcaagcatgtttcttctttgacaagagttttgtggtgtatgtagaaataactggaattaatgtaattttatttaattaaaaaaacctttttaaaaaaatcaatgcataattgacaatgttctggttgattcaggaatgtatagaggccagctgtatctgcagtcatcagtcagaatttcagaaaagtttccttcaagtcccaaggctttggaatctgtcactaatgaaaacgcaattattcctttaccaacaatcaaatggaaacccttaattcgtaagtgaattgtaaacttttctaaatactgttagtgttcagagacctaatcctgactgtctttgccctagttttgaatactgcagagataagaactgttatatactttatattttattgataaaccatgatggtatttcagatgttaataatgaatttttattttcatttagagcatcatttcttggaagcagcagttgcttctaaaaaatgttaatcaaatatttctctatacaacttagaaaaactcttaatcattccctgaccatgccaaagtaacatttagcgcttaacatacttatattaagactgtttaggcaaaagttatctggttagcacatcatattctttgagactgaacgaatagaaatcaaatactgtgcacctacttctttcattatctttctaaaccttgtacgtgttttttactacatatgtcatgtcatattttaattgtttgtttaaacaactcagattctctgtaaaactgtgcttttcaaaggcaagagctctgggccatttgtttaacttatatgtttgaattgaattatggttgaatatcagtttattcaattaagcacgtgcatttttattcaagtcataacagttcagacttaagaaatattattattaagaaaataataattttcttttagattctccttccagaactcctgtcttggtaggatctgatgaatttgacaaatgtctcagtaatgataagttttctcatgaagaatatagtaatggtgcactttcaatcttgcagtatccatatggtaagtgaaaatactgagttttatttattttattttttaatttgaaattaatagaattcaaatgaagaaaagtcgattagagtatagacaataaaacatcttgggagacaatttcatgaatgattactaagcatacaagctccaaagttaggttgccagggttcagatcccatttttgccacatgctaggttgggcacatctaactcccctgtgtctcaatttctttatctgtaaaattagaataataatcctaatatctatgtattgagttgttgtgaggcctaaatgagataacgcaggcaaagtctcagttaacatcatacgtggcacatagtgtcagtaaacattggttctcgttattagctcttatttatcagactatattatgtaggctgtatagttgcctgtataatgaagaaaatgtgtttttcataaaactacatgaaaatgatgcacaatgaggttatcttcttactcagacaagagaaattagtgcaaaagtcaagaataggtgagatttggcatgaaatacattttctatttagtaagcagcagttttttgaagttaggatatattcagatatgaaagccttttaaacagttgtgtaattaagaagtcctcaaatctgtatcaggtaaacacgtagacgactcatcagttaccctagatgttagcactggaaagttattatataaattaaattgattaaaaaaaaatggctctgaactagaaacagcagcctttatcttttttttttttttttttttttttttttgagatggagtttcgctctgtcacccaggctggagtgcagtggcacaatctcggctcactacaacctccacctcctgggttcaagcgattcttctgcctcagcctcccgagtagctgggactacagatgcacgccaccacgcccagctaatttttgtatttttagtagagacggggtttcaccatattggccaggctgttctcgaactcctgaccttgtgatccacctgcctcggcctcccaaagtgtctggattacaggcgtgagccactgtgcccggctcctttatcttgatattgatcaaaagacaagttaggctgggagtggtggctcatgcctgtaatcccagcactttgggaggctgaggcgggtggatcacttgaggtcaggagttcaagaccagcctggccaacatggtgaaaccccatctttactaaaaatacaaaaattagccaggcattgtggtacacatgtgtagtcccagctgctcaggaggctgaggcaggaggatcacctgagtccaggagacagaggttgcagtgaggcaagatcactgcactccagcctgggcaacagagcaagaccctgtctcaaaaaaaaaaaaaaaaaaaggcaagataaaagagaactgtgtagtctgaccacgtagtacaaaatagaagacaaaaaaagacaagctatttttctgggacaaactcattttgacagcctaaactgaaccaaacagcatggatgttttcctttcattttgtgaagaatgattggtggtaaaatttggtattttattgataactaaacaaaaagaaagctaaaaataccctgaaggaagattgagtattaattcttatatttaaagaattgaattattaatgaggttatgaatggagtagcccttaagatttttttctagtcttattacttaatataaagaaaatttaatatgcttataggataaaggaaaatgtctatatttacgggagaaaaatgagacaaattaagatgtttaaaatacgttaaagaagagagacaaaacttaaaaggaattaatgtgataagtcacaggaaaatggataaattttaatagttaaagacgggcctatttttgattacctttaaaaaaaacgttttaatgtttctatttgaagataatggttattatctaccatactacaagagggagaggaacaaacgaagcacacagattacagtcagattcctcgacaacccacattacaacaagaatatccgcaaaaaggatcctgttcttcttttacactggtggaaagaaatagttgcaacgattttgttttgtatcatagcaacaacgtttattgtgcgcaggcttttccatcctcatcctcacagggtaagaatcatggttgcttactgtctggtttccacttccccacctcctatttgcttctcaacccatcacagtctggcttccatccctactgctccaccaaagctactcttgccaaagttctcagtgatcttccttgtgttaaatgtaatggacatttttcagtccttatctaactgaacctctttgtatttgacactgttgaacatctccctttgacctttcttgcctgacttccttgacaccatgctctcctggtctccttgggtgtgatgtggatgcttcaggacctgatctttctcatcctctcagtattgttggtattcctcagcactccctcttttcactgttcatcccacaaactctccttagatggtcttccctactttcccagctccaatcttcttatatactaatggttcccaaatctgtttctctggaacagctatctagtaagtgctacacaggcacttcaaatgagccatatctcagactgtcctcatttcccctcccattcccctcccctccccagcctgttctagcatttttctctctcaaagaaacgtactgccgtatgcagtcacgaaagccatgaaatcattttgctctcccttatcagtcaccaagttctgtcgaatccttcctcctagatatcttcacatttttcttcttctctatgtgtcagttttcatttccacagcacaaataccatcatcacacctctcctgaatcactgaaataacttctaactggcctctgtgcccctagtcctcaggctatctccagtccattctccacaccctaactctagctgcatttctgggcttaaaaacctctaatacctgaccctcctccccattgttaggctcaagtccaaccttcttaaaacatgcaaggttctgaatgattcgtaccctgcctgcacgtgacccatccttcactggtaccctaatcccttcctcccctccaccgtgctcagccactaggctgagctgctttcagtccttcctgtagaccgtgctctcgcttagcctggtggtgctcatccctctaacctcgccttggaaccttgttccttacctcctctcccttccctctcaaataattaactcctgggtaatatcttttagtttgaaattagttgccacgtcccctgggaagtcttctttaacctcttatttctgagttagatttcctgcctatgtctacactctgtactcctcttactagagtatttactaaaatatttaataggtaattcctaatttctctctctacctctagactgtacattctttttttttttttttttttttcagagacagggtctcactcatctcactctgtcacccaagctggaatgcagtggcaccatctcagctcactgcaacctccgcctcctgggttcaagcaattcttgttcttcagcctcccgagtagctgggactattggcatataccaccacacccagctaatttttgtattttttgtagagatggggtttcattatgttggtcaggctggtctggaactcctggcctcaagtgatctgcccacctcagctttccaaagtgttgggattacaggcatgagccaccacgcctggcctagactgtacattcttaaggacaagaaccagtctacactgtttaccaccatctcctcagccccttacacagtgcttggcacataattggagctcagtaaagatttgttgaaagaatcagtgactaaacaggtgacccacagtgccccaatttgaccatgataattattaacatcctctaaaacatcttttaggagatgttggtaaagaggcattgcctgatttaatttcctgttcttaaaagcattttaatgcaatctatgaaactggttaggaaggaaatctctctagtctttttgttgttgttgttattgttactgggttttttgtttgtttgctttttttccctaccttattttgtcaaaagaaatcactctagtcttgcccaggagtttgtgtttatgcttacatgtgtgcattgtctttctatctagttatgtatcatgctgtacatatgacatacccacattataaagaaacaaaatcccctcaaagactggagggatagcagtgggaagataaactttttttcttttataataaagcaaaatgctgcactttgttttcataatgcttttatttttcttgatgctacttatgtatttttcagtgttgtttattttataacctaaaattgttagctaacttcagttcagctttgtactggtagtgattttgtttttcaccttatcagcaaaggaaggagtctgaaactcagtgtcaaactgaaaataaatatgattctgtaagtggtgaagccaatgacagtagctggaatgacataaaaaactctggatatatatcacggtaagagtcttataaaatacaaccatctgaatcaaagaagaaatgacctaagatcttgtttaactttttttttaatgtgtggatatctagaaaaataaaacataggcttaaccctcaataaataaataaattcaggtaacttaaatgtattaaaagtggtatataccctaagaaagataaaaatagagtgttataggaatttagaatttcagctaccaaattaagttcttattcaagtaacttagttatttagggtctactatgtactaggattagcatttatagtaccagataataattaggtttataagagtgtgatatgagtctccacgtttcggaatcctcatttattttcattattgttctatctgtaataggaagtagaaatatagggaaaaaaacactaatagaacagatagtttttaaaagcagaagggggagatggattagctaaaagtaggcagtttaaataaaagtaaagaagctattagcaatctctcaagtataaaatgtcacctttgatgcattgtgataactggaaatggtgttatggtttatttttcatattacatggattatacctatttttctctttgtcttgatagcatacttcttatcactttagtgatatggggacaaggaaaagacgtggaactatactgcttaatatctagggtaatgattttatggcagaaaagattgaaaataatagataaatatgtatattggggccctccaaggaaacagaaatgacaagatgtgcatatatatcttatacataggcatatatctttatatatatacttctatatagatatagatgcacaagcatattcacaacaaattaaggaaatacttgtgacaattacagttctcatttttgatacctgtcatgtggtcacagctggtagttataagtaccttcctcctctatccatcccatattccctttcccattggagaacaacacctcagccggttgtaattctatatctggtagggtgacccaaatccacagtcctgaagggtctgggagattggtagttctgcctggattggattgttgtagttttccattgaccttaatcacaaggcatgattatacaaagagatccctaagggatctcatgtatttcagacctactctttcttacacctccactgtgaaacagcaatccaatttccccttagtagtcaggattagtcatccagccagcacagtagctgtcttctttgttgattggaaggcatgaggagttcaaagttgctgttgtatctcctggtggaagtgttcctctcccttagacaaagacctctaggcctgccgaacataaggtcacaggaacaggaagcaaaaatgttgccagtggatcactaggtggtaatggtgggtgatgccactcgcatttccatcccttgatccctggacctgtaaatactggctatgggagaaaccatgctataatatattagacactgattcagagcatatccagctttctggagaaccctggcccagccctgcaaggtacctacctggcagtgtaatggagtcttaaaaggccattctacctttctgtcaaaccagctgcttcaggatggtggggaacaggtaaaaacagtcaatttcataaacaaagcaaaatttactaggtgattaacaaatgctaaaggctactttaatacctttgctaataaaaatactaatatatcagtgactgtcaacaccagcaggcagtgagagaaagaataaaggatccaacaactcccatgaggtagtctactactgaagttattcactgttcattaaacatttattcggaacagctgtgtgcaggacaatatttcaggctttgggagaaataaaaagactgctcctatcctggagaagcttaaagtctatgggaaagatactactgggtaaaacaagcatgtaagaagaaagccatgaaccaaatcactaaatctgtttgtgatgatctaggaggacatcataaatgaagtcatatttgaactgaattttaaattgtgagagttcggcaagtagagatgaggtttggggagtagaataaatgcggtatcatgaataaagatgtatttgtcaggcttttgtcaagaaaattagaaaaatatactcaaaattgaattagacttaagtcagtttaactttattcaatatgaagaatgcagctcttgggtcttttttttttttttttaatatgggagttctataataatacctaatgttttttagtggcgacaatgtcctaggcactgttaagaacatgaactctgcattcagtcatgagttcaaatctcagctctgttatttatcagctgacaacttaggcaagatgatacttacatttctagggtctgtaatcacatataagatgttactctttttagaagataatccgtttttatataggtgttttccttaatatgggaagataattcagctggccctccaggagtaggatatgaagtttgtgggcttttgcatttggggagactgatttgtactgaggtaccttgactggctatttttaggaatacagattattactcttcattttctatgaaaggaattggcccatggaacgttgaaatctattgcttctccttaactccatgctttaaccagctgaggcaactactaaataaatgagtatgtaagtcataatgtaagtcttaaagtaaataatgagtatgtaagtcataaacttacccttataagggatatcagacatcatctaatttattcattaattcatgcatttattcaacagacatttgttagactttcggtttgtcaggtagtgcccacccattggaaatacaaagagaaacaagaatgattttctgcattcatggcccccaaaatacagtggcggtgggagaagggagctgcttacacataattgcaaaaaattaagattaagtttaaatacttcaaagtattatgtgcagagtgttatgggaatgtcaagacaggggtctaagaaagccttacagaggtgaggagatgagcagaatgaaagaagaatagggttcattaaatgcaaagaggaaggccatcccagtggagcagacagcagaagcaaaaccttgaattgtgagacagcatggtgcaaattgactggatgatacagtgcaggtcagtgaagtcagcactaaagggagaaacaggctgcttagtggaggcccctgtgagtgacagatggtgagttggcttctgtttgacttggtacctccagtggtaggtacactgactcgtggggcaacccaacccatgtcagctttggttcctaggaaggtttatggctaaaatagtacctgggtataataggactgattaaaattttcccataaaattgacaggtaattagctaagataaaaacacattttctgtaattgattacaaaatgtcacagaatgtaaaagatatgaggattaggaatatgatattttggtagatgataggaagtattggacagcacacatcactagtgcagcagttgtaagaaaaagtgattaacaagtgattcccaattaaacatgtcttttttatttttaatttttttctaggaaacataagaatgtgtttgcttcatttatacaaacaggactaaaaatgctgttaatcaaattcaaaatatactatttattaagatgagttctatgagtttatacatttttatgtgtcataagattgaactgattttcacattaccacaaaatttaaaactgttgcaaacctttataaattttatctctttttaaagatatctaactgattttgagccaattcaatgcctgggacgtggtggctttggagttgtttttgaagctaaaaacaaagtagatgactgcaattatgctatcaagaggatccgtctccccaataggtaatgggtggtaccttcagtaaacttgaaatcagcacagtgtgatctaatctcatgggtaaaatatccttcttactgtactctgtaaacaccatagaaaacagtttcagacgtttcaaatcttaggttctaagtgctgccaattaaccagctgtctaaaagttgttatctctataggttgctttctatctacttttaaaatatgcccttgttttttattattaactcaggactttcgtttagtggcttataataactgtagaccagtaaattgcagcattttaaaacattctatatttttgtataaataaggaaaagtactagaacaaaaacatttgaattatattgtctctacctggtaataactattaacactttagagtatttccttttgattttgttttctggtcatatatttacctaactggtagccagttgccagtactgtacagttttgtctgttgctttcttcatcatatcctctatatttttcatgttattaagaatatgttattagaatcctaaaatatattaaaagtattttatggcttggtaatagtccatttaatacacgtgccatattttgtttaaccatttcttattgttaaacaatttggtttctaatttgttagaattagaaataactttaccataaaaaaaacctttgcagtattcatctttttatgtaccttttgacaatatctatttccttaggatagattcctagaagtgtgatttctggctcagaacagtgtgatgcttaagatgatagggttccagcaataccttttattctaactatgtagaaggcccttgttgcttttttttttttttttgagacagggtcttgcaccgtcacccaggctggagtgcaatggcacaatctcggctctctgcaacctttgcctccctggttcaagtgattctcatgcctcagcctcccgagtagctgggattacagacacccaccaccacacccagctaattttgtatttttagtagagatggggtttcactatgttggccaggctggtctcaaactcctgacctcaggtgatccacctgctttggcctcccaaagtgctgggattacaggcatgcaccaccacactcggctaatttttgtatttttagtagagacagtgtttcaccgtgttggccaggctggtctcgaactcctgacctcaaatgatccacccgtcttgccctcccgaagtgctgggattgcaggcatgagccactgtgcctggcctcttgttgattcttgattaaatgcacactaattgttgtgctgtcatcatatctggtagtcacagctttttcaaattcctgtctggtaggtacaggaattggatggtttgggtactagggaactattttttttcttttggtaaataacttttgagtagtttaaatattcatatgtgccaggcactacataagtgataaaaactgagcaaggtttctgccctcaagaagcctgtacctttttggtgcttctgtatgtacactcaagtaaatacaatgcaagaaagattttgacctttgccttatcttagtaaatattaatagcttctcatgaagaagagcagatgtggccaaaaggcagtcaaggaagtcaagcttcttagaaatggcggcatttgctctgggtgctcaagagtagcctttccctcagtaggagacaggtggggagggatggccaagtgcatgaaatggcccgagcaaaggctctcacaagcacttggaggtggtatggagaatggtgagagttctggagtagatggaacaaagggtaagaataggggaggatggaagagaggaagaaaaagataggttggccaggtacagtggctcacgcttgtaatcccagcactgtgggagtcctaggcgggtggatcatttgaggccaggagttcgagaccagcctgaccaacatgacaaaatctcatctctactaaaaggcagttggaggttacagtgagctgagatcgcatcactgtactccagcgtgggtgacagagtgagaccctgtctcaggaaaaaaaaaaaaaaagatagcttgtagcaccttaaatgccaagcaaagaagttgggattttaaaactttatttgtacgtgcagtagatgcgcttgtagcatttatttccagaagagaaaaacaaacaaaactgaaatacttgtattttttaaaatacaggacttgtgtggccttttagaagtataccctaggctagccgggcacggtggctcacacttgtaatcccagcactttgggaggccaaggcaggtggatcacctgaggttaggagttcgagactagcctgaccaacatggtgaaaccctgtctctaccaaaaacacaaaattacctgggtgtggtggtgcgcatctgtaatcccagctactcgggaggctgaggcatgagaatcacttgaaccagggaggcggaggttgcagagagccgagattgcgccactgcactccagcctgggtgacagagcaagaccctgtctcaaaaaaaaaaaaaagtataacctaggctaactcatctgtttctaattttagtttcaagaaaagatcctattttattatttttctgttttcactattagatatgaatacttcagatatgaacagccttcagtgttgtcttactttctctctttttcaggctaattttatttctttaattttccttttttattggtatataatacatctacatattttaggggtataagtcatataatttgtaaagatcaaatcagtgtaattggaatatccatcaccttaaatattttctctctttcagggaattggctcgggaaaaggtaatgcgagaagttaaagccttagccaagcttgaacacccgggcattgttagatatttcaatgcctggctcgaagcaccaccagagaagtggcaagaaaagatggatgaaatttggctgaaagatgaaaggtaactaactttgttacacatacacttaagctagttttttgcttgtgtgattacaatgtcagttttataactttagggatttttttttttaaagaaaaggaacagcagagttctgttgtttcatgttttgaaaagttctctagccacttgtgaaattttggtttagattttgagaacatacacgggtgactcatgcctgtaatcccagcactttgggaggccgaggtgggaagatggcttgagcccaggagttcaagaccaacctgagcaacatagtgagaccctgtctcttagaaaaaataagagagaacttacattttaaaaaattactagttgataggactctatacattgtgattgattgagggatttatagtgacttttctcagtataaggtatctgcttctgtctccattttttaaaaatgtttgttatttagttctcttagcagttaacaatttacagctcctttttaagtagttttgaactatttgcagttaaaaatacataaacttagcctgaatatattgtccatattaactatgatgtgctataggaaggaaggccctttaaaaactattaaaggagaagaaaaaggaagcatgtgtagatagactgccaccaaacaactggagtgaaactcctacctacaggtatctaagcaacattagatccacgtgaggtaccttgttaaagtggtgcttattatagactcaaccaataactaagccatagaaggaccaagtgaagtggccccatgtctcaaggccttgtgaggcgctgcccttttaggttaattttaagccaccaaggaatcctgtcctcactttgcataaaaggctttggctgctctggcagccccagacagtcccaggtaactgtttcatgtataaaattaagctttaaaattaagttttttagaaggaatgaatggaatgtgatgttctgtatctcacattgcatgtttttatttagtttgtatgttgttttgttgtcatttggtaagtggccttattacagttgaagctttttaaacagagggtgcagttcaggtacttgaatcaatatatattcactcttacccctttgtatttctcccacttttagcacagactggccactcagctctcctagcccaatggatgcaccatcagttaaaatacgcagaatggatcctttcgctacaaaagaacatattgaaatcatagctccttcaccacaaagaagcaggtctttttcagtagggatttcctgtgaccagacaagttcatctgagagccagttctcaccactggaattctcaggaatggaccatgaggacatcagtgagtcagtggatgcagcatacaacctccaggacagttgccttacagactgtgatgtggaagatgggactatggatggcaatgatgaggggcactcctttgaactttgtccttctgaagcttctccttatgtaaggtcaagggagagaacctcctcttcaatagtatttgaagattctggctgtgataatgcttccagtaaagaagagccgaaaactaatcgattgcatattggcaaccattgtgctaataaactaactgctttcaagcccaccagtagcaaatcttcttctgaagctacattgtctatttctcctccaagaccaaccactttaagtttagatctcactaaaaacaccacagaaaaactccagcccagttcaccaaaggtgtatctttacattcaaatgcagctgtgcagaaaagaaaacctcaaagactggatgaatggacgatgtaccatagaggagagagagaggagcgtgtgtctgcacatcttcctgcagatcgcagaggcagtggagtttcttcacagtaaaggactgatgcacagggacctcaaggtctgtatttgtggagcatcacccttggggtttcaatctgacgttttgtgattcagagcagtacttgcagtactctgaaggatccttaagagttggggagagtaaaagcatctgagagcagaggtctgagaaagtagcctcgaaggggcctgctgcaagaataagaagtcttatgtctgaaaactttaggcaaaccatgcattcattgtcttcagtaatgtgtttgtgttcattttactgtaaaaggtattctcagtagtccaggtgagggaaaaaaaagaaaaaagaatctttaggtaaaatccaccatgagcagatatagcctgtttttttgtttgtttgtttgtttttgtttttctatggttttgagtaaccctgacaccaatacctccagggctctgaagcagcatggtgaaagggatccgaatggaaggagagacatgggttccttcattagccagcttgaattggggcaaatctccacacttttgcttctttttctgaactgtttagactttgggggaaggggtaagaagccgaatggggaaaggtagcaaatagttaacagatgactgtttacagctctaaaaccttggattctattttcaatatattcagtagtgaattttgcagtaatataatatgcaaaattattaaagagtcttactaaaacatgacatttccgtagtagtgtttctaaaaataagtacatggaacttttatttaactaatttcccacattccatatactcttagccatcaccagtagatgtggagtgaatgtataaatacttttctgatgaaagtagcttaaagtcttgatagatgtggatccattttaagtcttttcagacttaaaacagacttgtttcaggcacaaaagtagctatttggacacaagttattttcttctaaaatcagcagtaggttttcaaattcttgggtatattttaagagttttagggtaacaagaataggaattagaaataattcttattttttaatataattgttatttagtcatataaatcattatgcttcagtgattttgacgtgggcccaaactgattgccaagaattgttctgcactgaatgaaaagttcagagatgaattatttggttggattggagaagacagtttacaggagaccacacacccctaatttgagagaatactagcagttaggtttgaatatagtaaacgcttatcactaggtgggaaacagctagctgaaatacacattcttcttgtacttaacacttgctgtacacacaaatgccaacttgaaagacaatgaatcatgttttcactaataatgaatattcttctgctaattttataatgtaaatgagatattggtaaatatccatttaatgctacaatgttgtctaaagatttttctgtaattgtctatgcaccagaaaaattgcaagaagaaagttaatattcctgttagtttttctagaaatcagaaagttttattcctttctaaatagaagacaattccttttaaagatttctagtgcgccacccccaaccaaaaaaaaaaaaaaagccaagatttttgttcctgggtgaaaaagctgtacattttgctacgttctgacctaaatctttgagctcaatgttaaaccttctaggccctctccccctgttatattttggtcacatttttgtcttcaggactttggctcctgcctcttcagactaacttctagtcttctattttctccactctgaacttttctcagttcctcttgatatacactgttctgacagaaacctggtccttcttcattattctcatcacacctggattatttattctgtggtttctatggggtatgaaccatatctgtttcttttacctgttatagtctcagtacaatgcctgaatgttctagatggtcataccatttattttgaattttattttctttgcactcaaaagtgtttatactgacttaaccagaaaaggaaatctgttggcccacatggctaaactgttgagaattcaggtaaagctttagctgagatcaagtgatttagccagaacctggtttctgtcctccccatttcttgtttctatttaagtcttttggagttggtggggtagagggtggagagaaaagtattgctttttcccactatcagaaattttattctacttaaaccaaggacacctacccatccctcaacaatccctagccaggcaatgggattccatggattggcgtaagcaacttttagagcatggatgccttccacactaaccgtggggttttgctgcacagtcagcaagaaggaagttcccaaagtaaagtcaagatacttctgctggaagcacagggagatagatactggagagccaaaaagcttgtctattatagggttcagtaaataacaactgccatcagatgttgggagttgggaagaaagatgacatttaatgcaggatagtctattattgcctctggtacaaagttatttattggagagctgcagattattaccatagatcttatacacaataacttcatgcttccaagtcaaaatcgtttaatggtattttagagtttgggaatgcaatgttattttctggcagtatttgaaacatgatgaaattcaatttcatgagctaaatggcttcctttttcctcatttcaagggctatgaatggtggtcatattacccgcagagtagagtagactctgagggagaggtgatgtatttcatgtagggcaccttgggtttgagaagcccatgagacctctggttagatgtattcaataaacagtgtaatatgagtttagaactcagggcagagatctgggagtagatatagtcttgagaacatagaggttttacgagaggcagcatagagtagtagtgaagagctcttatcccttctgataatctatatccccctcagacgcaaaccaaaagatcagtctgtttcattcattcaccaaatagtaattagctaccatagagcaagaactggactgaaatctgggcacgtggcagtggatcacaaggtcctttcctcatagagccagactgctcaggtctgaatccctgcttcaccacttgctagttgggtaaccttgggcaatttgtttaacttctgggcctcactttctatgtctgtaaaatggggttagtactcatctaatggggttgtagtacatgagttagtagtagtaaactgctttgaacagtgcctagcacattgcaagttctatttatgaactagttattattagttataattattaaggctttaagtcataagtgtagagatgcttgcctgggaagaatatatagaataataagattgaggattaagtaccatgatccctagggaatgtgcacctcaaagggtttaagtagatgttcaataaatactagcactctttgctacccttcccttttctttactagcagtacttgtctggcacagaaaaattgtcactattttcctgttagcccattttaaaaagaaatatgcttgaaaatatctagtttgttgtattttttctttgtagtcttttaaataattctctttactttttcgcctccatgcacacccactgtacttttgtctgttgtattctttccagccatccaacatattctttacaatggatgatgtggtcaaggttggagactttgggttagtgactgcaatggaccaggatgaggaagagcagacggttctgaccccaatgccagcttatgccagacacacaggacaagtagggaccaaactgtatatgagcccagagcaggtgagtttttcagacctttacttactagcacagcagcagatgtacctgatgaatctcttctcatgttttcattaaaatacccagtaatctaaaacccagtaagtctgaaaattatgaaaactggcagtagtgttccagtagtggaatagtgacacagctaagatgtagtttctacaacctgaattggggctggattaagaaaaatacaacacataaaatgcactcaccccctgaacaagcacctgacagcaaccaggaatttggaaagagactttgaatgccaccctcccaaacttaactcgtttgccttgtgtagactgtgttggaactgttttcagagccagctagacccagaggtactatactgagctgccctttgtggtcactcataggcaacttccagcatgtaccacagtaggaaatagaggcacacaggccggcaggtgttgccttgtgggctgcttggccttcacaggaaaagcactgtaatcagggcagggactggaagagctgggggagcagggcatcctggaagcatcaggcgagcatgctcagccaccaccaggcaaatgatcttcacaagcttctctatgcttagagcagcgggtctcggacgttttgggctcagtacatacttacacttgtagaaataactgagaacccaaaaggttttcttaacaaaattttatctatcgatatttgttatattagaagttaaaagagaaatttataaaactttattaaatcaactaaataacaatgaaacctatcacatcttaagatatttttatgaaaaataagtattttctaaaacaaaaaaaaattacaggcaccaattcccctgcaaaaaaaaaaaattagagtgacatttgtttacatttttgccagtctctttaaagctaacttataaaagtgctacattcttctatctgcttttgtgttcaatctgttgcagtatgttattttggctgaagtacatgaggaaatctggcctcgcacagatatgtagttggaaaaaagagcaatatttcatttcaagtaattgtagatattttgtctttgatagtatatcaaaacttagtaaatgatagtttcttagaagtcatttacactgtggaatctaaaaccattcatgaatattttgtactctggtacttttaacatcccttggtccattttgtactttgaatggatctttttacccatgcttgactttacattgtgcattagtcatttggaaactattggttccctaagtttggcaactattccaaaagtcatcacagttcattatgtaatataaaaagtcactttggttaatacaaccaccaatctcaccagaaaaggctttatgtacatattaggaggctatcaaattcccactggtagactgaaatcttccaaaattttaattttcacttaaaagctcaacttttaacattggcaacaaatactgttagttttccttgaaatgccattctcacattgttcatctttttttctctttaaaaaaaaaatgttgtttgtttttttttttgagatggggtcttgctgtgttacccagactagttttgaacttctggccgcaagccatccttgaacctcagcctcccaaagtgctgggatcacaggcgtgagctaccatgcccggtctcattgttcatctttaagaaagtgtccctcggccagtcgcagtggctcacacctataatcccagcactttgggaggccgaggcaggcagattacctgaggccaggagttcgagaccagcatggccaacatggtgaaaccccgtctcttgtaaaaacacaaaaattagctgggcatagtaacgcatgcctgtagtcccagctacccaggaggctgaggcacaagaattgcttgaacttaggaggcagaggttgcagtgagccgagattgcaccactgcacttcagcctgggtgacagagcaagactccatctcgaaaaaaaaactctctgtcaagtatccaagtctcaataactgtagtttgtctaccaattattctttcaagtcaaaatggtgttctatgaaaagagcagctagagcatattgtaactcaaataattgcacaaatgctaatgatactcacaagctaatctatgcttacatcagcaggtctcaacttcttaaaattagtttgttttttaaattgactcataattgtacatatttatggggtacatactgtcgttttaatacatacactatttagtgattggatcagggttattagcatatccaaggtatcaaacttggagacaactattgtactttggtatggagcataaatgtttttctgaatattttccattttgtcagattattaaaaaggtgtatatttaaaggttgagatttaataaattaataatttctactgctaaggacattttaagtgaaatgttttttggttttgcctgtgagcacgtggtgctgaagaatgtaattgctactggtacagcttggcactgctcgcttgattcatgcttaggttctgtcagtgcaaatgtcaacacagtgaaaaattatatcttagtattattatgaaaatagtcttggccttgcagaccttttgaaagggtgttagggtcccgaggaatccatggaccatacttcaagaaccactggatttgactatctttgaaagattatatcagagaccagtaataggaactgcctttgaggagggcaagtttgttttactgtcatagagcatccttttgaagtgtttgcattgtttaccttagtcaagtgtttcttttttgcaatgtgaatttttattttgtatttcgtctttgaaggagattgcagtgagccaagatcctgccactgcactccagcctgggcaacagagcaagactctgtctcaaaaaaaagaaaaaagaaatcaagcatttttacatattaagagtcaaaaaagtatcttaagtgaaaaaaaacaaaatgcagaaatgtgtacaccttttgtgtaaaggaggaaaagatagatatacatttgcttatgtttacattaaaaaactctggaatgatgtgtaagaaacaaatggctatgggggcagtggcagaggggaagtaactggtggggctaggccagtgagggacagagtgagagggaacttttactgttagctctttttgagccatctgaatgtgttacctattaaaagttaatttgagatgagaaatatataaaaattggcaatagacatcaaacccaatgaacgatatgtgccaatggttcttgtgaatattgataccaaaatgagaataaaatccaaaatgtattcctagtaaaagacaaataattttaagtatgcttatcattataagctgagtttgtcattcctatattaaattaacaaagattaggaaatggacgatggtaagaacatggaaaataaagatgggaatagggatttgtacttgatgtagctaagtttggcaaatagaataataaaacaatatttctacctctgtatcacttacagacgacaaacacaaactgcagcaaagggaaaggatatggaaatacaagtgatgctaaagccaaatattagttatgacaacaaataaatagatgtgtttaaatatccccatgaaagggaaacttcaggttggattataatttaaaaaaaaaaaggttagaaagggaagctaggtaaaaaaatactaagctttatatacagttgctatttgaagatttattgatgaataaattataattatatttactttcattttgaacttctaggccacaaagaaatatcatggatattgtaaatgcctttttatgattataatatattaaaagaagggtatagtggtgtataaattgatttttataattttgtctgtttttatttttgcttttgcttctgttttgctggctggaaattttattatttttttgagacagggtctttgtcactcaggctggagtatagtcatgtgatcttggctcactgtagcctctgcctcctgggctcaagtgatcctcccacctcagccttccaagtagctgggattacaggtccacaccgccatgctcagataatttttttgttttttgtggagatgaggtgtcactatgttgccaaggctggtcttgaactcttgggatcaagcaatcctcccgccttggcctcccaaagtgctaggattacaggcgtgagccactgtgcctggccaactggaaattttaaaaccctcctaaataactatcaggtcaatagatgatgggttgataagtgcagcaaaccaccatggcacacgtttacctgtgtaacagacctgcacgtcctacacatgtaccccagaacttaaaaaaaaaaagagtttttaaaaataactatcaggtcaataatgaagtaaaaatactcatacaaagtattaagaaaatgatgaaagaagctgggcactgtggcttgagcctataatctcagctactcaggagggtgaggtgagaggatcacttgagtccaggagttccaggccagcctgggcaaaatagaccccatcttaaaagaaaatgtaaaaaactttttttaaaaatgaaagaaatgaaaaatagtgaaatctataggaagttttcaaagttccatttggagataaatttattttcaggccttcattacatagcacattactgtataagagattagaattctgctcaatagaaggcagggaggagccaagaagatggaaaacaaacataagaattgatactggtgaaacagtaaaatagcatcaccatggttgtttctaatagtttaaaataaagataatcctctctagcatagatacctacttaaggggggaaaatcacaaataaatttagaaattagaagagatacagaagagatttttatttataggagactttcatatatagtcaattggttgcaaccaaaagtatccaaactggcttacgtagaaaaataaataaaataaatctattggccctggtaattaaatcatcctgctcaaatgatctggccaaggggtggtgaaaggaaaaattaaaactgtatgaaatatcaaaatactataaatacatatttctatctataggaaaaaagactagaagagccataaaatatcaacagtcattgcttctgagtagtgggacttcaaatgaattttaatctattttggacttttctgtatgatccaatttttctacatagtcatacaacagaattgatattaaaaacagttttggttgggcatggtggctcatgcctgtaatcccagcactttgggacaggtggattgcttgagcttcagagttcgagaccggcctgggcaacatggcgaaaccccatctctacaaaaaatacaaaaattagctgggcatggtggtgtatgcctgtggtcccagctacttgagagactgaagtagaaaggatcgcttgaggctgggaggtggaggttgcagtgagccaaggtcatgccaccgtgctccagcctgggtgacagagtgaaacccctttaaaaaaaaaaaaaaaaagtttttttggccaggcatggtggctgacacctgtaatcccagcactttgggaagccaaagcaggcagatcatctgaggtcaggagttcgagaccagcctggccatcatggtgaaaccccgtctctactgaaaatataaaaattaccgggcatgatggcaggcacctgtaatcccagctacttgggaggctgaggcaggagaattgcttgaacccaggagggggaggttgcagtgagccgacatcttgccattgcactccagcctgggcaacaagagtgaaactccgtctcaaaaaaaaaaaaaaacacctttttaattgtgtttttaaaaatttattattatttaagaggctggaaataatacttttacattttaaatattgtgaaaacaaataaaaggaattctatctggatgcttattaatgaaggctcacgacttgggaagcctctctcacccagtcctatttaaaagagatgcttctcccttcactccctgcctgggtccatcccattacactggtttctttttacagcatttttaactctttgaggttcttttttctttccctgtgaaatataaactatcagtatagggacttagcttgtctctcattctactcttaacacctgaaacaacacctagaatgtggcatagtttcataagtgtttggtggatgagtgaaggtgaatgctagtgaaaagatgaacaccaggtagtcccggccaccccatacacacttctgtgctgactgtagtgtggcttgtggctgctgtgtgtgtgtgtgtgtgtgtcttggaaatgggttgccatttgagaaaggaagaggttgatgacaactgaagctatatttcgtattgttgaaaatactagaaaattaggatagctgtagaaattttatggcaatgtatagtggttaaaatttggtagttaaaaatggacagtcttaattatcttcttaatcctctttaaacatagaaactgtcactttataaagtgctccttaaaaagtcacacaaaatatttgggctgtatgaattgtacaatcttacccaagccttagaagctatactaaaacattgttttaaaattatttattattagaactctcttaattttctcatccttgaaataaatgagcaggacccatggttactttgttcttggttgtaattacgaagaaacacaggttaagttctagatttgcacacagcgattaaacaattcaaaggatatattctaggtcctaattccttattttttagatattttgtaaatataacttttcatgcgttcatgaggctacatttctttttttaaatatgtttaatcacgttagaaacaataaataaatttagtaacacattatatatctatctgtcctctagggaatacagaaagtatagggacatataacaaaaaagtaaaaatcacttaccaaaaatatctgtaagacattaacagcagttatttccttttctctctctgtgtgtgtgtatatctatatacaccttactttagaaaataaaattggaattctactctaacattttggatacaatattaaaatataagtatttcccatattattaaatattcttagaaaagatttccagctgcatagtattcaacattcatttgggacattttaattacttgtaaattttgctattaggaatatcacttgggtaactatccctgtacccaaatacccaaatgtctgtacacatttccatctgccctagggtgggtaaaattagatggcatcattaagcaggagtaaacatttattgccaagttgcttcttataaatttgtgtttatttatattctccaaatagtgtgtgagggtgtccttttcagttcccctataagatttgtttttgcacattttttttaacacttccaaaaccccagggataagaagtgagacagggttcagattgctacagtctcttggaagggaagagggtgatgccactgatgtggtcactgaagctttccatctgctcttctataagtacagaggcaggcaggctgcgcagaaggccagggagacagatgccaagtacggtttagaggggaagttgtgaagggatcataaaccctggcaactgccctgtgaccacctctacttcccagttaagaagtactggtatggagcatttccaaagttcccttctttggcagtttctcaaatgtcatgttatatctctaaagaaattttcacaaataaaggggttcttctgagtcaccaaaaggtcaattttaatttaaataatgctttctttagtcgagtagttctgttgtaattcatttgttcattttaacaactaagtatttattgagggccttctctatacttagccccagtgctggacgatagcaacacaaaagaagcatttcccttcctccaggacttgataatctagttgtgaagaataagaaatatacacatgaaaaatacaaccaagaatgcaaagtatccgtaattaagtgccctaatgaaggctaactacagttgattagtggtttggagtaatgaagattttctcataaaaatgggttaggactaagatgattagaaatgaaagatttgctttagatagcgttccctttgaaaaacctcacctcaggggtagtcgagcagattttgctggctcccacaaacttttttagcatggcaagtctccaggtttccgaggggcctgttttactgatgcatatctcagagctatacctgggctttccttctgtaatgctgagtagtttaattactcttggtgtagtagtgaagaaaagagacttgggagattaactctttgctaacatttttacacatgtacttgcatttaaaccaagaagtgactaagtaaactttgggattcaataatgctgtaatatcaactgtactgtctctgtgttaatttttaaattttctttatgtgggatttcagattcatggaaacagctattctcataaagtggacatcttttctttaggcctgattctatttgaattgctgtatccattcagcactcagatggagagagtcagggtaagtaccctccctactcaaaaaaaaagtttcaaacagaaaataatctaacatttacaaaagagttttttaaagacttagttcttcttaataccagcagattggttaactaaaagtgaaagaggtgatgtgagtaacacagagaggagttctagactatttgcttccatttaaagctcagtcttcaaaaacttgtttggttagattgtttgttcttagtttttgcttaaattcatcataatttaacaatgttttgcactcagtaagtttgttataagtaaaaatctaggggaaccacaaggtaatgggggccacacactcatatatttaaaagctggcagattaagcataattaggtttctttcctctcaaaataaaccatgaccacagcctttaaagcagatagtactgaaagtcttttttttttctcaaggcaaggtcttgctctgtcgctcaggctggagtgcagtggtgtgatcacagctcgctgcagcctcaacctcctgggctcaagccatcctcccatctcagtctccccagtagctgggaccacaggcacgtgccactatgcctggctaattttattttattcattttgtagaaatgggctctgcctatgttgtctaggctggtctcaaactcctgggctcaagtgatcctcctgccttggcctcccaaagtgctgggattatagggatgactgaaagtcattttaaagtagccctctgggccgggtgcagtggctcacgcctgtaatcccagcagtttgggaggctgaggcaggtggatcatgaggtcaagagatcaagatcatcctggctaacacggtaaaaccccatctctgctaaaaatacaaaaaattagccgggcatggtggcacgtgcctgtagtcccagctactctggaggctgaggcaggagaatggtgtgaacccgggaggcggagcttgcattgagcagagatcgcgccactgcactccagcctgggtgacagagtgagactctgtctcgaaaaaaaaaaaaaaagtagccctctggccaggcatggtggctcacacctctaatcccaacactttgggaggctcaagcaggaagatcacttgaggccagagttcaacaccagcctgggcaacatagtaagaccccatctctacaaaaaatttaaaaattagcaaggcatggtagcacatgccttgagaggctaaggcaggaagatcactatgattgtgccactgcactccagcctgggcgacacagcaagaccctgtctctgaaaataaagtgggcctctgtcacattcttccctatctttcataagtagctaccctcacctcttctagttgttgtccctggtacttatctccatattttcaaagtttaggctcttgtcactatttcttattttatcagttttagatcttacttattgatctctggccatggtagaagaggatgtagttctcacatagagcaaaatgactcatatcttctaaccgaaaggacctaccaaatgttctgtacaatgaatgaaaaaaaaaaaaaaacagtcaaaataaccattttcagaacaccagaaataaaggccctaaaagcttccagaaaggaaaataaaacaggtctaacctaagtaaaggatcaagaatcagatggcatcaaaatttatatagttataaatgcctcagagaatactgtcaagaaagtgaaaagacaaggtggacgtggtagcacatgcctgtagtcccagctacgtgggaagcttgaggcaaaaggaattccttgagaccaggagttcacggctacagtaagctatgattatgcctgcaaatagcctgggcaccatgagaccctatctctaaataaattaattaaatgaaatagaaagtgaaaaggcagctcacagaatgggagaaaatatttgtaaatcctatatccgaaaagtgtctagaattcagaatacataaagaactattacaactcaacaaaaagacaactcattttaaaaaggggcaaagcaatagaactttctccaaagaggataaacaaatggccaataagcatgtgaaaagatgctcaacatcgttgggcattagggaaatgcaaatcaaaaccacaatgagataccacttcagcaccatctagggtatctgtaataaaaaaattaaaaaaaaaggaaatgtcaagtgttggctaggatgtggagaaattggaaccctcatacgttgctggtggaatgtaaaatggtgcagctgctttggaaaacagtctggcagttccttaaacagttaaacatagaattaccatagaatccagtaattctactcctaggtatgtactcaagggaaatgaaaacatagacaaaagcttgtatacaactgttcatatgagcattatttctaatatccaaaagtagaaaccaccaaaatgctcatcagctgatgaatggaaaaacaaagtgtggtattttatacaatgaaaagtattcaaccattacaaggaaggaaatactaacatgtgccgcaacgtagatgaatcttgaaaacatgctgagtgaaaaaagccagacacaaaagtccacttttatatcattcagtttttatgaaatattcagaagaggcaactccatagaaacaaagatttccaatattttctttgtgctttaatatggccctttctctctctctctctcccctttctctttctccctccctccacacatacatatatacacatatatgtaaatgtacatacacacacacacacacacacacacacacacacagtcatcttggtatccacaggggattggttccaggactccctgtggataccaaatctgcagatgctcaagtcccttatataaaatggtgtaatatttgtatagaacctacatatattctgtgtattttaaatcttctgtaaattacagtacctaacataatgtaaattctatgtaaataagtattatactgtattgatgagggaataatgacaagaaaaaaatctgtatctgtccagtacagatgcaaccatctatttttaaattttttaaatattttcattctgtggttggttgaatccttggatgtggaatctgtggatgtggaagaccagctgtatattttgaggatatttgatggagtgtacatctgtgctcaggaaacatatgtagttattaaatcaggaaaagctattgataaattttccatttgatagatgtacaacctcttagtcattttgttagagtatcaaaaaatattttcatgttgtatgtcaaaataaacttaataagtgatactttttttctttttagaccttaactgatgtaagaaatctcaaatttccaccattatttactcagaaatatccttgtgaggtatgtgtaattctcatcttttatcttctttagaatcatctttagaacgtaagcggtccttagcagtcgactcagtttcccctattttacagatgaggaagccaaaggtctagagaggaaagagacctgctcccaagagcccagaatttgttaaaaccaaacactggagctggggcctggctccttcagcctaatgtccagtgttccacactgtagcacctgtgaaatttatatattgataaatcttgaatttccttaagtaattaagttgaagtgagttagtatgtgttcattttcaaattggaaaaagtcaaaatttatctttcagtattataatgaagggttgcattaaaaaatggactttataacaatatattaatacctacatatacttaagtctgttttactaaaaattgtcatcatgtattttgcaaacttgatgaatctattcccagggtggctcataagagtacatgttacgttcaaagagatttttaaaaaccaagaaaaggtgttggttgctgatctctgccataattttttctaattaaaatttctattgagataattgtagatttacatgcaattataagatgatttttaaaaatcatatttatgtttcagggatgtgattaaataatcctttataatgtgttagaaaatcaaattacccaaaaattgtccatgtttttttggaatgagggttggcaaactagtgcccacaggtcaaatccagcctgccacctatttttataataaagttctattggaacacagccatgcccattaatttacaaattgtctctggatgcttttgtgcattgacggcagagctgagtagttgtatcagagacttgaaaactcgaatatggctcaaaagcttaaaatatgtacagaaatattttgccagcactgattttaaaaactgtacagtgatcaaacctggccgttttatcacaaaacaatttttatattttcagtacgtgatggttcaagacatgctctctccatcccccatggaacgacctgaagctataaacatcattgaaaatgctgtatttgaggacttggactttccaggaaaaacagtgctcagacagaggtctcgctccttgagttcatcgggaacaaaacattcaagacagtccaacaactcccatagccctttgccaagcaattagccttaagttgtgctagcaaccctaataggtgatgcagataatagcctacttcttagaatatgcctgtccaaaattgcagacttgaaaagtttgttcttcgctcaatttttttgtggactactttttttatatcaaatttaagctggatttgggggcataacctaatttgagccaactcctgagttttgctatacttaaggaaagggctatctttgttctttgttagtctcttgaaactggctgctggccaagctttatagccctcaccatttgcctaaggaggtagcagcaatccctaatatatatatatagtgagaactaaaatggatatatttttataatgcagaagaaggaaagtccccctgtgtggtaactgtattgttctagaaatatgctttctagagatatgatgattttgaaactgatttctagaaaaagctgactccatttttgtccctggcgggtaaattaggaatctgcactattttggaggacaagtagcacaaactgtataacggtttatgtccgtagttttatagtcctatttgtagcattcaatagctttattccttagatggttctagggtgggtttacagctttttgtacttttacctccaataaagggaaaatgaagctttttatgtaaattggttgaaaggtctagttttgggaggaaaaaagccgtagtaagaaatggatcatatatattacaactaacttcttcaactatggactttttaagcctaatgaaatcttaagtgtcttatatgtaatcctgtaggttggtacttcccccaaactgattataggtaacagtttaatcatctcacttgctaacatgtttttatttttcactgtaaatatgtttatgttttatttataaaaattctgaaatcaatccatttgggttggtggtgtacagaacacacttaagtgtgttaacttgtgacttctttcaagtctaaatgatttaataaaactttttttaaattaa

SEQ ID NO: 204 - DNA, 91678 bp, Homo sapiens
  source 1..91678: mol_type = genomic DNA
gttcattccaagcggaagtgatggctggtggatatgacttgaggggaattcctgagggcaaggaaaaggaagaaaggggccccagagaagacgaggcacagctggagaaccctagggctgtgaacactgcgactgccgcgcggggcagctgcgccgtgtttgctggaagcctccggtagctgctgaaaccttcgctccggaggtcgcctcggtaaaccttgcggatgattccaccacggcggaaagacgaaaaggaggcttctaggcacccgggaccgcccgtgtcccgcccttttccccgatgaagtctgacgcggcaggtccctcggcagggttaatgggacggcctggtggggcattgccggtctttcccagccacagacaagcttcgcgcctcgatcccccagcgcccccagacgctggatgccgaggcctggtcctttacagccgccgacgcctcatgagcgaagccagccagatgccagcaccgccttcggccccgccccgagccagcccctcccacatccccgcccggggcacgccctcggcccgcccccatctccgccccgaacacgcccctagattggccccgccccgtccccgcccgcaactccgccccgaccggaagaagccgcggcacccagcgcttatagggccgggaatgggggtgccgccgctgcctagtcagttctgcgtccgctgaggctcggtcaccgcctcgctgtcgtcgcggcgcccccgccccgtcctctgtccgtaccgcccccggagccagggccgagtcctcgccatgccggcccggcggctgctgctgctgctgacgctgctgctgcccggcctcggggtgagtgaccggggagcgtggggtggaggacagctcgcgacggccgggtcggggccggggcagcgtcgcggcgccggggctggagtccgagctgggagcgcgacggcggcggccagatgccccgtgagcccagccgtgggaggctcgggccgggcgtaggaggcggcaccgggccgggagagcttccctgacgggagtcgcggccccaccgaggcgtcggccgcccgaagagcctcccaagccagcgcggctgtcacgggcagcggctccccggaccccgcgggctcgggcgcaacttcgtggcgtcctgcacggcacttgggggtcccagaaggccccggcctgaggaggccgcccacctgcgggaccctcctcctcgcgggcgggcgccggcgctgcctggcgggggccgcggaggagccgaaagggcgttgggatccaggggaagggtctgtcctgcgcttcgaatccttgtttgaactttttaaaaattcgaaaactttggggaacgaatgcaacagggagtaaggactctcacccgagagctggcttctgccacttgccctgccggtttcttggtactgggaggctgcaggcttccttctgtgcaccgagacttccttgagcaagtggagctgtgggaattgcactcttggaagatcccgcatgggttcgaggtgaggccgcttcagaacctcaaatgaaagactgtctcctcgtgggagagcacctggggccatcagaaatgtcttttcatctttttctggaggagacgaatgatagggcctggtttacattcatttaactctttatgaccttcactcagctgtggatttgggggcactttgtgggagacttggcttttttttttcttctggttggaagaacctaaattagcgaatgtttttcacaaaatgtattgttcaggatgtgagcgtggcaaatttgtccgtgttctgtttaatgacctctttaaaggtactgtgtactctttaatagggatatcatgtaccaggtgtcccagtagagcactgacatgtgtgtgcctgagtgccagccaccgtgtgaactctttggaggttttgcattttaggtaaataactgtctgtactcttggagtaacaagaatttggaaacaggagaagtaaataaataaggttgcctttttcaaattcagggtttttttttttaaataaaggaaaatttgtagactctttataatagaacttgtggaagttaagtttttctttcaaataaaaaccccacttttacaactaaggtcaggttttgaacttgagcacctcaccttggattggtaactactgcctggcatctgttcacaaacgaaggtataagcagaatgaccaaatgtttgacatgaattcgatcatttcataacgtcaagggataggtgtataatggtttcctttgccacatctttccttttgctactttgtcactggattctagtgtttggttattgaataacttaggctaaagagccaaaaataacgatttagctgtagttggaactatagtttcagttcgtgtaaatatttccaatttgtatttagaaatccaaacttctcagagttcatgataaaatattccagacccttatcaaaaggttatagtttagcgtaactatatttaggtgaaaggtcaggccgggcccggtggctcatgcctgtaatcccagcactttgggaggctgaggtgggtggatcacttgaggtcaggagtttgagaccagcctggccaacatggtgaaaccttgtctctactaaacatacaaaaaaaaaaaaaaaaaaaaattagccgggcgtggtagcgcaggcctgtaatcccagctactggggaggctgaggcaggagaatcacccgaacctgggaggcagaggttgcagagatggagtcactgtgctccagcctgggtgacagagcaagactctgtctcaaaaaaaaaaaagaaaggtcagaatttcactcctagaattttctcccaagggtttttacccccaaacatagtaagaattattattttaaaattgtaaatgaaactcatagcaaagtttgcagttaaaccaggcaacagtgatgtgcagaacgcagtgggtataaaatcagacaaacctgagttctaactggtcacttgctagctgtgccctaggcatattcttttactactactactactacttctttttttttttttttttgatatggagtttcttcgctcttgttgcccaggctggagtgcaatggtgtggtctcagctcactgcaacctccgcctcccgggttcaagcgattctcctgcctcagcctcccgagtagctgggattacaggagcccaccactacacccggctaatttttgtatttttagtagagacgtggtttcaccatgttggccaggttggtctcgaactcctgacctcaagtgatccacccaccttggccttccaaaatgctgggattacaggcatgagccaccgcacccggccatgattttacttcttagagactccttcctgataggtgaaatggggacagctaacatgtgaaagaaggcaccaccttcacacgtgcttaatagataataaatgtaaattctctttatgctccaaagatgctttttactctaagccatcattttttgaatgttatactatgcctctgcaagaaatagtttttgatatttctttttgattgatgtagtaactattgcattggaggcaatactgtgattttctttcagtgtgtgtcttattgagccagacattgactcattatgagttgagactttaggctaccagatccaaaacgcaataacattggtattattaagcacttgaggctgtcttttgttaatccagaatgtgcttatttagtcagtgagtttttcctttcttcctagacctatatcttgctcctagagttggttagggttacatcatcactgtcagcagtcctcattttatggttatttaggtgccacatctctcaattaccaaagagatcagtacaatgtgaggcaaagtacctttttttttaaaagctataagatatcagatttctttcatttagccaatattttggttttagagggaggtttttaaaaagtcaccgagaactgaggatcatgtgtgtatagaaacactgtaatctgatagatgagtcttaactagcaatgtctttgcttatcatttattctgacagtgatcacctgcattaattatcctaataggcgatatcaagtgtttatactgaggccataagtagaatgttcattgagtttgttatcagggctgctgatcatgaaattaaactgtagttgtgcacatgtgtattgtttcattaacttgcctgcctattcagccttctgcagtaatgtagcttctcagagcacaggagaaaaatgtatctgagagttattcgagagagagttcaacaatagcccatatttccgaacataaatctagtgagccgcattaaagtttcttcatgtctggatggaatagtgtcacttgcataggtctgagggtttcattatttgcctgccccagatttggactccgtttttcaggtgaaagaatccttggataactgtttcattttcataggaaacctctttggtttcgggatccaaagtaatatgtaggttcaatattttgtaggttttataatcaaatgtctccctaaagagatgacatagggaagaaaagcctaatgtatcatcttaatggattcagtttttattatgcacaaataactgggcttgtaacctaggaatatgattagagcgtgatgctggcttaaaaaataggactggtgaatcacagtttgtgaataataaactactggttggaaatatttcccagaagcagttttttttttcctttctatctttacctatatcccatgtttggtttcaaacttccctgccttagagcaacacagctggttttagacagtctttctatcaatatcttataatctttgctcatgtacaaacatacagcaaatacaacggtataaaaatacgatgttatctatttttgttcactttttccccacagaacatcttctgtaacccggtagaaaatgttctgagtacaccatcacatttgtcactttagtagcaccttagtaaaccatcatccatgtaaaaaaacattgagcttctcagccgggcttggtggtttgcgcctgtaatcccagcactttaggaggccaaggcgggtgaatcacttgaggtcaggcgttcgagagcagcctggccaacatggcaaaactccgtctgtactaaaaatacaaaaattagctgggcaaggtggcatgcacctgtaatcccagctactcgggaggccgaggcaggagaatcgcttgaacctgggaggtagaggttgcagtgagctgagatcacaccactgcactgcagccttggcaacagagcgagactctgtctcaaaaagaaaaacaaaaaacaaaaaacattgagcttctgtgcccagccgtgggttggggactggggttataactgatcagggttgatgtggtaataagccgagctttgcctgccagtcatcttgctgtggccatagggatcataaagaaaggggtattttcattttttcaattattttatgtttggtgctttctgtatgataacaggggaagatatttttttttgaggcattatctcaaagtaatcatattcattgtagaaaagttagaaaggatagataagcctaaattaaaaaataaaaaacaagccttctattatcttattttccaaacattacctctatgaagattttaaacaattttattgagatataattcacctatcatcacaattcacccatttaaagtgtacaattcggtgggttttagtatattgacagaattctgcagtcatcaccacagtccattttagaacattttcatcatcccagaaataaacttcatacctattagctgttacacaccgtttccccccaaacctcctagtccttggcaaccacaaatctactttctgtctataaatttgcctattctggacctcttatataaatggaatcatacattatgtggtcttttgtaactggcctctttaacttagcatcatgttctcaaggttcatccatgttgtataataacatgtgtcagtactttgttcctttttattgctgaataatattccattatatgaatataccacattttatttatccattgtattagtccattttcatgctgctgataaagacatacccgagactgggcaatttacaaaagaagtaggtttaatggacttacagttccacgtggctggggaggcctcacaatcatgaaaaaaggtaaggaggagcaagtcacatcttacgttgatggcagcagggaaagagagagcttgtgcagggagcttcccatttttaataccatcaaatctcgtgagacttattcactatcacaagaacagcacgggaaagacccatccccatgattcagttgtctcccacggggtccctccaacagcacatgggaatagtgggagctacaagatgagatttgggtggggacacagagccaaaccatatcatccatccattgagggacatttggattgtttctgctttgggactattaataattctgccatgaacatttgtgtacaaatttttgcgtggacatttattttcactcttcttgggcatatatctaggaaagagattgttgggtcatatggtaactctttgtttaacctttcaaggaactgtctgactgttttccaaggcagctgcactattttacattcccacctgcaatgtaggaaggagggttacagtgtctcttataccctcactgatactcgttattacctatctttttaatcttagccatcctggtggatgtggagtggtaactcattatagctttgatttgcatttctctaataactaatctaatatcttgacatatgttctttcagatgctttttctgtgcacatatttacaggtaatacttttcttccccacactggaacatatagatctatgtcaatcagcttaattctgcaacattattcttaattggctgcgtagtatttctctgaatggaatggatgtaccataatttgaccactcaatcatttagatattgaggctgtttttatttttttttattttttcactacacagatatgtttttattttcattataaaaattataacaatgtaatgaactttcttgttgctaaactcttgaatgagttttaagtgcttagttatttcctggagatagattcctagaattgaaatttgctgattgtatgtagtattttacagccctctcccccagccctaagcaatgttgagtgttttaaaaacaaaactaaccttaaattgtttttatgataggcggtttaaagtatgctattttcttttatcagtggccactttcttttaggagcgtagactttaaaagttggatgaaaatagaatgtttacattttgtttatattttgaagatgtaaataaaccaaggcagtctctggatgataccctttgtacctaaaagctattgagaaaatgttttatttggatttgttaaatgactcatttgtggggtcctttagtttgcagtggtttcagatcaactttctaggagatgtggcacccatgagcaccctgaaatacctcgggataattctctggttttgagggtggcccgcctcctacagataagattctttgtatggtcggttgtgaggccatttaaaacttttgccttaagacttcataaatcagagttgatacattgattgtcccttttggaggctgcagttcttaaaacatgtggctgtttttcctaggaatatttaagtaccacttgataataaagtactaccttttgctgggattatctacctggaaaaaaaaagggaacaaaaaattaaaaataaaatgtaatatctgtggtgttttattttttgttttgttttgcttttcctgcaaatttattcttccaaaaaaaatgtccctttcaaaataatcaccctttggcgtgaatttacgggttattgaaatcagtcttaaaaaaatttccagttaaatttaacaacttatctaacccatttaataattcaactttaaaacaaaaacgaacctttgaaaacaaatatttactcttaagccagttatccttatacaagttaaaacattctccaattccttccagtctttgcttaataggacttttacatgattcacactacacttttgatcaaaattgttattacccagtttgatcacacaatttattgaggacacttggatttggttttcagctatttattaaaatgaaatccatcctaaagtgaacaggatttttaccatttaggggattcaaaagtatattctttgaagggaatttccaaagaattccagaaatattttgagccctagaagcatgtatgaatagatgtgtagcctcccaagataactggaatcagagtgcattagactgcttgatgggctctcggccatgtagtccaatgagtctcaattttttccccttccagctgcacataagaaatatggcgcacatccctcagtaacagtatgagcacatcagaacctaggagggtggtgtttggggcaccctctctcaggcattaccctcctctcccaagctgagaaaaattactaccctgctctgtcttccagagcagacagatgggaaaaggcaaccagcaagggctggtaacctgtccagggtcatgtgtgagtggcagaaccaaaccttaaacttgatcctcctacctccctttgaagagaagcccctgcagtgcttatgttctggtgcgtatgttgggacaaaccagtctggctaccctcagtcataccctgaggagctgaccaaactatgtggccatgagagaaggatctagagaaggtctaggccagtaggctttcttgtaagcttcaggaaaatacccagataatgttatttttcctccgttaagaatcatggccttctaccctttgttgcagttgtgcgaagatgccattttgagatgggaatgctgccttcacctgagagtctccatcaaggaaattggccattttcaactgtagagtcaaatccagcaatcatggagagagtagggattaaaagcctgctcggctgggcacagtggctcacgcctgtaattccagcacttcaggaagctgaggcgggcggatcataaggtcaggagttcaagaccagcctggccaacatggtgaaaccccatctctacaaaaatacaaaaattagccaggcatggtggcgggcacctgtaatcccagctactcatgaggctgaggcagaagaatcgcttgaacctgggaggcggaggttgcagtgagctgagatcctgccattgcactccagcctgggcaacagagactccgtctcaacaacaacaacaaaaaattgcctgctaagcctaattcacagtttaagctaatttctttgcttggagtctaataatatccaagcaggtgcatgttttcagtaacatctcgcctagtcatatgtctgaaagaacaaaactgaaagttctttccttagaggcctttaacccaagccgctcttctctagctcagtcacagccttcaccaagaagtcctgaaaagatagaactcttgcattaccgtgctggttctgggtgtttgcctttgcagaggcgccacctgccaagcagttctggcaccagggagcaggtctgtgatgacaggagagagacagtggctgtgactctggctcttaaaccacaatggagggattcaagttagcttaggtagctctcagaggagactaatgagggaaggaaggagcaaggggggaaggaaggtgcccctgggagtgtgtctcacttcccttgctggttcatccgagaaggcagggaccctggcttgctgatggttgcatcctctgtggcatttaacgtggcatgctggttatacccactgtagggggcactcagcaaatatttattgaattcttctttgagactcattaagaccaataaaggggctgtattatatcatcaagcaagtgggttgtggatgggggtgggaggtattgcttcagctatattttatattctttaatgggattgcaccagttgtgtgtctttctacagaactagaggagctttcaggatatttgcttgggtggacgtgacccatagtgtgtagtgttcttttggtgggctcttcttatcagtaatgagattaatttttccattgccaaactccatgaggtaaacagtttgtgattatttcatgtcagtttcatttttcactcagcatgatgtttcactgttaaaaaaatgaaccttggcccagagttgtcctctcatgtattaaacatgacttcctttgttagtagactaatttataattataattcaaaaccatcccattctccagtggattatttcccccctctctgtcagatgaaggaataattgtttgtctgggctgcaggagtgtctgtcatggaaaccgaatttttctgtacattctctgaacaaacagtgctgtcacatccctagaacctgacattgtcattgatctccagttgagtcagagaagtttgttgaccaaggtaaatcagatctctcttctcttaaagcaaatggcccatgactcctgaggggccactaggagtgagagaatcacctgtacagggggccacaactgtggctaggaatgtgttacttgaggcggtgcttcccagccatgactcagtcacctggggagctttttaaaaacgctgtgctggggccccatcctatgtgaatgaaattggaatctctgggagtgggggccggcatcttttcttttttaaaaaaaaaatgtttaaggccaggctcagtggcttacacctgtaatcccagcactttgggaggccaagacaagaggatcacttgaagtcaggagtttgagaccagactgggcaacaatgaaagaccccatctctaccaaataaaccagcaaaaaatgttttaaggcccaagtgactctgatgtgcagccaggatgaggccttcaagtaatttttgtaccttaatcctggaaagaacaaatgcatctccaaattcccagtcacgtcacagagcacgggaccagactagacacagcatttggctcattttacagagaggttaggattgatagagtccgctagttagtgttagaactagaaataaagttctaactttatttctagttctaggcgtggtggctcatgcctgtaatcccagcactttgggaggctgagacgggcggatcatctgaggtcaggagttggagatcagcctggccaacatggtgaaaccccgtctctactaaaaaaatgacaaaaattagccaggcgtggtggcgcgtgcctgtaatcccagctgcttgggaggctgaggcaggagaattgcttgaacccaggaggcagaggttgcagtgagccaagatcccaccactgcactccagcctggggaacaagagtgaaactcaatctcaaaaaaaaaaaaaaaaaaaaaaaaaaaaacctagaaaaaaaggaacctaatattacattttctctactgtactatatcattcaacttttaaagagcaggtaatttaatggattttttcctttgaatacaaactgttgaaattgcttttatcagctttaactaataggccttatattaaaacatatttagttactgaattgtaagatgtttaaatgtttatttaaagttacccgacttatgcttgtttatttatttatatatttgtttattgccttttccatatattaagaggcttaagaaatcaaaacaatgttgttttccaggctccttcacagtatcctgatgggtaaaatcatcttcatggttttaaaagaaccttccataacaaaaatgaaatagccattgcgagtgaggagaagggatttgtagaaggagtgagttagttaaagcacaagaagaagcttgtgaaccaacaggaactttcctatcagggtgggaacatatgttttggaagcaaatggtgggagggtgcaggctgtgacactcccttccccttttcatgtgagagctggctattagcctcattgcctgagtcaggcagagttccctcgaagggtttttatagcaggtgccgagctgacaagcccaactgtagaacacaggagaggaccagtcagttgtctcagctcccggacccatctcagttgtttctcagaggatctttattagctggtttagaaacaggaggacacttgctttcaagcatcacattgagtgggctggaccaaatccaaaactctgctggaaccaagttgacaaatgtcagtagaattgggagcccgctctttgaatacaaccttggaatggggcttggcacctggcctgaaagcgctgtgtggactccagcaccagggctgtttcctaatttaacttaatgcttaaaggaaatcccaagtggcagaccagttctgcactccttgagcagataggcatttagctgtttttaaatgtaaaatcattttagctgtttttaaatgtaatcatagggccagtatcttgtttctatatgtgtgtttgccccatatgatgaaattgtatgcattctttcagcaagtgagagtccggaggttctgtactagctagctgtgcaactttgggcaaatgagttatttccccctctgcttcctcatctgtaaaacaaagcaacggaaccagaaaatctctttggtgggcctgtttccaaatgtcttcccaaattaggatcaccatttaggtgaaagcgactagtcccccagccgcctctttttctggtgcagcctcatacggggaggtagaagatgggagggctgctttgctttgagcctcccagcttcctagctcttgaatgtagtgaatttcatctgttcatccatttatttatcaactttttgagtacatattttatgccaagcactgtttgagatgcttgggaaacatgaacaaaacaaagacccccgccctcatggaacttctacctagttggttgggatagacaacagcatggtaaatacattatatagaatgtgataaggtgataaaattctgcaggggttgcaggggagaaacatagagcagagcaagggagatggaggcctcgtaagttgccacacaccgtggtgtggtttcatcggctctcgctcacctgtcttgtatagggcctagggccttccctgaccactgtactctcgtagactagatcccttcctgcactccaaatagcaccacgtcacttagtgttggggtaatgtacaggttggtgctcctgtttgtttcttgtctaatcttctggaggactggtgttgatagtcctcaggtatgtctgaaaatcctgagcaaatatgagggactgagcgtgaacattgttgatttttctttactttctatttcttttttcttttctttttctttttctttctttttttttgagatagagtctcactgtgtcgcccacactggagtgcagtggcgtgattttggcttactgcaacctccgcctcccgggttcaagtgattttcgtgcttcagcctcccgagtagctgggattacagccatgtgccaatacgcccagctaatttttgtatttttagtagagacggggtttcgccatgttgcccaggtgagtctcaaactcctggcctcaagtgatccacctgctttggcctcccaaagtgctggggttacaggcatgagccactgcgcctggccacattgttgatttttttaaaaatttttattatttatttattttttgagatggaatctcactctgtcgttgaggctggagtgagggcagtggcatgatctctgctcactgcaagctccgcctcccgggttcacaccattctcctgcctcagcctcccaagtagctgggaatacaggcacacgccacaacacctggctttttttttttttttttgtatttttagtaaagacagggtttcaccgtgttagccaggatggtctcaatctccggaccttgtgatccgcccacctcggcctcccaaagtgctgggattacaggcatgagccaccgctcccggccacgttgttgatttttaaggataacatgataagacattaaatcctgtcagggaaacctcagaaaacccccacaactcagaggggtcagaaccagccattctttgatttttgtgatggctgtgcacccaaatacacaaatgggtgtgtttgtgtgtgtgtgtgtgtgtgttattttttttttacattaaataagattacattttttttccattgtaggagtatttgtaacatctcccgataaattgaaatgcggtaagaaagttctaagaacaaatttggggaatctctgacctttaaaggtactacctcattatgagcaatccagtgaccttattctagaattctgttagggttcgttttccacttgccatgagctggttttgcaaagaagaaaacggtttcctttatatgtggagattaagaacaagtttatctgtagttttggtgctcgactaactgggaaccaagccacagttgcttgtaaaacggaccctaagttatcttgatcttgatggttcagtgcttggaaatctctggggctttcggtgcctggtaaaagttcaatcacttatctgatttgtggttggcagaagaaaaggtatcaccctttcagtttaggagatggttgcttttagagtctatagtaggtaggtgtgcctgggaatcagccacctggtcccatgtaacattagttgattttcatggtatttcttttccccatcctgaaccttaaagtgagtcagattattactaatttctaatgttgcaatattttgagataagcggagacacttagatgttgcaagaccaggattggaaatgactatgttcaaaggcattaggacttctaaactctgtcaaattgttatgcggattttgggcatgttttgattggttggggctagaagaagctgcagcaaagcctgaggagagatgagggtctggtaagtcatggatcatcatgcttcagagctgcagccaccatccacctcaggcttcttactttcttggaaacccatgcctggaaaaatctaatgacttgcccagagctcaaaccagaccatgcatctgtgtgcccacctcatcttctgtcagcttcattcaccccaaaagcatctatatgttccagactcatgaggatacctgaggaactttggttttgtttttaaaccaaagagttttgagaggataaaataacaggttttgaagctatatggacacaggctagggcaaggagtgagaagacagctgagcagggtagggtgggaccagactcttggaactgctctgggcaggacctggatatgctgccaagtcagctttcgggaagttcggccatggaacttgccgtctttttttctgcattacacgactctcctgctagacggcaaaccccttgaagccaggagttttacaggccttggggcggcattgccttgtgtgtaacaggacccttctttctgcatatatgtaggataagagtccagcttaggggcagggttggagtaagtgaactagcacacaggagttgaaatagaagagtcagccaacaggaagaagtatgaggcagggagtgcctggaagagattggcaaatcctgaagtccttgccagcctacttgagtaatgtgagaccatgagccaatgacttaccttgtcctgtaagtttagtatccccaagatttctgcctcttgtaatgaaaatagtcctggcactgactgcaggtactgtggagatggggcgcctggaagattaaaaagacgggaaggtgcaggtttaactcctcaacccttcagagggagctttctgattccatgcatgatggctagtcagagaaatggctccccctcaaatgaggagtcttaggaagcaagaaaacctgccttggggtttgttctgaaggccacatttcatcacaaaaacagccatatttactacgctctcctacgaagttctgatgtgttctgctaatattcagctgtaaaccagctaggcaacatcagtcgaatgttagtataaattaaaacactggaggagactcaccgagagtgtgaacagattgtggttggtgtattacacgcctcaccttagggagagtgcttttttttcttccaggtggctttacaacgatgtgaacagcaaccttcctgttctttccttcagctgcatagataacaaataagacacgtaaaaaaaagattctgactcttgtggcccacgccattctgggacttctcccccaacctcaccgtgtcccatatcccctctgccttctctgtccagctacactggtccaccgggtcctcaaacacaacaaattctctgcagtctcagaattttgcataggctattccctctgcccaggaaattcttctttccttctccctttcctatagatcttaactcaaacatcatttttaacactgtgcttcccccaccatcacaagaccagatgctcttcttctgttatgctgtcgcagtttccagtatgtccctttcatggcacttactacaatttgtcattttatgtttgtgtcattattgattactggggtctcctattggactgtaagctccatgaaagcaggaaaccagatctcatttgttgtgattagatcctagtgtctcatacagttcttaatgaataatagtaactgacacttacatgatgcttactgtatattaggcccgttcaagagctttacttatgttgactcaacactccttgcaaaagcttttttttttttttttttagcatttaccttcttattacagtctttgaaagcccatggaattattctagggacacagaggactttgtggcatagatttaggtaaaggtcaccgggcacggtggttcacgccggtaatcccagcactttgggaggccgaggtgggtggatcacaaggtcaggagttcaagaccagcctggccaagatggtgaaacccccatctctactgaaaatacaaaaattagccgggcatggtggtgggcgcctgtaatcccagctactcgggaggctgaggcagagaattgcttgaacccaggaggtgaaggttgcagtgggccgagatcacgccactgcactccagcctgggcgacagagtgagactctgtctccaaaacaaaacaaaacaaaaaaattgcctggcggcatggtgactcgtgcctataatcccagctactccagaggctgaggcgggaaaattgctggaacctgggaggcagaggttgcagtgagccgggatcacgccactgcactccagcctgggtgacagagcgagactctgtctcaaaaaaaaaaaaagatttacgtaaagggcaaaatgctctggaaaaataaagtgttagataccagggagatttggccatagctggaaatgtttaactctgcgaatacttggagccactaattatgtatacttgttttattcataatttgtaatggtctaggatagcaaaagtaatgtgaatcatggttgaatttaataaaatgtttttaacctcatcctaaaatatccactgatccatctcattcaatggcaatatgcagtggttaagggaacataaaaacaaacatccacacagctgcacagttctcatgaaagtctatctcattattggtgggggtagcacatttaacagcttaaacatataggtcactgcatgatgccgcactggtaactagatagccagggaaccaactaaccagtaactgttaaaatatttaaaatacagcttttgtttagatcatcctttggatcaccttcttgggaaaaaagcctgctagtcacagtggaaatatattaaggcccgatcttctgatatccattcccagaggtttctttcagctagattaagcctccacctccagagcacacccaagtttgtgatctccagcattgatgatctcttgtctaccagagcagacagtgtgagcctcacaccaggcctcagagtctgtgtgtagcccactccaattagactagagttggtgacttttgcatttactggtttatgataaaggatacagatgaagagacgcatagggcaaggcatgcgggaaggggcatggagatctcatgcccttggggtatgccccacccatcaggaatctccatgtgttcagctgtgcagaagcttttcccaacaactttttaaagttaattagcattatccccattttatggatgagaaactgaaggcacagagaggtaagtgattgcctgaggtggtctggctccacaatctacctttttaacaaccacattatactgctcaggaactacactgaacttaacaagtatctattgaatcgtttagccgcagcatcataggtgagtttccaaatgatggaaatacaatcccataacttaaaatatagtaatgtttactgacaacctcctcagcagttatactctgcttccttcttcttcttctttttttttttttttgagacagagtctcggtctgtcgcccaagctggagtgcaatggtgcaatctcagctcactgcgctgtccacctcctgggttcaagtgattctcctgcctcacccactcgaggagctgggattacaagcatgtgccaccgtgtccggctaatttttgagtatttaatagagatggggttttaccacgttggctaggctggtcttgaactcctgacctcaagtgatctgcccaccttggcatcccaaagtgctgggattacaggcatgagccactgctcccggccactgcttccttcttgaacaccacgagccaaacatattttaactcttccttaattattcctgattgtctcctagcaccagttgttacattattgctgtctgcccatgagggtaagagatgaggagcaatggaggtaagagatgaggagcagtggattatcaggtttttgagtttggtttacttcctgatgatttctttggctgccaccaatttttttttaaattaaatagtctcccttaatatttgtataactcttacttttgaaattctcaatatttgttttgctttcttagtgtttagagagatgttgctattcttcagtttttaaaagaaaaaacaaatgtggaagcttagccaccttgccccacaatccagatgcccaggtccacttctgggacctagagaagatggcaataagattggatgacctggccgggcgcgatggctcatgcctgtaatcccagcactttgggaggctgaggtggatggatcacctaaagtcaggagtttgagaccagcctggctaacatggtgaaacctcgtttctactaaaaatacaaaaaattagctgggcatggtggcatgtgcctgtaatcccagctactcgggaggctgaggcaggagaatcgcttgaacccaggaggtggaggttgccgtgagccgagattgcgccattgcactccagcttagacaacaagagtcaaactctgtctcaaaaaaaaaaaaaaacattggatgacctccaggctaggcggaagcctgaccagggtagtgactttagaaagagagattcctgggaaaactgagaatgacagcagagaatatcctttataggatcattatagccattccacaatgtgtacatatatcagaacatcatgttgtataccataagtatatataaattttatatgtcaatgtaaaaaataaaaacaaacttttaaaaaatattttataatatggtcccttgtccattcctgcctgggacagccatttttcccttttcacgagggagttcttcctttgatgtctggaaaggcctcctctttgagcccataggtttgctatcttctggctggtaattctttcctgcttctgtttcctgccgaccacttgataagctggagaaagcaacgttgttcgctcttggccggttcctcatgctttgcccctttttctgagtcctgttttcgagcctcaactcggaaggtttggttgtgccagcacagtcttcccagcagtttcttgtgctttccaatctctattcaaacgtgtgaggctgcataaagatcgcttctcagagaagcctagataatagaaaacctatgctgaaattacagaaatctgatgtaatattgacatgaaaaagtcagtatcagaataggctttcttttgtgtgagcatcttattgctaccaagtgaagcagccatagcttactgtgtggggcccatcagtttatgcttggtcattaaaatgggccttacagttcaaaggagttgtcctgtgctgatcagtaatgcgcgtttccttggcactgacattaaaagaatgttggcttcatcaaaggaattggcagtggctacattatcatcgtcttcatcaaaggacattttttaaaaccattagaactgggctgttcaggagatctattatataacatggtgactatagttaataacaacatattatatacttgaaaatggctaagagagtagatttgaaatgttctcaccacaaaaaaatgataagtatgtaaggtaatggatatgttaattagcttgatgtagccattccacaatgtatacatacgtcagaacatcatgttgtacaccgtaagtatatataatttttatatgtcagtgtaaaaaataaaaacaaactttttttaaaaagactggtttgggtaagtgtgtattgtaggaatttttttatggtggttaaagctgagacctttgaccttttgttgtgttattcccattcccacccacttagatgtacagtgagatctcaggaattttcatgctgaacattttttaaagacccctccctgtataatttgcagtgccatttggtatattgggtttctatagagactctaaaaattacattttggtctcatccaaaagatccaaccctcatatcaaagtggagtgctgatcttcatctaccccagcaggattcaaagggggagcttcaggcctgaagtaatttaggctttggctctcagtgaaccgtgatttaaagtagtgaaattatagtgtggcatagtgggcaaaagggctagacggggaggcggagaccttggttccagtcctgtgtctatggttaactgtctgtggtgccctgggcaagtcacttcacctctctgagccttgatttcttttcctgtgaaatgagagggttgggtaaggtaatctcttcggtccttttcatctcaaaaattacacatcccagaagcagtaaacagtccctactggttgatctgcattgtgtggaaccgcatggacttaaaggattatccagctaattggagagaggaaggtggtatggtggcctgggccggtagagaagtgtgtgatcctcaaatcaacttcaaacaatgggggtcctggctggcagaagtcagtcaagccagatatctcaactcggggtgtatttcatagtacttcttttctagcctaaagtttggcaacatctggccagtgtaggtagcaattatgtcataaatacagttgtttgtaggtaattttaatttaactagagtatttttccactttctacttgactctcctgtctactcctctactgtcccctgcaagaaattcctaactaaatatgaagagcaaaattgacagtttcagattagttgctgttaccaggactgaaaaacttggtatgtaattaaatttttttcccttggggtttctacgtgaggacttcttttttttttctattttttttgagatggagtttccctcttgtcacccaggctggagtgcaatggtgcgatctcagctcactgcaacctctgcctcctgggttcaagtgattcttctgcctcagcctcccaagtaattgggattacaggtgcccgccaccacgcccagctaattttttgtgtttttagtagagacggggtttccccatgttgaccaggctggtcgcgaactcctgacctcaggtgatccacctgcgttggcctcccaaagtgctgggattacaggcatgagctactgcacccggccaggacttcttaatagtaggtttaactgcatatgagtagacatactcaaatggataaaatttgactttttgtaaggccaatggtgcacatacaaatttatagtctgtcaggcctgtattagtttagtttgtttaggatgtttctccattaaagtaaattagcctgatacgtttcttggttgttactagatatcagttgatgctgtttccctttagcaaagacaacaaaatagagtagtgacacctgcattctaaagctcagccactaaatgagcatgtaaccttgggtttcagttttcctaaagtgtgggatttggcttagctccccaggtatcctgagggaccttagggatttgataccaccctaagaaaaagggcttgttttcctaaccacgtcagggaaaacgatttcatgtagcaccattcatgtccagatatgtttcttcttccaatgatggcaatgtaagttgatggcagagcaaccatgaacataaacagaactgcaaatggttgaactcagacactcagcccaggccccaaaaccagtttggggggaactgtattcacctattatgaaattagcatacctttgcattcaggaatacagtggatttatgaggtacttttttttttttttaatcagatctattaaaggaggacagtagcctaaactgaagaagagtcctaactgtcttgggtggtggttaattacaccatacggcagacttgccacaaacactgaaagtttaactctctcagctgcttagtttggaaaccacacagtgctgttcagttaggccttggccttttctgcatcccagctagacacttgactcccatccaaagcaaatgtcatggttgcctttattgacttaatatcaggaaacataacagccgatagactggttagaaggaactgtatggttgatggattattgctgacctacacacaggtaaacgaagtataacagaatttggaatgatttactggtggactgaaatctttaaaacagtaagacttttgtttgtgtctatggctgatgttttaattcagttctgaatgttcttccacagacaggagactaaaagtagtgaaatatttgttactcactgttcaggtggctgtatagaaatctccatatttgggtataagtactttgctgcagtatgtgtaaatgagatgagggtcagggaacagggtttgatttgaataaaaatctgttttgtaggccagccgctcaagcctgtaatcccagcactttgagaggtgaggcgggaagattgcttgagcccaggagttcaacaccagcctgggcaacatagtaggaccccatctctacaaaaaatgaaataaaaagccaggcatagtggtgcatgcttgtagtcgcagctactcgggaggctgaggtgggagaatcgcttgagcccaggaggtcgaggctgcagtgagccatgatttgtgctgctgtactccagcctgggtgacagagcaagaccctgtctcaaagaaacaaaacaaaacaaattttttttgtatctgtcttaattaagtctttacttaacataacttcaaagatagtcctttgtgagcggagagttgagcccctcctgatcattgtgaggcttttactctgagggcttgctttaatcattgagagagttttatgtcatggacctttgcacttactgggcactgatttcagtgttctactgctttggtgaatttttgatgtctttttggccatgatcggacagtctcctactatgtgatgaaatggtattagaaagcggtactctgctggctgcctttataaagcagagaatcacaaatgcccaggctttgagtttatagtctgagacagataatattgctgcaagtagaagaattgtagacacagatgtccttgttttgaatatcctttagtgcctttcaagggtctgtgttatagaataccattttgaggtacttcttcctgttgttttgatgttactgcacaggttgagtgagagagagcttgtgtgtgtgtataagaaaccctgtaggactggtgtcctatgagagaaagagacagcgagcttgtgtgtgtgtgtgtgtgtgtgtgtgtgtgtgtgtgtgtgtgtgtgtgtaagaaaccctgtaggactggtgtcctgttatggcatgccagaaagtgtcttactggtatttcttaaaatcagctgatccatcctgtggctttcagccggttatagccagcagaataatccagtctatttgccattactcattattaacccctactttcttatccatctagacagcacccctcaccacatccacatgtgtggtggatcagccttatcttgctttttttgataggtgctttggcataggcacattcccctgtgtggcatgcccttcccacctccaagcatgattgccaaggttaataattataagctctaattccttagcacattctaatccacttgaaatcattattctacatttagcaacatgcacttttaattgttctcaagatttcatatgtcctaactgggcagtaaaacaaaatatcttggaaatctttcttatataatccttctctcacttgcataacttgtttcaagtcttacctttaatactgtaatatgtattcagtagccaactaaaaggaacccttaacgccaatttattgctttacctctgtgccaaccatccagtagatttgagtcctggcaaggaaccctgcactgcaaaaggcagcctggctgttgttggcaggttgcgggttccaggaactgaggtacacatggtattgtatgatattctattgtccttgctcaaattatgtaagtatttttagtttggaggaatggttttctttcttttttttttttttgagttggagttttgctcttgtcgcctaggctggactggagtgcaacggcaccatctcggctcactgcaacctccgcctcccaggttcaatcgattctcctgcctcagcttcccaagtagctgggattacaccatgcctggctaatttttgtatttttagtagagacagggtttcaccacgttggccaggctggtctcgaactcctgatctcaggtgatctgcccaccttggcctcccaaaatgctgggattacaggcgtgagccactgtgcccggctgttttcttaaccttaaataaataaaactaaagttgggattatgcaatataacagtaatccaatgaacacagaggactattagcaaaacaaacaaaaacacacacacacagagaaaaaaccagcctctgaacaaattctagacattggtgtgatattcctaaaacaaatttttattattagccagatgattatataaacttctggtctgttggagtggaggtgtgatgggaagaagattcatagaaaagatttttatttgaagtcttttttttattattattatttttaagcttatgcctgtaatctcagcaactcaggaggctgaggtggaaggattgcatgaggccaggagttcaagaccagactggtcaatgtagtgaaactcccgactctacaaaaaatttaaaaattggccaggctggtgtcacacacctgtagtcccagctacttggaagactgaggggagaggattgcttgagcctcaaggctgcagtgagctctgatcgctcaactgcactcccacctgggtgacaaagacctcatctcaggaaaaaagaagaaaaaagagagagggatgtacagttgggttggacttgatccatttacatgccacctgagaagtgtgtgactctcttgttcacaatcgtaggttttctgtgtgtgtgtgtgtgtacacgcctttttttttgcagggataagatgctccagttttgtaaatggagcagagattataaacctcgttaagtatagatcactggaaaactgtgggtatggaacacgtgtgcatgacactgtatcttgccattgacttagaggtgaaaagtctgtgccattttaatgatcttatttctgaccctttttttttgagatggagtctctctctgtcacccaggctggagtgcagtggtgcgatcttggctcactgcaaccccttcctcctggattcaagcgattctcctgactcagtctcctgggtggctgggattacaggtgtgcaccaccacgcctggctaatttttgtatttttagtagagacagggtttcactatgttgaccaggctgttctcgaactcctgacctcaggtgatccacctgcctgggcctcccaaagtgctgggattacaggcattagccaccacacctggccctgacccttgttatcaggtagtcaacctgggaatcagttcttgaaatgtatgtctgaaattgacaagctgcatttttttttttggcaaaagcaacatttctgaaacccctgataaggaacattcagctttcacacgttctgaatctcagaggagcttgcagggtcttccctgctgtacttaccattgcagggggcaacaaggcagtggtaagtggaaacaaaccaaaacttcagtgataaggctgctgaaatcaagccctgtgttttttgtttgtttatttgtttgttttattttgagacagagtctggctctgttgctcaggttagagtgcagtagcactgtcttggctcactgcaacctttgcttcccaggctcaagcaatcctccctccttggcttcctgagtagctgggactacatacataaaccacaacacctggcaaattaatttttttttttttgtcaagatggggtctccctatattgcacaggctggcctgaaactcctgggttcaagcaatcctcctgcctgggcctcccaaagtattggaattacaggcgtgagtcaccatgcccaggaagctgtggtttttttgctggttgttctctagccactgatgagcttgcctccctgcctgaccagtcagtcccaaatgcaagtttagaaactggtggttttttgttagaggccatttcatttgtttttgtgctgtttgaacacctgtctgcccctgtgtccataattctctttactgaaaactttttctaaatgaagttatttcagaaggcatttaagaaaatatttttttcttacctgaaatatatataagtagttaattaatggaagagccctaacaattagctgaattcacaatattagggaatgattaaattgttggtgatgtacctttcaatcatctctgcataagcagttgatagccacttctgtatctttgtagtaaatgcagagtgaatggtggattttatgaatggggaagctgctggattttgtgtaacattgcttttttttttttttttttgagatggagtcttactctgttgcccagcctggagtgcagtggcgtgatctcggctcactgcagcctccgcctcctgggttcaagcgattctcctgcctcagcctcccaagtagctgggattacaggtgactgccaccacatccagctaatttttgtgtttttagtagagacagggtttcaccatgttggccaggctggtcttgaattcctgacctcaagtgatccgcccacctcggcctcccaaaggtgctgggattacaggtgtgagtcaccacgtccagccgtaacattgctttatgatcagaacattgaacatcaggatccagtgctggtcttgtgttggctttcataggagggagacttgctgcagtccagctgagtagggctgcagtgaggacccttatactgctgaagcccactgagtgacacatgctggacagagtctgatgtctgtggggaccaattagctaatggatgtttagttttaggctagactagatgcctgccactacccttcccaccctccacagttactgttggttacttcctacaagtcaccatcaaagccaggagtatatattccactttttttttttaacctcccaactactagttttaaaactgaatcaaatttcaaatggttgttaacttgaaacagatctgcagactcgacattttctttccattttcaggctctctggaaaccagtgtgtgtgccgtagggtatgttgcttgtagagaaaagtgagcactgaggactgaaatggctgggcaaagacaaggcacaagttcatctttgtgaagcagcgtttttcagtgttcaggtacaaatagttctcagctgtgctcagtatcacacaaggcatctggaaacatgtttaattcatgttagctatagcaactacatttgaactcaggcatgttcatgcttttaaaaatgccagaggggaaaaagccagaaaatttgtcatttttgtttgccttatgagagaataacactgttccgagtggctcccaggagtttcgatttggtacagttgagagccttgagaagaacctgccagttgtaatagtttgtggcatttctgtagacattgtgattgacagaattctcagttgccaaattcagcttctctctaaactttgtatttttgagatttttccaagactaaattagtcatgtgattagtgttgttgttgtttttgtttttgagacagagtcttgctctgttgcctaggctggagtgcaatggtatgatcttagctcactgcaacctctgcctcccgggttcaagcaattctcctgcttcagcctcccaagtagctgggattgcaggtgtctgccaccaggcctggctgattttttagtatttttttttagtacagacggggtttcaccatgttgactaggctggtctcaaacttctgacctcaggtgatccacccacctcggcctcccaaagtgctgagattacaggcatgagccaccggtcccggccatgattagtgttttattttgatccataaaccaattgtagaatgttgctcttccagtggcttccaagatgctcagacaaggcaggtggcttttgtttccactagtgcttccactagtagcaaaggagcactgatatgttttggtgaatattaaccctttttaatattaatactgtgataagatatacttgggggcacttagttcattatggttgtactgtaggctttaataacagcaaactcttcttattcttggatgcatacattcttattgggagacccctgtgtttctaaactctggtcccttgtttggtggagattaatgatcaaaggtggttgacttgcctactatcctgaggtggaaagtgcttcatgtggaacttaggcacttgctgaagctccttcgaattcaagcttctctcctacctgctagcttgtccatctcctttctactttgtgaaaacttctactttgtgaaaaatttgctaatctacagattagcaaatcatattattggaagtttaaaaaatgagaaaagaagaaatattgctataattttgcagtattgttttccctttcttttttttttggagacagagcctcgctctatcccccaggctggcgtacagtggcgtgatctcagctcactgcaacctccacctcctgggttcaagtgatttcttctgcctcagcgtctctagtagctgggattacaggcacccaccaccacgcccggctaatttttgtatttttagtagagacgaggtttcgccatgttggccaggctggtctcgaacatctgacctcaagtgatctgcctgcctcggcctcccaaagtgctgggattacatgtagtcatgagtcaccacgcctggccctttttttccctttttctatctgcatttttcctcattgggtgtgtggtggggactgtttgggctgcaagtgacagaaacctaattctaacaggcttaagcaaagaggggaatttattgtaaggactggagggtctctgagcccaagggcaagaacttagctgggcctgaggagctgtggaagccagggtgggctctcccagtcctttcagtcatgtttcttctcaggctgctttctgtttctgtgtctttctcattcagctttttccatgtggcagaaaacacattcacagagctctctgaagttttatttccattttatttatttatttatttatttattgagacagagtctcactctgtcacccaggctagagtgcagtggtgtgaccttggctcagtgtaacctccctgcaaactctacctcccaggttcaagcaattctcctgcctcagccttctgaatagctgggaatacaggcacatgccaccatgcctggctaatttttgtgtgtttagtagagatgggttttcaccatgttggccaggctggtctcgaactcctgacctcaagtgatccgcctgccttggcctcccaaaatgttgggattacaggtgtgagccaccacgcctggccttatttccactttagccacccagagtttaactcactttcttgtgtggcctcccaagacctgttgtacagagtggttattcctgtggtaactttggggggtggaggagggctcagcagggatttccacttcttggccccaggtatgcataatttgccctttcatttattcatcctccaaactgtcacacctaacataatccagccatcccacaccaagctgcacacccattccccctcctcagtggcagacagccccaattcacttagcccctgtttactcatgaactcccagtggccttgtcatagggccacagttctccaggcccaggtacctgtggttcaggtggcttgtcaccatctggaccctctgggctgaaataattctaaccactcccaaacagtgacctttgcatccccggctagggcagataccacccttgaggcttatgttttcctggccgatttatactctgatattaatttcctagttccagaggtagaattaaaagcactcttcttcctcagacttcaggctttgcacagagtagactcggtaggtggcaacacagcttactgtcctttctcccattccagggagtgggcccaggccctggccctgggcaaagcgaagaggtgggatgtgcaaagttctagcagctgtttcactccctccgttggtgggtctccaccacagaaaaggaatacgggaccccagagtatttgtcctgccacctcaggctgccccagagagagcctgtggggccttccctttgaaggattaactaggcatcctggctcttaccgagagtagccgggccttctgggatcaggctcccatgcacaaataaccccaatccttttacatttaatgctccatacttctgtatttcaaaaatagcatttgtgccagaattcaaactgttgcagtataagcaagttgcattggcatttttttttttaattgaagacctggggaaaaagctatttgtaggatagtatgtgacaaaagaagagaaaatctcattacaagggtggggttgctgaagggacccctacctcaaaagggaaatcttatccaggaaaccttaccagctgtcacctgcatatgcgtccgtgtgtacatgtgcgcacacacctgctcccatggaaaccctgtggaatgagggtacaattcctagcaaagccagaagacaggcagacaaaaaaaaaaatctgtccagtataattgtaaccacagtggatatcaaatcttggattctatatttaattgataatgtatataagcatttttctatattgtagatttttccaagtgttattttaatgataattatttcactgaacatatgtctttatttatcttagccatttagatattattggaagtttggttctttccagtttttgtgtttataaatgggacgtcatgagtatcattgtgcacagaactttttccatttctggagttatttctttagagtatagaagtggaattacaggatcaaaaactaagagcacttttatattttccagaaagatgatactagtaattttcagtgctactagcaatggatgggaaatgtcacagcctttggttatttcttttaaaattttttttgttttgttttaagtttgttgagaaaaaaggtacattttaatttaaattttatttttattctaagtgaggaccagtttggggttatgctttttattcatttacttttataacatatctttactggaatcttagtgttttattttataaattctttgtataatgaaagctgtttttcctattttgctttaagcattttcccctaattctttgctttttaaaatttcatgaatgtgtgtatgcgtgggtattggcattcttttttatcataacgtcttatgagatgcccaggttttagagaatagaataggcccaagagaaggaagtcagaaagctgagcatactttgcccctctgtttcagtggaggttgcccatggattatttcagaattcttgtccttgtaatgttaggtcatgagcctgcctgtctgcaggcaggatcactgcttagagtgaggtgacctgggttctagtcctgactgagtgggaatttaggctctccaccttccatttcttcatctgtaaaatggagggttttagtaggataaccttgggagtggggggtctgtgattgtacatgcccaaggtgaagaatcatatcaacattaagagtcttctacatctcgttgcagatttttggaagtaccagcacagtgacgcttcctgaaaccttgttgtttgtgtcaacgctggatggaagtttgcatgctgtcagcaagaggacaggctcaatcaaatggactttaaaagaaggtaatttggatttggtccttgggcgacatggacatttgcttaactggttccacagaaacatattctggagaaagagaaaacattactcattatctaataaaataaataagaaataaagaagaatgggatcaagagaggaaaaggcattctgctcaaaggacgtttatagctttgctgtggttatccactaagtgcatcagttaaagaagcacgttttatcttcttttttgcttctgtttagacttcatgttaaaatggctctaggcttttctattaatagctctagctagttggtctttatgaagacatgctgcactaaatttgttctcatgattagaatcttgtaatcataattacaagaaggtatcttctcaacacctcaaattactcatttgtttttatagaggctgaaataatagagggctgtaagatttgacattcatccaagttaaccactttattgggttgttatggtgaggggaataaagactgagcttctttcttacttaacataccatgcgtccatgttatgatctgatcttcctggtggtaactagcagagtcaagccctacagctgggaaattgtatttgatttccaaagtaatctttccagataaagccatgcaaatcccaggatttgggactttcagagtcatctatattatttaatctgtctagtaataaatctcatttggcccgaggttcgggtctgaacagcatcgttctctttcgtcactactctgtgactcattactttcacgagcacagccaatgtttttccttccttaataaagtgttccaaaacagtatgctagatggaaaaatattggcatatgtcagaaggtcacacattgtcttgtgaattcagcagcaaacctcgttaccatccatagatgatggcagctgggttaccacaagccatcctgccccacctgcatgggccctgcttggatcagcaggaactttaagcagcccaaagaccagctctctcaggagtgtgtggccacaggaagactgtagagtgttttattacaggttccaagaacatcatctgtactgtatctccatcacatttaagccttttaatgtttttaaaatgaaacagagtccttcaaacttcaggatttcctattttgtccagagatgaaaatcaacaaatcacacaagaattgagagaaacactttggctgtggaatgttagggcatgtctttcagtttcattgttcccaggcagggcatcttcaccctgagccacttcattctgctttgcttttccctgcacataatgctttaagttggttttttccaagtcttcatttctgcaagtaatgtcatctgtatgcaacaaaactgtgtcctctccgttacttagtcaaacataagaattaacctgttttctcttctaacttagagctgaaagaatttgcctctttttaactcaattgaatgtgtatttagagaacctagaatgtgagagatactgtatagcagcagtgcccaaccttttttgcatcagggaccagtttcgtggaagtttttccatggaccgggggagcaggggcagggaatgttttgggatgactcaagtgcattacatttattgtgcactttatttctataattattactacattgtaatgtagaatgaaataattatacaactcaccataatgtagaatcagtaggagccctgagcttcttttcctgcaactagacagtcccatctgggcgtgatgggaaacagtgacagatcatcaggcattagattctcataagaaacatgccacactacacttgcatgcgtagtacacaatagggttcacactcctatgaaaatctaatgctgccactgatctgacaggaggtggagcttaggcagtaatgccagtgacaaggagcggctgtaaatacagatgaagctttgcttgctcactcactgctcacctcttgctgtgtggcccagttcctaacaggccacagacccatccacagaccagtatgggtccacaacctgggggttggggacccctgttctgtaggaccccaaaatgaaaaaggcagaccttgtcctcaagaagcccatgatctaaacccatggtgaaaatatgagaacacaggacttcaacacagccgagtcctgtaaccactcatgagagggactagtaatgtgctgtgagcccacatccatttggagggcaggaggctctgtgaagtggggtgtcagaggtaaaccctggtgaatgaattgagttcagtcaggagtgaggcctggagaagagcgaaggaggcagcaggtctagggtgcaggagcttatcccgtttagcaggagcttagcgtttccaggtagagggagggaggattacaaggggatgttgagccttactggatggagcacttaggcatttgtatctgactgaacaggaaattgggagctgttaatgtgattgaacaggtgagtgactcaacaggtgctcgcttttcgatgactctagcagctgtgtgtgggatgactagaaacaggaagcagacctggaaagggaggagggatgggaagggtgagaggcaagccagaaatagaatcagtagaatctagtgactgactagggaggaggagttacaagacacttaaagaagaattagataaatccaattaaggtctaataatttcttttcttttcttttctttttttgagacagagtttccctctgttgcccaggctggagtgcaatggtgcgatcttggctcactgaaacctttgcctcttaggttgaagtgattctcatgcctcagcctcttgagtagcttggattacaggcatgcgccactatgcctggctaatttttgtattttcagtagagatggagtttcaccatgttggccagggtggtctcaaactcctggcctcaagtgatctgcctctcaaagtgctgggattaaagatgtgagccactgtgcccagcctaataatttccagtagtattcatgatgatctgtttttctaagaataaactggcatgttttagttcagccctggataccagtggccttgacttatatttctatacaaagattaaagatggtaatgtgcagataccctgagttttcagtttaatcttgtggttataactgaagatttcaacatttttctaaattgttaaatatagataaatgataaaggtatccagatgctactctaggtcctgaggatacagcaagtgaacaaaacaggcaaacccttttatcataaagctttcattctagtgggaaaacaggaaatcagttacttagtagtgacgagaggtttgaagaaaaaatgaagtggggacatggaatgggcagtaccaggttggggtgggagtctgcagttttaaacagggagggctccacggagaaggtgtcatttgagcaagagctcaaggaggcaagggagtcttgtagacagccggcatagcgggtcaaaggtggagtgtccttaaaaaaaaaaaaaaaaagaaaggatgggagtgtccctggcacggtagaggaggagcacagagttgatgtggcgggaggagatcagctcagagagagatgggccagtcatacagggcaggagggacccagcgcttcctttacttcacatgtactataaagttgcttactgaaacaaaatttatagtcagtaaactacgtatacacagtttcaaaaagaaataaacatattaccgaactggtaatctaaaacaaataataggaaagtatttttttaatcacatagatatagcatgtaaatgctcggacacacgctgacactccccccaggaacaaatgctgtgcctgttgatgcagatggagacaagtgcaggatagtttaccaccatagccacggcaactggatttccaggacggtgaactgttcttggtagtgtttcaaacaaaagaagtacagccttacctgccttacacagtagttacgttccaagaaaattctgtatattatgaaaaagtacatttgtgcttatgtgtaaaacaggctatagcctcggataattagtaaagggttttggcccatgagaatgtctggcaggacatcagagtggcatgcagatgcagggcaatccttggttgtacaggaccgctagcatccctggtcccccacacttagtgcctgtaaagtccgctagtctctgtgaccaccagaaaataccttcatcgatttctcaagcattccctggggagctgtgctctccctacggataccactggtgtagggcctagtggctggtgtgaggacattggcttttcctcagccgttggaggaacctgaggcaaggagcaacatgccctgttgttctggactgaatatttgtgtcatccttccactgccattcataagctgaagccctggccctcagtgtgatggtactttgagatggggcctttgggagataatcatgaagatggggcccttaggatggatgagtgtccttatgagaagggagagaccagagctcgctcattctctctccaccatgtgaggacatggtgagaaggtggccgtctgcaagccaagaagagagccctcaccagaaaccaatctcagacttccagcttccagaaccataagaaataaatttctgttgttcaagccctctagtctatggtattttgttatagtagtctgagcagagtaaggcacatggcctccactttacaagatcaacaagtgctgtgttgaaactgaacagatggggccaggaagaaactgggaggccaggcaggggtgtactgcactagtccagacaagagaggatacaagcttgggtctgagtctcaaagagggattcagagctgaatggaataaacttgctgatgcaaacacatacctttaactcaccaaactggggttcttcagaatagaggcctgcaactccattcggctgtttacttttttcaggagccaatgaactggacatttttatgtatttatttactttttttttttgctttctgtggtggtttggcaggtgcttttgttcctcagccaaacgtgttgtagttcccagaaatggtggtttcttacaccatagtggcaaattatacgtaatagagaaaatgcgttttgttttctggaactcatttgggttgtgacattttactttaggggccatccttctaagcactgattttgtagctgtagtctgtctttctctaaaacctcaccagtgaatagagttgaatatatttcatctctgtacttttagacgaaatgcaaactgagaatgttgccatcatgttttgttttagattagcttgctttggcctgatggagttgagaggactttctttagtatttccagggctggtgtagggcttcttgagctcaccttaaaatactagttaatgctgatatttaacactcaaatccccatcaaattacaggttattctatagcaaccctgctctattcttttctgtctcctttccaataatagtaggcatgaagagctgggtcaaattagaaccattctttactaatcatgaaaatctgctaaatatgcaatatgactactctcctagccagctgggcccagactccggagatgtcccttgagtggacatttagataaatgataaagctatccagatactactccaggttctgagtatacagcaggtgaacaaaacaggacataatactggagatttcttaggagggaagagtcagaacaaagttatttgaaatttgaagacaattttattctcacgtgagtgtctctttctaaacatgtgcctcttgccacagttcctccctgtgctgacagaatcacggccaagcagtatagaaactagagaaaatagaatgatgctgtgctacttcccccttgatgcccagtggtcaccaagccctgtcatgcagactgggaaggaccctgcaaacctgactcctctctggccccattgctggtgccttagccaggctcttggcacttatttcctaggtgaatgcagcagcctcctgaccaccatccatgccccccgcaccttagccctctcgttcactcatcacactgccctcagatacacccccaaaaagaccaattggacctagctgtacccctgcctgctgaaatgctcttggtgttgtctatagtggtggcgttgtgcctgcatcagtgtgtgtggtgtgttacctgtgaatgatgaggaaaggataaatagggagcgtgagcatcatccatgatgggttggccgtttcaacaactggcccttcaccactgctagtttgagaagtgctgctccacagggtcaagtctaagctccttagtgcatgtgcaaggccattcgtggtctctcaccgccgcccccccgccccaactccctgggctccctcccctgcccagcaggtgccctacttgcagccatgtaactccttaccaggccttggagacctctggcctttgctcatgctccctctctaccagcagcctgcaatgttagacaagctcctgttcatctgtgaagaccccatttacctccctggcttctcaagcagggtgagcccattttttctctgggttctggaggtgcttttctgaaccctctgttgtggcacttctggcttgtgttgtaaatttttgttctcatttgcttcctagtggatttctacctccttactggggctctgggcagccaggatgctcagtaaatgtccaaggcacttgatgctgactcgggtcccagaactcttctgcctggacgtcttttgggagtcctgagaaacaaatgggacttgactgccttctcaggatgaatcatttgttgcttgtatcatagtcatgacagtttccggttctggtttctgatcttgagttttgcatggcctttggcagttggtttttctgtcctgctttaggcagtgtgtgggactctggaagagttggagatctgtcttcagaagtgcaatggaaacatgagaaggggaaattgtgaaaagtgatgatgttttgttaatagatctaacctgttttctctcaaggacttttctaggcttacaatatgcatcatctacctttttaccctcactgcttaagtataagaaaggtgtttatttcctcttcattgttgtgaaggattgaaaattaagttttatgaaaggggctgtgagagaaacctgtttttacttttgagcatcttggaaatgtgttggttctttctttttttgtattttacttttaaacatagacggtttaaaacatatccaaatgtagaagtattatgtaaagaacccccatgtactcatcactcagcttcaacagggactggtttgtatctagccttgttcacctgcacccccactcactttcttcccttatttttgggacttgcttcaaagtaatgcatttctcatttcggatggctcctcttagcagctgccacacacgtagtagcgtggatctcagctccgatgggtcgtctttgcagcattggttggtgtgtgttggaatatggttgtgattgttgaagtacatggataaagtgccttattttgtctgtgacttagttacctgtccctttgttcacttttgagtgtctggtttgatggcactccatcactcaggaatgaattctgtgaagttatgacatcctgagaggcatttggacacaggctgtagtgttgaattgtcttcagtgccttcatgattgattataacgttcagtgtgttttttggcctgagttacttctgccaaagtagagataaatgagaacgcagtagacttcagctgcttttagtatgggcagttttccggattacttggtcatttctatgtgatcgtctttgccaagtgtgacacttcgtgacttatggaggttacctccaaagaaaacttattacatccttttccagttctgctgagattagaaattgaggagcttttgattagatgtctttaaaaaaaaatgctttcctcatgaaagctgaactgtaaagaatgtttgagactttctgtcttaaaatttggacctaacagctttaatgggagtttatggcttaggttaatgaagtgctttttctctggagggaaggaatgagctgccactggggagaagtactccctaattgggccactcgaatgtatgaaacatatttgggagactgaaggtttgagttaaggaagggtgaatggctttgtttctgccagtaatttttttttttaataagaaaacagtattagaaccttaagcacattcttgagaaaatagcagttgtttacctcattcagactatgcctttctagtttcactgttacctgtcagccagggttaaaatctccatgtcacctttaaatcgttcctttctcccactgcatttatctagacagggctcagttttgctgacactcttttccctcctgtctgtttctgactcccctccaccccggctcgggtctatctgttgcagcacctttgtgattccttctccctttttcccttcattttgtgcctcaatgcccgcctgtctaacttgccttcagaggacttgtacaggttgaatatcccttacccgaaatgcttgggacctgaagtgtttctgattttggatttttttaggtttggaatatttgcattatatttaccagttgaacatctcaaatctgaaaatctgaaacccaaaatgttccagtgagcatttcctttgcacatcacgttggcgctcaggcttcagattttggaacatttcagattttggattttcggatttgggatgctcaccctgtgtcacgttcctctttttttttttttttttttttttttttgagatggattctcactcttttgcccaggctggggtgcagtggcacgatctcggctcactgcaagctctgcctcccaggttcacgccattctcctgcctcagcctcctgagtagctgggactacacgtgcctgccaccatgcccggctaattttttgtatttttagtagagagaaggtttcaccatgttagccaggatggtttcgatctcctgacctcatgatccacccaccttggcctcccaaagtgctgggattacaggcgtgagccactgcgcccggcccacattcctctttttctcagaggcttccagttggactctagtgaccaacattccacatcacaaagttttcaaggctttcttccccatggtgtcactgcctgcagtccagcttcatttgtgttgttcctcaggaggaacatgtcacacttactgagcctgcgtcctctgtcccgtgaacacagtgacattttttcactcatgttgtcttgtcatccctgtgcttggggccggctgcctttatgagggttttctgctccgagtattccggtccccacctaggaaagcctgtggtgcatgccccatgttctagcagttcgttatgtgtggttcatgtgtattagcttcgtaactcaaaccataagctcccttctttatcctgcatggcacttaacagagaacccagctgaagcagatatctgacagttgtttctgagatgtgtttggcgcatctcaacagaaagttactagtagcagggttgtcagtcctcttcctcctcggcggggaatgggggtgcatgtgtgtagaggattacacagactataaagcatttgagacttcatctctgctctttgggtccttaaatacctttcaaaaggtattttgaataccaacccagaacatttaaaatcactgctagggttacacttagaagggactggtttggggactttctaactgtgtggtaatatcttagttgtgcagaagagagagctgatttccattgctgcgttatgggggtcagaagggtggtcagatggggtcagaaagaacaaggtggaggagggcagtaaagccagaggtcatctagagtccaacggaaaagcaaaagcagggtgttccagaaatatccgtgctcatctgggaaagataagagaaggatcttgcaaggctccttgagctccagttaagtgagcaacctgttcttgtggcttctgtaatcaaagggatcttacttcttcctacatggaaggaagtctgcccagagctacctccagagagaggccgtcaatctcgaagtctggtttgaaacaattatttaaattttggttgattgcatcaaagacatttttctgttcagctgacttatcaccccatgttttccccaggccctcacgaattttgccagccctgcatttagggaagcctgggatggtcctgacagggtccttcatgctcttaacttgggtttcccttcagtctctctgtgccctgtgcaactggaagagcaggctcttcagaattatgccacaggtgagagcaggaggaacaggccattctctccaacctattgcagatgtttgccttaaatagcttctgtttttagctttttttttaacttttcattttataaaaactttatacataccccaaagtaagaagagtagtatcatgaaaccatgtacccagcacccagcttcaataattatcaatgcggggtaatccctgtccctctcccttaaatacttttcaaaagggccaacccaaaacatttacagtcactgctagaggtacacttaaaagggactggtttggggacttcctgagtttctaggttgtgtgactgggtggaagtgggacccactagccaatctggggaatgtgaactgaggagcaggtcctgggggtatggccttgggctgagacacccatagcagttgcaagtgggactgggtcaggagtccaagggagaacatcctcagatgccatgcggaggatttgcaagtgttggttttgatcacgggaacttgacagtggcagttctgatcttattctgagggtaggggccggagggcagtgagtggaggaaggtaagaaggcaggaaggtggaacagaggattcggagcagtgtagtttccccacatggctcaatcacccagcttgggttataaaggcaaattccttgtctctacctacaaagccagcttcctgggggaagaacctaggaatcaacattctaaaaattccataggaatctctaatacattgctggtggaaatataaaacagtactaccagttttgcaaactgtttgtcaattttttgtcagaggtaaacaatatgatgcagccagtccccctccttgttttaagaaatgaaaataggctgggcacacacctataatcccagcactttgggaggccacggcgggtgaatcacgaggtcaggaattcaagaccagcctgaccaataggtgaaaccccatctctactacaaatacaaaaattagctgggtgtggtggcacacgcctgtagtcccagctactcggtaggctgaggcaggagagtcacttgaactcaggaggtggaggttgcaggttgctgagattgtgccactgcactccagcctgggcgacagagcgagactccatctcaaaaaaaaaaaaaaaaaaaaaaaaaaaggaaagaaaagaaaaaaaaagaaatgaaaataggtccaaataaacactcgtacacaaatgttcacagaagctttattcacaccagccaagaaaataaaaacaactcaaatgtccctcagcaggtaaataggtaaacagattgtggtaaattcttatagtagaatactatttggtaataaaaaagagcgaactatgatacatacaacaatatggatgaatttccaagacattatgtgagataaagaggccaggcacaaatgagtatctatgacgtggtcatttgtgaaattttagaacaaacaaaatgaactggtacttatctggagcaagatttggaaatactgaatccaaagggatgtgaaaaaatgttttagggtgatggaaatgttctgtatcttgatggtgaagatagttacatgggtgtgtgtttttcaagattgattgaactgtaaacttaaaatggttgcactttggaggaaaaggagagtgtgcagaagagcaggcagagccaagaggtttttgtgtttataggcaaaggaggagttgaagatccttggagacaggatctagatgtgagtgtgaaaaatctatgagtgtgaagacaaaagcattgtccctttatagagatgtgaagggaagggtggagctgggcaaatgtagaagacaaagggtaggaagtttcagcaagctcactcagtctcccttaatatcccctatgacacagaaggcagagtcatttgtggagagacagggaccttgaggcaaggagtagtttgaaatatcagctacaggggtgagaacagaagccagccaggatctcctagtggcaggggcctagctggccacaccatggagataccacgtatcatggtatctccactaatgatcgcagtgttttctacagctgtgctcagaaggctgggtggaggaacagggactgctatgcagatcctgggttcagggtgagtagagcttatctgctggattattaaaagtgatcaacaatggatttccaggctggccaagagtggaagtaggaaagaaactgcgctagtttgaatatttgaccctccaaacctcatgttgaaatttgattcccagtgatggaggtggagcctaatgggaagtgtttgggtcttgggggtggatccctcatgaatggcttggcgctgtcctcattgtagtgagtgaatcctcaccctattaattcctgtgagagatggttcttaaaaagagcctggcaccttctcccctctcgctgcttctctcgccctgtgagctctgtacactccggttcccctttgccttctgccactagtggaagcagccagaagccctcatcagaggcaaatgctaatgccatgcttcttgtacagcctgcagaaacgtgagccaaataaacctcttttctttataaattacccagcctcaggtattcctttataggaacacaaacagactaagacaggaaatgacacttaattactccattcagcaaatacgttggttaccacctgtgtgtcaggtattgttttagatccttgggaagatgcagacaacaaaaaataaatcccaaccctccgtggccagagttgggcattaagtaagcaataaaatatacagaactacagaggtggtaagtgacatggagaaaaattaagcagggaagaagggttggaaatcctgggcagtaggaggtgatcatggaagaccgctctgaggtggcaacagttgatcaaagacctaggcagaggaacagccagtgcaaaggtcctgaggcatgggcaggcctggcagtgcttgttgaatacttggaggccggcatggctggaatggagtgtgtgggaaatagtgggagattgttaaagggtgacaggttgaaagggagggactgcttgggatttatgaaccactgtgtaaacactggccttcactgagtgagatggggaaccaccaaaggattttgagtcacagagaagcttaatctgatttatgcctttaaaaggatcactcttctcagtgtcaaggcattgacttatagtcttgacaaacatttaatccacatagagatgccccatgaggttgatgttatctctattttttttttccttactgatgaggaaattgaggctccacgagcttaagtaactttgccaaggtcactcagctggtgattggcagagccaggatttatgccttggtttgtctgattccaaagtccacacagattaagagaggagggaaggcttgagagacaaagggttcctatggtgttgaagggaatgggaacaggacacagaattatggttggcatcgaaacagaccacagagtttggcaactgatagcatgtgttagggagaaatagacatcaacagtgtcgtttgagtcatggctttcttctaggagaatggtggtactgttaataaaatacggtagtcaggagtagaagccagtctcaggcaaaagacagagggcgtgacttgggcaagcagaggctgaggcgttggtgggaagtagtgggcgtgtccagttgatccagagaaaggacccgggagaggggagcctagaaccccactgtggttagggtggaagttatagagaggcatgtgctctctgagtgagaagaaaggctgaagggagaagctggcaatgttcctccctgtgtggaggagggagtggggacaaaaattcactgcttttggggacagaaatgtttaaaactttacccttatgaacttggacaaaggaaagatgtggacgtctgttttgttatttgagcttaaagaagtgatttagattagcctagcaatgagcatcttgtgacctcacccaggatgtcagttcctgcaggtgtaaaacttgtgccattccaggcctcagctggacacacgatgggggccggggagtggagttgaggccagtggctgctcccaggggatcagtgagcaggtttgtttctttcccgtgttaatcctgggagaccaaaccttgatttcagctatattttccctctacctttaccagataaccttacctttaccttacataacagccactttttatatttgtgaagtaactcccccacaactttttttttctgaaagtaaaacaacttggtgacattggcttttattcttatcgggccccatatagatagtggcttattttacagcagtatttgtttacatccctacaggtaggacagtgtttcttttcacatggctgaaaacttttttttttaaagcaagaatcttacctgatatcagttctcattattaaatcaaaaccactttttcatgttactcttttagtgcacattttcagataatgctctttttatttttgctgactttccaaagataattttctctttaaccttttttaatatgaaaaaatttaaccatatgtacagagagtagtaaaataacactccagtgttcccgtgtctcatctttaactgttatcaacagcctgccacttcttgttttatctgtcctccccgccccccgtataattattttctgtagtattttaaagcaaatcttgaattcagatgattcttaaagaaaaacatttacagaattaggtcattgttacatttcagaagccaagcagcagtgtgtctgcctctgtcagaactgtcttaataattgtgtctttacctgggctgcagctttgaagaggcttattccaggtgcttattttactgagtggatgggaaatgctaagataaccataaggccctcctactggagtttatcttctcctaagcctagaaaaaaaaaatcacagttcttaaacaccaatgtagttgtcccgggaatcttcccctgtctcctgccaatgtcctgaatcttaactggaaccttcctgatacagggcatatcttgggacctgaggcctcagtgtcaggtgaccagtggataagctatagaaaaccaggaaaatctgcatctgaagacgagtctgtgtgactgagcaaacactgtacagcaaagatcaggttatgaacaggaatttaaatcatgttggtctgcatgtcttgtttctggtgaattcctggaatttggccatgtcctcttaatctgtgtttatctgtgatacctttaagtggctgaaacaaacaaaaaagatgccattttactgctgtgttttcttcggaatatgatattcttgctcttcttggcttgcatgccttcaggccggtgttaaaataactgggttattgcaccttgactagcttgtttcagtaggatgagtgtggtgtgcctttatttcctgtctcttgcatcagtctgtttgtgagagtgtaccgagaggtgattaatgggaaagataaacatgtgcttactgactgaaagttcttcctgtttcctagagtgtttttggtttagtgagttgtttgtttgctgcccacagaccgcatatggtgtgtgtacacctctgttgttgtgaacaccatatgcctttgtataggagctgggcttttaagcaaagtcaacatatgataaggcttaaaagattttccttcatccaataattggatggattggacagccgtctgtcaccataagcagagcctacagagtctggaattctgcatacaaaatcatgtaagaatacttgctgttcttgccccccagagattaagttgtgtatagcatggctgtggggttttggttgctggaaatacctcatcgctgtgagtctcctgcctgcggacttttggatctgtcactacacagtgctgctgtgccagtgttcatgctctctcactgccaccaccatctgcccctggaatcaggagcttcctcttgctttgtgcccaggaaaatctagggagggaagaattctgccattaattgctgcaaatgtaaaattgacttagagaaaaaaacgtgttctcaatttaaaaagtaatgcctgctcttgcagaaattttaagatatagaaaaggttggggggagttgcatttccaacaaggataacttacaattagcatttttgatctttccatctaattaggtacattgaagcctttccccatagttgcattaatactctatgtacaatgttatcttttctcctgaacataatagcataggtttgtatatgtcttaaaattttattagccctcttagaagccttaattttttgccaagtggacattctataacttaaccatattattgggtaggtcatttgtaatgctgctacgtacacatctttgtacaaaaaccattttctatagtttatattgtctttaaattagattttataaaaatgcaatgggggggccaaagggaatgaacacttggaggctctagaattgccgctccaaagaggtgtgtccatttactggccaatcaaagttagttcttaaacccattttacttttcctaatgggaatatgtagagctactccaggcatcggacaaggtaatgattaaggttttagaagtctttgaggtgtcagatagtgatgctctgaccccttgtccacggtgtgtggtgactggttcttcgttctgcatccatcccccaagttatatgcaagtttcttgaaagcagttctgttctggtctcagttctctatccagcctcagtaactatccaagagcttacatttgcatcattgtggatatgttttctaaaagatatgcacggtgatacaaaaatgcatataaccttcacgtgcactagcccatgtaggttaacaggagggagaaagttattaccggtacaacttggcctggtcctgggaagcctctgggaatcttgacattttgggatgtttctgatgatggctttgttgttcttttgcacagatccagtcctgcaggtcccaacacatgtggaagagtaagttttctgattcgctcagtacttccctttaattcagtcttcttcattcaatcagtgtttatgaggccagttgctgggagtgcatatatgtgtaagtttgaggaataacagtgagtgacatataaagtcttacaggtgctatgatgaaagcttgtgttgaggaggaggtggtcagtttcctgagggagaagggtagtggttttaaaaaggcttatttgagatgaaactcaagttgagctttgaacttaaacttccaaagtcctcagggggactggacctcttcctctttgctgtgtcatatcatggagaaaaaaggtgaatgtgacctgctactacagagtgtgtgttggggtaaaagctggatagcactggtaagagccttaaatgatggcacaacctaaggaacgattcagccaagggtttctgagggactgtagttatagtttagtctttagcagattaacttgacaaaagaccacttcacatctgcttcaagggaagctactgacggagggaccttgatctgtccccttggcgggttctctctgatgtcaagctgttagagtctgcttttattgcctccagttaaacaaaaaatatctcttgaaaactaaaagcagatttgttctacctgtttatgtaccatgccatcctatcaaatattaatggctggagttctatatacaattgatgtagaaattgaaaagtggacttactgggtccttttcacatattttgccttcatccagagtgctttgaccaaatgataatttgtcttctatggttttgtatgatttttcctttcaggccgcttttctccactcaaggatagtgtataccaccataggggtattttatttatctgtggttgaagtgagagagagtagtgggtggaattgtcttatatactcacttatacacctacacacaaccaccctccactctctattcctccatcatgggtttgcgtggctttggtatgttgttccatgccctgggctgtaatttatctttgatatttattatttaatctctaggcctgcctttctcccagatcctaatgatggcagcctgtatacgcttggaagcaagaataatgaaggcctgacggtgagtatatttagctgctttttgtactccaggggttctagaccagcggtccttaagtgtgtctgcacagtgtcttactgtgtctcccacctggagcttttaaaaacaacccctggggattctgattcaggtggtctagagaggagcctgggcatcagtcttttcagagagcttcctaaatgagcttttaaatgtggtgccagagttcagaaacacggatgcagaccagcaggttctcatggcccagcccatacactggaggatataatgttaagaacagggtttgctctaactggtgaccctcaccttaggagggagggatatagtttgaaatgctgtctccacctgccccaccttccgatgactccttaagggagtcatgtgatattctaccctcatttccatttgagaatctaaaccagtggttttcagccttaattatacattgtaataacctggaattcgaaaaaacagcattaggacctagaacatagggcccaatcccagaaggtcccgatttaattgatctaagtcatcaggactttttaaaagctccccagataagagaatttagaaacaggcccacacatatggtcatctgatatgtgacaaaggtgacactgcagtgtcctgtcttgtcttttctcttttcttttgagacagggtctcactttgtcacccaggttggaatgcagtggcacaatcttggctcactacaacctccgtctcacaggctcaagccagcctcccacctcagcctcctgagtagctgggaccacaggtgtacatctccacgcccagctaattttttgtatttttggtagaaatggggtttcatcatattgcctaggctggtctccaacttctgggctcaagcgatccacccacctcagcctcccaaagtgctgggattacagacgtgagccaccaccacccagcttacagtgtttttgcaataagtggtgtaggtcaattgggatatccatataggaataaaagtattgactcctacccccctacaacacatataaaatcagttccagatagatcacacatctaaatgtgaaatgcaaaataataaagctttaagaaaaaaagtaatggaaccatcttcatgatcttagagtaagtagagatttattaagtaggatattaaagaacactataaatttaggaaaaaatcaatatattgattatattaaaattaagaacttttcctcattaagaggccacaaagtatttgtagtatacacatccaacaaaagttcatattcagaatatatgaagaaatcctatggtacgttaaaaaaagacagcccaatggaagaataacagaagagaatatccaaatggtcataaacatatgaaaagatgttccattttattagtcatttggaaatgcaaattaaagccacagtgccatactgctactcaccagaatggccaaaacaaggaaagtagaaaaagaaaacatgttggtgatgtggagcaaccaggactctcacctactgctggcggaagtgcagggtggcacaagtgatttggaaaactgttggcagtaagtgctaaagtccttaggacccagtaatgccctcctaggttacagacccaacagaaatgcacatttgtggctgggtgcggtggctcatgcctgtaatcccagcactttgggaggccaaggtgggcggatcacgaggtcaggagatcgagaccatggtgaaaccccgtctctactaaaaatacaaaaaattagccaggtgcggtggcgggcgcctatagtcccagctacttgggaggctgaggcaggaaaatggcgtgaacccgggaggtggagcttgcagtgagctgagatcacgccactacactccagcctgggcaacagagcgagactccatctcaaaaaaaaaaaaaagaagaaatgcacttttgttcaccaatggacatgtgcccaaatgtacagcagcaccatttataataagcagagggtggccaaataacatccacagtggagtggaaaaataaactctggaagcggcatgcacggtgatgaggaccaacagtctatgacgacacacgccgcggatgactcacaagcgtgatgttgagcaaaacatgacagacaaaaaaggccacacgctgccattcacttatgtaaagccaaaaacaggaaaaacgagtctctgctgttttgaagttaggataatagttacccctggagagttatggctagaaaggggggcaagagaggaggggggcttctgtttcttcacctggatgccggttacgtgggtatgttcactttgtgaaacttgactgagctgtgtgatgatgagtgcttttctgtttgcgtattatgcatcagtaggaagtttttaaagcttccaagtaattctcatgggcaaccaaggatgagaaccactgatctaggctgtaagtggattgtggactttaacttgggtgttttaaaattattttgtgaatgcctgtgaccaaaacagaggggaggagggcaagtttgtatagagctgtgtgtatttcaccttcaacactgctctccgttggtttctctccacagctctgtagtccccatttcttaagcaatttgtttgccagaaactggggtgagtgagttgtataagttatctcattggaatctctcagcagccctgtgggtgatatccccgttttagaggtgtggaaacagcctggagaagtgaaggaatatgtccagggctgagtcttctagtgttggagttggttcttaaagaggatgcccagccgggcctgtaatcccagcactttgggaggccgaggcgggcggatcacaaggtcaggagatcgagaccatcctggctaacacggtgaaaccccgtctctactaaaaaatacaaaaaattagccaggcgcagtggcgggcgcctgtagtcccagctacttgggaggctgaggcaggagaatggcatcaacccgggaggcggagcttgcagtgagccgagatcacgccactgcacttcagcctgggtgagagtgagactccgtctcaaaaaaaaaaaaaaagaggatgcccttcatcactcccttgtgctcctttctgggttgtggtttagcagctccagaaacaatgtttcccaagcttgggccttgaatcagggcaccagtggcagtgctcagcagagaccacaggactccagaagactagaagatctgcagtgcctttctgattctcagaaacacatggcaaaacccagtcattgcagcctctctgaagcatttttcctcctctgaggcttggtttgaatgttgggatgatgggaaaatccaagttatttagtatgcaaagctctgcttattaaagctagagagaaatcttttctttcttggagaaaaaggtgaccatgcagtagaggcatttctataaaagcaggtatctatagaacaatttcaaaaacacagaatgttctaaaaataaagtatactgaaacaagcattaaccaaaagagctcgtcagatgtcagctgtagactcagaagaatcagttttatgatgaaatgcagttgaaacatttggattcctttgagtttcttttcctggcacctatcttaacttcctctttaaaaccaaaagtctcaatttttcttgtttttcaatagtgaattatttactgaagaaaacatcaaaactcttttccacctcaaactcttgtgttgcccctgtaatggcgacttctcctttccctcgaagcttgagcttggcaccaaggttgcatcccttcagcatcaatgtcctggctccctcccatggggctctacaaagcactgtcattttactcagtctagccagctctggctctgtattccaagccaggacaattctttcttagcatttcaaagaatatataactctccatatttgtgtaaatcttttcagaaaaggtttgtgtcacccctgggaagcaccctggacaggagaccttgaggggcctctgcacatggtgtcaagtaaaggagtggatgtttacagagctcagggacctgggagcttgtcaaaatagatgtggaaaattagctgggtgtagtggcaacatgcctgtaatcccagctacttgggaggctgaggtgagagaatcacttgaacccaggaggcagaggttgcagtgagccaagatggtgccactgcactccagcctgggcgacagaatgagaccctgtctcaaaaaaatgaaaataaaaacacagtagatgtggaagcatagggtgcccccttctcctttgtattcagttaggaaaactctcatctgcaaagtgcttctctctttttagcagaattaggtaatagaaacaaactgcctggtaaaattgtaataattgcacaagacttggttaacttttttttttctttttttttttttttaaagaaacttccttttaccatcccagaattggtgcaggcatccccatgccgaagttcagatggaatcctctacatgggtaagagttcctgtctccagaaacttgtgtctctttgatgtaagtcccggaatctgggaaagtggcatgcggagagagagggcgcagtcaccgccttgccaaccctttctttcctgggttgtgcttcaggtgctgttctccccaggatcagctgaccaattaagaaagggctcccccaacttgggagaagaattgacatcattaatatggttactcatttaacaagcttttagttgctgtgttgacttagtcctgagattccaagattgcaacatacccagtggcaaatggatgaaatttaaagtgagtacaatcatctaagccaaggaaggaaagccaggctctgcctgttaattatagcgctttcttagtatttcctgctatcagaatgtttgatagaacagcacttaatagcttgcctagataaactgccttcatacctatggggtcacagctttcaaagcatcagatcacctgcttttcttttactatgttgctgccaaaatgtcaataaaaaagcatttgcaacacaaaggagagctgtatttatcttgaaatcatagtagcaataatagcccgtatttatacagcagctttctttttgaggaactgaaagtgcttattgcctattcatgcctcgaggagctttatgtgtatttctgggtctcaagtgcaggccagacttttaaggttttgctcaggacactgagactcttgcttccttccacaccttcagaatgaggaactcccagcctaggaatttggaggaaacgatcggcacagatttttctctctgtgggccgtgacctgggaacatctgataatcttctgaccatccatgtcactgtgtcctatctggtcttccagcttttgccagcaattcatcacttatagtctgcttaggatattgtcttcttatcatctttgtgctgtggcctcttaggcgagttcattaaacatatttaagagcatggtagttgcccaatctacccattaaagtaataactgagttatgtaaactctagtggttcttgaagtaaccagctatgtcatgctagatggaaaaggttcgtggtcctagctctgttctcctctaccttcagatcatattcatattatgattttgtcagtgagaacagagttgcgatccatgggtaagttgcacacatgtggagcaggcatgtatgcaacatctgttagaactttagaggtatagcattagcaaattacaggccaggtgcagtggctcacaactgtaatcccagtaccttgggagggtgaggcaggaggtttgcttgaggccaggagtttgaaactagcctggtcaacatagtgagaccccgtctctacagaagaaacatttttaaaaaatcagccaggtgtaggccaggtgcagtggctcacgcctgtaatcccaacactttgggaggctgaggcgggcagatcacgaggtcaggagatcgagaccatcctggctaacacagtgaaaccccatctctactaaaaatacgaaaaataagccaagcgtggtagcacatgcttgtagtcccagctactcaggaggctgaggcagcagtatcgcttgaaccctggaggcggaggttgcagtgagctgagattgcaccactgcactccagcctgggcgacagagcgagactccgtctcaaaaaaaataaaaaataaataaaaattagccaggtggccgggcatggtggctcacacctgtaatcccagcactttgggaggccgagttgggtggatcacgaagtcaggagatggagaccatcctgactaacacggtgaaaccctgtctctactaaaaaaaaaaaaaaaaaaaaatttgctgggtgtggtggcacgcacctgtagtcccagctactcaggaggctgaggcaggagaatcgcttgaacctgggaggtggaggttgcagtgagccgagatcactccactgcactccagcctgggcggcagagcgagactccatcccaaaaaaaataaaaaaagagccaggcatagtggcacatgcctgtagtctcaactatggggaggctgaggcaaaaggatgacttgagtccaggagtttgaggctgcagtgagccgtgaccacacctctgtactcctccttgggcgacagagcaagactctgtctcaaaaaaaaaaaaaaaaaaatttcaaaggctctgtgaccttctccagcatctcaatattcttcttctaagagtctccaaaacaggagacttttccaataagttaggaagataaaaatgaccaccagagatcatgctttacaaaatggaaatacacgcatcacagtgactgtgttgaccttcacattggaggcccttgctacagactctccattcctaggatgctgttgggtatataccattgatacatatgctttgggttttcttaatatatagtgttatttactgtgctgtctgcctgtcataatcagctgaccaagattagggggtatggcccgaggccagggaattacttactggctgggaacagaggccgagacaactttgacatccttagcatcaggttgcaaccaactccactgaccagtcccaggtactagttaattatagtcataaacagtaactgtggatccttctcacatggtggctggttattagggaggttgagaaatgtgaatgatggttattagggagatgaacccctgggcacatttctgtatttctatagatcccagtccacgggaaaaggattgcccttcacaggcaagacttttcatatttaaagccactcatcaaagcaataaaatctaacttgaaagtttggggaactttttgaaactataattatgttattgggtttggaggaatttgtataccatgtttaggttattaaattattataagacctatggacctaagaagttttattatctctgcattaccatttatatcatcaccttagaaatgacatcctaagaaattcaggtctatctctctcaatacagagcatcttggctgctagtttggcagcgatacttttttccatatggtgtaaacgacgatgtgtttttgtgtcctttcaggtaaaaagcaggacatctggtatgttattgacctcctgaccggagagaagcagcagactttgtcatcggcctttgcagatagtctctgcccatcaacctctcttctgtatcttgggcgaacaggtaagaaatgaacctttgtcttctacaacctgcctgtttccagaagatcggaagaagctccccagcctccttccctagaaggtggccagagctgcttttttccaaacacaggtcccatcatgtcattttcctttataagacccttcagtgtccccccagtgtgcaagggatacagtccaaactgcaccacggcccagaaaaacccctgtgacgccgctgccacctttctcgcctcatttctctcatttcaaagttgcctggccgggcgtggtggctcacgcctgtaattccagtactttgggaggccgaggcaggtggatcacctgaggtcaggagttcgagaccagcctgaccaacatggcgaaaccccatctgtactaaaaaaatacaaaattagtcaggtgtggtggcatgtgcctgtaatcccagctactcaggaggctgaggcaggagaattgcctgaactggggaggtggaggttgcagtgagccaagatcaagccactgcactccagcctgggcaacaagagtaaaactccatcccccctgcccaaaaaaaaaaaagtttcccaattaggatgaactacctgcagctcccagaatagcagtgttgtttttaaagacttgtagtggtgtggtcctctccaccaggtatgcctgtttttgcctatctggcaaatatcctctctcacaactgtactcaaaagtcaccttctctgtgaagcctcttctgcagcctcacagcctgcaccctgctcaggaacacccggctctcccattctaggggcacacgtagcagttaacaggcctgtagtggcagccatctcacccctcgtcattgtcccttgacaggcatggcttgcaccctcttcaccgcaccattttgtgtttcctcccttttcagcctctttcttcttaacacttggcactgcatatttataaattcaatgtgcctacttcctgcctccctcactagaatatcagttccctgagggtacgactttgttttgctcagctgctgtctctctacatcaggcatattgcctgatgtgtagcaggggctcaatgtttgaatgtatgaatgggtgggtcccattattgcagagacctgccttacttattaccatatgtgcagcacctcacacatgtcggggatgccatgaaaattgttgaacgatacttaaagctaaaaggagaaacaaaaaacatttagaaggaagaaattataccaaaaacctaggatgaattcattacaattgagcactacatttaggtctaaactttcaggcagccaaggatttgaaaaaagagaaccgtcctgaaagtgttggggaaagcactgcatttctaaaactcagtgagactaatcttgggccctgcagaagctggccgggctctcctggaaatgggtggaaggtcttagactgtagaaatcatgtattccagcttctgactgtagtgactgcttaggatttatgtgtttaccttttccattaagtaaattcttacagtggccccagcttcatccagatataaaaattgcgtcattctcaggtgaaattgtggtgttcgaaggagctgggatatgcatgaggtggaatgtgtgtgcataggtgtgtaaatccattgcctccattatctattgctgcatgacaaaccaccccaacttagcattttattgttaatgattctgtagggaattcaggaaggactcaacaagaacccatcatctttattccacatgcttggttggcctcactcatgtatctgagacttcagttcagttccgtgtgacctttctccatacagatagcctggactcttgatatggcagcgggctccctcttgagtaaaaatgggtgttacagtgcctcctaaggtctgggctcaaaagttccagaaccttccttccactgcagtctgttggtcaaagcaagtctcaaggccagctgagaatcaagggtagagatatagactcggcttcttgatgggaagagtaacatgcattacaggaatgggaagaattggtggtagtgacctttagagatgttctactgcagtcctccctcaggctgcagtagtttacaaccctcccactccctccaaagacccccaaagtccaatcccagcatcagtcccaaaatctcacctctcattatctgcatgaggtctggaggtagatgatgctcctcaagtgtggcacctcttgatcggagacctgtgaattaaagagacagggtctttctccccttcccatcccccacccaacatgcagtggtgagacagagacaggatagctgcagtaaacatgttcactcaaaaaagggcaggaaagagagacacatatcacacattgggccttagtaattctgaaatccagccaggcacatgttttcaggttcccctcctccaggggtagggaatattccttcattagggcccagttttgccctctgggattggttccctaatatagtgctctcagtggctcttggttctgccctctgagaagtcctttcttttccataacaaatggccagttttgtatctttctcagtccgttccttgtccattgaaatttggggatctagaagcccttttttttcaatttgactgtctctgttccttttagtctatgctgataccactcctttaaaaactatgtgggcttcccatgtgtcaaattataatttattccattagataaaagccatacccacaagtttctagactttggaatgtgagtgcaatgggacaacacatggtttttagaactcccttgatgggggcagagggtctatgagggaccaccttaaaatctttcagaggtctcaaagaaggatcttacagcttcaactttgatttggttgatctttaccctgagcccattttttgttgctggcagtaccctggatttgatcttttccctaaagttattttttatattgagaatcttttccagcgatattcagtcctggaccctttatagttcctctgtattctgctgaatgatttcttcctcagctcatttgtctcacaatatatcatagacagctaagagaaaccattcaacattttctgccttctgtctggaaatctccttagttggatccctgagttgattaggtactttttctgtcttccaagttactgcaagcaatagtcatgctcatcatggcaccctccacaagctgggtcaccccttttccattttcaatagcagtgccccctctgcactagcaagtctccaccaacctttttatcagcctcccagcctccacctgccagctggtcctaaagtcaatgccacatgttttaggtgtttgttatggcgccatcctgcttcaaggtgccaatttttaattgtcagcaatccattgctatgtaataaggcaccccgaagcttaatggctaacaacaacattctattgcttacacttctgtgagccatgagtccaagggcatagcgagggtgggtcgtctctgcttccacatgctgtcagccagtttcactcatgtgtctgggccttcagttctcctcacattgcctttctctatcgacatggatagtctggactttttggcctacagtttagggaggatttgtttgttataattagataaggaccacacctcagtaggtactatggcccctccgtggtaatgggctggctggtctgtgttctttagaatacaccatcaccatgtacgacaccaaaacccgagagctccggtggaatgccacctactttgactatgcggcctcactgcctgaggacgacgtggactacagtaagtgctctctgctggatttcacaagcttgggccagtacttttgacctatgtggaaacagtggctccagaaagtaggattttcttttaagatactctttgtcaccaggttctttctttccatggacttttcatgggcttatcataaatacttcccacagtcaatgtgcaggggccttggtgaagtctgaagggaaaccgaagtaaaatggtgacaagcttagccagagaggaaggaggacatccctcgttgagtctttctatgtcacagaaggaatttactgcaagcccatggaaagtagaagtaaaatcagcataggacattaacaaccctgtcaagaaggccactctgcaaatgtgactcatccctagttatttctgcagttaacattcacccaactcaaatgaaaactaaaaaccaatttgccaccttaacattggtatcaaagttggactctgctttttcttgtcaaggacctagaatattttcgtttttctctgaggactcctttgtgaatctgatgggacagtgtcagtggttcaggtctgactttcagggtgtttttttgttgtttttttttttgaggcaagttctccctctgttccccaggatgtgtgcaggagtgcagtcagggctcactgcagcctgaaactcctaggctcaagcgatcttcccacctcagcctactgagtagctgggaccacaggcacgtaccgccactcccccacctacctggctaatttttttttttttttttttttgtagagacgggggtctcactatgttgcccaggctggtcttgaagtcctggactcaagtgatcttcctacctcagcctcccaaattcttgggcttatagacatgagccaccacagctgtccctgactttcagtttgatcgatgggtttcaagtgactgctatgaaatgccagattaataggcatctccactggctccttcctcctcagtatttactctcacttattgaatagagtgttaaagaacatcaccaaataaattgcctttgggagagtgatcctggcttgtgtttatacgccagccagctctcagtgtcttgatattacagagactaagcgagttcattggaaacaagtgaaattgctcagaggagatctgagaatattccagaagtcttgtttcctctaactgagtgactagagcctgccacaagagtagaggatgtggttgcaagatggggtgagactcagcatgctttgtttatttgatctgtacagagatgtcccactttgtgtccaatggtgatgggctggtggtgactgtggacagtgaatctggggacgtcctgtggatccaaaactacgcctcccctgtggtggccttttatgtctggcagcgggagggtctgaggaaggtgatgcacatcaatgtcgctgtggagaccctgcgctatctgaccttcatgtctggggaggtggggcgcatcacaaagtggaagtacccgttccccaaggagacagaggccaagagcaagctgacgtgagttgggagctcggggaaggagagggcggccgtggccttcgtgttctggtgctgttgcagtgtagcaggccctgcacgggaggccaaagacagggcagtctctgaagccatgaggaatattcagagccaagactgtttcatttggaaacctcagaatacaagagctgaggggcacccattaacacttcagagttattaaatattacataaaaatcatggatgggaggtgtcgggcaccatggcatacacctgtaattccagctacttgagaggctgaggtgggaggattgtttgagcacaggagtttgaggccaacctgggcaacatggcaagaccctccccctgccaccacacacacacaaataaaggtataggaaagagactgccagtgtaagtatagtttggatctatcttaggtggtagggatgcaagagatttatttttttaactttctatattttctaagtttttaggttatattcattttaaaaatcagaaaaaatagttacagtgtgtgtgtgtgtccaagactcagcaggcttctgttctccatccccctcttcatagcctatcaccgagtcacttaaactccccaagcctcagtttcctactttatatatagagttgtgtggaagatcaaacaagataatatgccggcaagtgtttagattgtaaaacagcattcaaatgtaaggtattcgttgagagaggtttagataatgtagtggatgaccgatcccaggtgggctcttgacagtaagcagaagggccaggaggtgtagctctcaccattttctgtctccctgatgtcccacatggggacagactacacagctggggaaccagaagtctcaccaagtctggaatttcttatgcatcccttttgctctcagcatccagagtagagcagctgaccatttctcaggagttctgtaaaacctccaggatccttagaaagcacaaggcagaatgggggtagttctggtggtcgctggagtgatcgctggagtgaaagtgtgttgtagagagtcatctgaggggcctcggcggtggtagtaagcactcagtctcctctgtggccactgggcgtagtcctttctgcaggcatcatgggcatcgtctagtccagccctgcgattttgctgaggcttgccattaggtggcttgtccatgtttctgcagtgagtgacagctgggatgaagtcctgtggtcctgttcccagggcagtgcccctagcttcacacccctactgcgttcctccatgtctggggggttaatgtggtcatccctgcgggtggtatttggggtgatgattactcccttctgtgggatctggaaattcaatgactctggaatgcatgtatctgtttttctcctaggcccactctgtatgttgggaaatactctaccagcctctatgcctctccctcaatggtacacgagggggttgctgtcgtggtaagtccactacggagggctcgcagctgcctaaccacttctgttccattttagcaaagaatgactttgctatgcatgagcatcctgcaggttaagaatgaaaaacacaaatcttaagttctcaaaaacagtttctgcacatgccacattctactttgaaagaaagatacatgacaaaaacagcttcttaaagccgaggaatccctgattattcccttttgcttttgtgatcaaatctaaactccccaggctggtgttcatggccctgcttcatccagtcccacgatgcccttcctccaccctgttagtttctctatgtgagttgcgtggcccaaccatgtgcaccttctccctgacttctacaagccccatgttcatctttccccggggcctttgttcaggctgctcctcacctcacacttcaaatgccctttcttcttccttttccctactcaaaccctttgcatgcttttgcaatctcgccgagcctccttgggcctcacaagcctgcctcaagcattctgtctctgaaagtccaaggcgtcataatcctagctgtttgtcctgatccctacaatgcttgggctgtgtggttggctctcttgtcttcccagtgatttgggcggctgcttctgtgaatagacagcgcctgcctctgtcatagttccagcagcacctgagccagcactgggcgtgtggctggactttattccgccccattggttgcgtagattgtgactaacagagatatccattcattctccttcacttatgtctgcttctcataatagcttcttggagttctacacacacacttcttgttccccagtacccagacataagaatctaaaaagacgtccataaagacatcagtgcagcttgtcacatcctgagggagaagcttctttgcccagactttgggcctttgtgtcttgctctgtcctggactagccctgcactagaaattgctcacctttcaggacagtggctgggatggtgtgccgtgggacccgctctccctccagggctcctgaccctcactgcaccctctccacagccccgcggcagcacacttcctttgctggaagggccccagactgatggcgtcaccattggggacaagggggagtgtgtgatcacgcccagcacggacgtcaagtttgatcccggactcaaaagcaagaacaagctcaactacttgaggaattactggcttctgataggtaagagcaggtctcccacagtagcctgaggtgacagcgtgctgcctcctggtgggcgaccgccggccctggtagttacaccgtactgagctcggaaggccttgtgctcagagcccttcccggctggcccctgagaccttgggacatttttacccccaaggaaaatcaacaaggtagctgtgtttctgagtcagtttttgaaaactgtttaatgttccaaaactcaggtactaaattaatgtaaaccttgtgtgagtatccgacattaagccctttagaatgcatttcctcactcctcacagcaaccctgtgtgaggtaggtacccttgtcatttccattttatagttaagaaaactgagactgtttctatggaagaattaacttggagtccacgtgggcatgagggtgaggggttggagaggcgagggctgaggacccgggagggattaaatcccaggatggattgagagcagcagagtcaggggctggttgtggttctagggcagtgtcatcccaggtgtgtgggaaggtcccttttttcctctttctcttgtttttgctgccatcactaatggccagggattgaactagaggccctgtcccaagagagataagttgagatgacacttcttgagttggcagtgagtgtgacaaacgaaggcggaagtgagaagagctgtgttcctggcaagtgtgccaagtcattagagcaggagggagttttcttgaaccccatctgcccttcctgtgccccatccctcactgttctgccacctcccagccccagtaggggcagagcagggcaggaggtcagtcgggtgctggagcacccaggggccggtgcagtttcttctctctgttctcttcctgtcgtgcttgctggtgacaggtactaggggagaaagaggtcagggctggggctctggaaaagagatgtggggcagctgggagcatgtggggaccaggaaacagcaggatctgccaggcagtgcggtgtaggtggggatgtgtgtaaccaggtattatggggggaaaccaggtatccttgagccctgctcgcttcctttatagattgtcaaggtccatttcttttttcatcctgtttccttgtagccatttttattttatttttaccaaataacgggtaaaggagatgacaaaataataatacgtttttattaacagaagtagttggaggagcatgtatgaataggcccatggtgagaaaaaaatagctaatgagaagaggtcattgcaattacaaggctgctcagcattatgtgccagttaaggggctcacagactgcccaccagtgattaagaagtggaattaaggaaatgtgtatatatgagaatacagaaaatatgggggcagggagtcttcatggttaacttgtaaaatgagatccctttaaaatggaaaggttgtccaagtaaggaaactgcgaaaacagcaaagtataaggaatctattaagtgtaaggatcccacaattcgaaagcctcttctgaggacctccaaagctcgtcatcttaaaatatggcactgagactatggcagtgtctcctgttgacgagggccacaagtaaaaggatatgccctactatgtccagatatgtcctttcattttctctttgtggaaagcattaaagatattccaggttgtcattaatcgtgaaaatacaaggatccaattagcttgagaggcatggtctgtgggttgccccaaagccatggccctgaccttgggtgctttcggcatcagagcttagttaactaggcatatataagcccgggagagcctgattcagtaggtctggggcagggcctagccatctgctttttgctctggaatctggacctaagagataatgatagatgaatacatcaaggagaccaggtaatatttgtacaaaatatttagtggtctcatgagtaaggttgtacagtggttggtccagtgtgtacagcgtgatatcagtgaaggcccagctccaggagaagcctgtttacaagaaggttgacagaagaactagggggattcaggctaatgccttccatagcagtctcttggcaggtgtcctaccagacaggtaggaccctgagcactgagtgggtgttgtgggaagggcaggacactgctgcacagcgtggcatgtggaagaacacctcacttttcttagaccgtaggtctcttgttagtgagcctcagagttacccgcacatactcacattcggattcctgggccctaccagcaagtctgattcagtggtctgaagtgggcagaccacaagtggagaaatcctgctcccaagcaaagcatgtctcagagctccttggtacacaagagaaactagtggtggctcaaaacaaaagtaggtttcccttaaagaatgatattatgttgtagatagagaactgacctaaagatgggaactcaaagaggaattttccagatcaagaaatgtacacagcttagactagttcctgtttgttgtcatcttggcatgtatgtcatgaaatctttgataggtttaggggaacaatggaaagatcataaggtgaaagagacgtgagtcagagtgagatctgctcatagccagagaacagaaaggaaagtcagccaggctactggcagcctaatctgaaacagtgacctggctctttggggcagtatgtggactcatttttagagctgaatggattatcaagccctatcaaatcccagttccctattctagtcagctttgtatctcttacagcaatttgcacacaatagatgctcaataaatgtgtaatgaatgctcagtagccatgcgatagttgtgtagtgaacagcaaatgaacgtggagcaagctatggccccatccatctagcaggtgtgtcctactgctttctcgcaagtaatgtaccactttccccgatggaagctcacatttagataatagtaggactggaactccacctgagcaatttaaataccaagatgggaattcggcggccatagaagagtgatgttacaggaaaaagcattgaaaggagaactccttgaacttttaatgaagcctcatcatacttcacctgtggatcgggcccatgcagccccacgagccttgcgtctggtgcctcccaaatgtcctgatccctgtcatgcaaggatacttcttcactcctcagtaggagacttggaatactgtattctgccatgaagtaataagggtcctgctttgatggaattttctggtaactgccactcattttctctaactcacagtcctgctgagagtttgcattgtggacccctcagtgggtagcacctgttgcctaagtttagcattgagtgccaccacagctcgggaaattgttctcactaaaggttttgtttcctgtcataggacaccatgaaaccccactgtctgcgtctaccaagatgctggagagatttcccaacaatctacccaaacatcgggaaaatgtgattcctgctgattcagagaaaaagagctttgaggaagtgagtgaggaagcgaccagtcgggggttgttggtgttaggtgttgggagggtgaggcattagactttgactctgccttctgagcttgcagcctagtctgggagggaagaggaatgcaccagaatccaaagcaaaaaacataaatggttaagggctagtggagaggaataggaagcaacttgtgaaagaaggtgcaggaaaggcagcaggaccaagctaggcctggacctggatgaatgggtaggatttggccaggtggagggagcaagagggcacaggagggaatggaacagcaagggcaaaagcctggagtgggaagaatgctggtgtgcccagctcacaggctgtggggagaaaggcctggccagacccgaggctactaagtagggggtagtaggaaatgggctcacatgggtaaaaaggaaccatgttacagggcctgaaacaagccctgtggaggagtttaagagttgttgaaggctgggttgggtgtctcacacctgtaatcccagtgctttgggagaccaaggcaggaggatcgcttgagcccaggagtttgagaccagcctgggcaacatagcaagaccctattgctaaaaaaaaaaaaaaaaaaaaaaaaattgttgaagaagtgatgagatctgaagttttatgaagcagacagagagtggcctgggactatttgcacagagttccaggggctctcttagcacaccttggcctaaagccagaggagagggagtagaaaggactctagaccgggagctgaaagcatcagttgaggaattcagcagccccacagaagtcaacctctttctcttacctctctctctcatctgctggtgtcccctgttagctttacccagtcaaaaaccccagggggttggggaagccattgctttggcccatacaggtcagccttctggggcacagagccggtggaggaggtggaagggtggctctgcaggagggaacccaacatggccagggaaggggaagaggggacgtctgaggcttagtgaccgattcaggcctggcagcttcagcagccctgccatggagggcccagggacagagatgcacctgggctacatgagtagggtcagaagaagaagagaatggctgactgatgccgagaccaaaagcacaacaaactcagttgagagatttagattttatccagagacaaaggaaattgtagactttcaagattccagggcacagtatctgtttaccatcatctacggaagtagccaggttggagaaatacattgattcctaaaacagcaatcttaaacagcattgtcctataatcttattaaagtcctgcatattcattattgaacacttagaaaataaacacatacagaagaaaataagacagtgcccttaatttaacacccagaggtagccacgtgtcaaatctttgtatttaaccatctggtcttggataacggtctttgaaaaagtatgttttaaaatactctcaggtgcatctgtatggtgatgagacatacagatgtccctggccacatgcccaggtgcttcctatatactctgcaggctacaaacccccaaaaatgtgggaggcactgtgggagaggcatgaataagaggggtacacctggaggggagagaagaacattctaggcagccatctggggggaggggtgaaatggcgtgagcgtgtgggaggtttagcatgtgggaaattcagcatgtgccagggaggctgtgttagttttgttgggcaaatgataacggcatacctagaatactagatatttgaaagtgagtcaatgcatttttctaaatgcctgttccgtgaagtcttagagattctgaggaactctagggaagctccatttttatctgatttaattttgggcttctaaattttctttaacaaacgcttctgatgcttcttaaaaactttgaagaaatagtggactactggaataaattataattttgggattgcactgacagtttacaggcaacacgagaaaactgctttattgctttctagccatgtgcctctgtatacgtgcggatttccttttaatgtgaaatggtattattaaatcaaataccaatttttcaccagactttgttacagatgacttcagtgttttcctggatactgaacctaccatcaaaggaggaagtgtttgcctttttgaggatttttgaaaaaaatatgtagggtctgaagacacctgccaaaagtattgctccaaaaactatttttgaataatgataacctcactgcaaagatgcatggcctctcaaagcaattgctttgaaagaggcaacagttatctggctacatgatctttggtgagcttaaaacaaataaaaccccctgcagtacagtcatatccttgtaaacagtgattgcttctcttgattgctggcctcatctgtatctggctagaaattttgcagtgatgtcgcaactctctcccatgcaaggttatcaacctggttgaccagacttcagaaaacgcacctaccaccgtgtctcgggatgtggaggagaagcccgcccatgcccctgcccggcccgaggcccccgtggactccatgcttaaggacatggctaccatcatcctgagcaccttcctgctgattggctgggtggccttcatcatcacctatcccctggtaaagctcaacaattcccctttgccatccacctatttctggggcttctctgcctgtcgcctcatgtcagtgagatccagacaaaaacaaccagcacatttctttccccatttaaaagtcagtgtttgttggccgggcgggcacagtggctcacgcctgtaatcccagcactttgggaggccgaggcgggtggatcacaaggtcaggagatcaagaccatcctggctaacacagtgaaaccctgtctctactaaaaatacaaaaaattagccgggcatggtggcaggggcctgtagtcccagccactctggaggctgaggcaggagaatggcgtgaacccgtgaggcggagcttatagtgagctgagatcacaccactgcactccagcctgggcgacagagcaaggcgacagagcaagactccatctcaaaaaaaaagaaaaaaaaagtcagtgtttgtttatcttcaaaaacataattaaagagacactagcctcccagaaaaggacaattttgttcctaaatcttagtgtttttcagctaagagctgatttataagccttgctcaaagatgattttgaatagttatctgtatttttaaagaataaggataatagatgaagacctttcctcccttaaaaactgccattagaacttctgctggggagaagaaccaaaaaaagaaaaaagaagctgcctgtgagatcagcttgtgtgaaaaaggcagtgtggccatccctttacttcctagttggaaatgagcaagttctgtagcagaacaggccatgggtgggatgaaatatgtgaggggcatggtccttcagcaggttgctcagagcatcgagatgctgttacctgagagctcaggaagctaatgacccgcccaggaatgggaatgacagactctttatggcactccccactggcacgtctgcacctgatagtttcacttttcacctcactcagtcctatgaggtcattattattgatcccttgtccacaaaagaaggaagtagaccctgagaagctaagtaactttccccacgggtacccagctagtagacggcatttctaggactccaccccatggtggagagaagaagagacgactccctggtgggttggtggctcacagaagtcccttcagtccacctcctgcacatgggtagggatgatcacagatcgctgctacttcagataatgacagaatgaatccttcagagtatttgagaggcatgtggcctcggggaaggcagtgggatgaaaggcggaagcaggacctcagccaggctcaccatgtgtcagccccactgccacctcctggctatgtgtatgcagatgtactctgcatacctagaatactagagcttcctcacctgcccctctggattactgagtgtctgtgcgctagcctctagccaacacacagacacggtgggtggcgaacctggggcttgctctcacccaccactggctcagccatgctacctgtgcttcctgtttggtttcacctttgcaacaactctcagactttcatgaaaatcacagaattttagaactgaatgaaactggcacagccctcaacctagggcacagtccctcccctggtggccatccagcccctcctagggttggggagtgggctgtatgagcaaggatctaactagtcggtggaaagacgtccagtcatcgaagcaattctgcttccaggtgccttctcactggtctctttgtgccctgttgggtcacataaagtacacatgctccctccgccactgggacctgtcccttcccagctgcttgtttccctgtgggaacagctgcccttgtctggatgtgggtttctcttcccagagcatgcatcagcagcagcagctccagcaccagcagttccagaaggaactggagaagatccagctcctgcagcagcagcagcagcagctgcccttccacccacctggagacacggctcaggacggcgagctcctggacacgtctggcccgtactcagagagctcgggcaccagcagccccagcacgtcccccagggcctccaaccactcgctctgctccggcagctctgcctccaaggctggcagcagcccctccctggaacaagacgatggaggtaaagccagttgccatcttggtgctattttatgttttattcgagcacctcctgagaagtccaaggagtctccataagattgtaaactaccattctcaggggttcactgtgttctcctctaacttccactctgggggtctctgtgggaaggcttctgccccatcccttggcatctccccttcagagggccttctgggaaccaccctggccatcctcctgtctttctccacaagggctgggcgtcgcggctgaccagaggtgagctgcccattgggctgaagagagttcccagggccagccggtggccaagtgtggaagtgtcacagttggtctgctttcctctgtggaagttggctcaagccagttgtcagagccccaattctgagggaactggcacagagctggtgcagggaactcagagccctctgtcccaaggagtctcctcgttttacatgtccattgccgccacctgaatgcttcagtgcggatctttacagtggactttgtggtggttgttaactattaaaccattctaactatatcacaatgaatatgtataagtgtgtgaaacgctatggagaatccctgccttccagaaggttttaagatatgcaatcgcacaataaggtaaaggcggagacagaatgcaggggcagggggaagaggcagtcctgggtgtacatggggagtgggcctggcaggctcttgctgagcagcagtctggggtgcagtgcctcttaaatcccatcttttaatctgaggtcaggaagcttgtcactatgttaacctcaaggttctttaggtgatatctgtttgaaacaatctctttttcctattttgtcccagatgaggaaaccagcgtggtgatagttgggaaaatttccttctgtcccaaggatgtcctgggccatggagctgagggcacaattgtgtaccggtgagtggattagccagccccctgccctcaccgcctggtgtctaagtgcctgtcaggttgcgagcctggtgccaggctcagagcacagcagggtcaaagcagtgacctagacgcatggagtccggcctccagggagcttgcacactgagacaagcgatgattccggggccaccaggcagtcaggcggggctctctaggctgggaggcagtaggtgaatgctgtggacccaggttctcacctcatttacacagcctgactcgtgcttcccagacacaactcccactcctcatcccgcaggggcatgtttgacaaccgcgacgtggccgtgaagaggatcctccccgagtgttttagcttcgcagaccgtgaggtccagctgttgcgagaatcggatgagcacccgaacgtgatccgctacttctgcacggagaaggaccggcaattccagtacattgccatcgagctgtgtgcagccaccctgcaagaggtggatttattttttttattttgttaactttattaaagtcatagcactttgggaggccaaagtgagcagatcacgtgagctcaggagtttgagaccagcctggacaacatggtgaaaccccatctctacaaagaaaccaaaaattagccaggcctagcgatgtgttcctgtagccccagctacttgggaggctgaggtgggaagattgcttgagcctgggagatcaaggctgcagtaagcagtgattgtgccactgcactccagcctggacaacagagtgagaccccgtcaaattaaaaaaaagttacagtgaattgtactaattttaaatgtaatagcttgatgaattttgacaaatgtctatacccatttaaccacatacacagtcaaaatgtggagcatttttatccctctggttgtaacagggtggtccccccagcatgcctgggcagtctgcttgcagttggcatgtctctccctctttgcctccaggaaacctggacagttgttctttccctcttcagtcatggctggtgtgggcttggaggatgccagttggtaactccaggctttaagatcatccagcaagctccttttgctcattttccaggctcactttgaaaccatatcagtatcatttggattcctttgtaggtttacttatatgaggcaatgaacttgagtttcttgccttcttatctttctcattgtaaattagtagatttggaggtttgctccttgctggaaaacatggatttagacagaatgttgtcagtaaaacttgccatttctttcttaaaatggtatcaaagaaagtgagccgaggggccaagtcctgaggactgtgtgccgtgaccttgctgtcatgtcttttgcagtatgtggagcagaaggactttgcgcatctcggcctggagcccatcaccttgctgcagcagaccacctcgggcctggcccacctccactccctcaacatcggtgagaggctgcactttaccaggccagcggcccgggtggggagaatcagtggcccaggtggggctaaccagtagctcgggtgggccttgcttctgttcaagctcttggctatatcaccagtagcaaagatgagtggtgtaagaatttgaggaggaatccgacatagttgaaaatcagaacatttggaggtggcggcaggcatattgggagtctgacgaggacacattccccattggaggaggcctggggttgctcctggtaagcattggactaatctggagttctctgttagttcacagagacctaaagccacacaacatcctcatatccatgcccaatgcacacggcaagatcaaggccatgatctccgactttggcctctgcaagaagctggcagtgggcagacacagtttcagccgccgatctggggtgcctggcacagaaggctggatcgctccagagatgctgagcgaagactgtaaggagaaccctgtgagtaataggctatggccctttgaaaactacagaaccagcccattgtatcttcaggagtagaacctttaaattccaggtttgggggctggtgcccgtgtagctggagaatggcattcctttcaccaagagcttctgtgtgaacattctgtgtcatctcatgttcagctgattaaaggggcaaatgtgggcaattatctattttttttccctattcttccaatcacttgttttttttttttgtttggttggttggctgtttttttgttttttttgtgtgacagagtcttactgtcacccaggctggagtgtagtggcatgatctcagctcactgcaatctccacctcccaggttcaagcgattctcctgcttcagcctcctgagtagctaggattacaggtacctgccaccacacccagctaaatcaatcactttttaacccctttttaattttggtaaactgggaagtcagggcttgcttagcgtgagcaaacttcaagttttcattatttttaaaattttgtttttgttttctcaacttattttgataatttttagacatagagaaaattaaaagaaaaaaattttttagaagtgcgatctcgctattttgcccaggctggtcttgaactcctgggctcaggcttagcctcccaaagtgctgggattgcagacatgagccacagcatctggctgaaagaatgttaacatgaatacctgtgtatctccacctagattcaacatttgttaatacttttgccacatttgctttatctttacctattactgaaccatttgaatataagtagcaggcatcctggcccttcatccctgaagacctcagcacgtgtctcctaaggaatacattgtgtttccaaccacaataccattatcccacctcaacagttaatactgtttctatccatcatctcatattcaatccatattcaaatttccccaattagtccccaaatgtcttttatagagttggtattttgctacctactgggttttgatacctactgggttttatataccaggatggaatcaggtgtcttgcgttacatttgattctgtctcttggaatttacaaatctttccacctatattttgttccatgttgaagttccattttgaagagtccaggcagtgggttataggatgccccattctggtttgtttgcttttttcctcatgacagcgttgaacatttctctgtattccttgtatttcctggaaaccagaagttaggtggagaggcttgattaggttcaagttaaatgtttttggcacgaatgtttttggcaggtctctacatcagaaagcatgtgatggcagattgtatctgtaagattattatcacctcctcttagtgatgctacagctgatctctctaccataagggttcatttcctcctctcttgttagtatttggggtgatacttcagcacaatgtgaatatcctgtttactgacagtcactcacccagtggtttagcatgtgttgatcacccttgcctgaagtactcagttgagtagaaattcttctacattgttagctgacatttttctgtaaagcagagctttcttttcactttcttctctctctcttttttttttttcttaatcgctatgggctcaaggattttgaaactaatgttataatccattttagtcctttttttgttatttacttcttttgatacacaaattgttccaaatttggccaacctggaaaccccttcaagctggcttctgcatccatttgctgggagcgcactcacacttgagcaccttattctagcacaagtcgccgaggctcaccttggacactccccgatggagacctgggtgggtcagtcatcttgagtggattagatatggctgcctcttatccagctcactggggaccagcagctggtcagatcatcaaagaagtcagttacagcgaagaatcataaaaacacgcacgcacgccgtaacacttaattttaacttaaagcaagtaatattagcccttaagtcatagaaatcttgtgctgtaggctaaggtcttttcagatttgggtctgactgactggagtcctcattttcccccttgcattaagcacacttctgtaccacttctgtgacttctgcatggaggcttggacacttcaaacacttcctaagcgatttgagagcagaagcctggtttttaacgcttcatgacccagtcccttacggttgaatccaccacaccaaatgccgcagcagctcttgtaaccattccctttcctttatcgagtctttctaaagattcagcttacctcagacttcgtggcactcatgtttaacagcttatggaatatccaaattacaaggacaagtggcaataataagtttgggaaagaacataattggggccaggcaggtaggaaagatgcctcttcaccttagtgttgtctgtgctggggacagcaggctgcagagagtgtggggggcgtgaaagacccagagagctctgggagtcaggggcgagctccagctgtggtggccatgttcctcctgtcccgaatccagcaccttcctaagggaaaatccagtgaggtagaataaagcatggtaggtttggagattggaagacctgagtcccatcctggtttatcacatccagcagtgaccctgagcttgtcatgcaacctttctgtccacgttctcatctggggatgaaagcatttgctctgctcgcctcacaaggttgttgtgaggctgaatgagagtgctgtgttgttcaaggtgtgtctcctccagcatgggaggtgatgagcccctgcttcctcacactagaccctcacttcacctggtggagaatctcagaggcagggcctactaacagggacccaagctgtgctcaggaaccaccttggtattacaccccaggtagcatgagctaaaaaacacaaacgtacatttccctcgaaggaagctattctgtagacacagaatggtttcatgggataagtgagaggctttctcggattaacatcaaacatgacctccttggtaacttgtcagatagtttctttctagggctgtttttgaatcataagctgttttattcacttattagcaattttgatacctactgtgtgcaggcaccattctgggccctgggggtacagcagggaagcaacgacacagagaccctgtctgtgagcactttcgtgttgggggtaaggaatatataacagccaggagggcttttgatgggccaagcactgtcgtaagcaaccatttttgcatattaatgcatctcttttgacaacagccccatgctgtcagtgtcctcatctcacatgagagggaaccaggggcttccaggtggctccaagcccaggttctccactgggacctctgacacccatgcagtgctgcaggttagccctcgctgctctgtgcagctcacatatgtcagctgattctcccaggacaccttctaggtggcagaagcagcagcaatgctcctccctccctgactgtgagtgaggatgaaaactctgctcccagacctctcacgcctcatgtctcttttcagacctacacggtggacatcttttctgcaggctgcgtcttttactacgtaatctctgagggcagccacccttttggcaagtccctgcagcggcaggccaacatcctcctgggtgcctgcagccttgactgcttgcacccagagaagcacggtgagcggtccaggggttggggttgggagcagctcctcagctgcctcaggtggccctgcagagctgggctggtgccacctttgcactcacagaggccgtggtgccccagctgctcaccccgcaggcctcaggacctccagacttgtgccaaatctggtagagggttggtagggttatctctggggcgccaccttctaaagctgagatgctccaaggttcctccaggtcaccaactacttgtgtgacctaggcaaagccccctttggagaccttctttttctacctggtgacatgagggttgaataatcagaggtcccttcctgcactggcatttgggaagacaaattgtcttctctcttgggatggcgagtggtcagtaggtgcagtctgtgctgggctggggacagacaagctttatcctcaccctcctggtctcctggtatgggtgcaacaagtctttcttccagacttcaggttttcctgggtggtaattggcccatgacactccagtgctgccttttgaaaaaattacaactaaattattgttttgtttatgcttaatttttcttattatagaaaacacagattagcataaaggcccatatattcccattatacagggatgaatgatggctattgatacctttgcatatacgttattccagtcatttatctagacgtgattgcatattttataaaaatacagttaaatcctgcatactgttttgcagcatgcacgtttttcagcgtcaccttgaatctctctccacgtcaatccatatttagtcacagccgcactttaacagctcatggcccagcgtagggaggcaccgtagtgtatccacttgggcctctgatactggatgtttacagtcacttccttcacaaaccatgcagtgaggactcacctctttggctgaggttttgtgtctgttcctaattattttattggaataaattcctgtaaatagaatcataaatgagagggtgtgcagctttttaaagtttttggtatttcactgtggctttggactggtagtcatgagttgcttattttcctcctttatagaagacgtcattgcacgtgaattgatagagaagatgattgcgatggatcctcagaaacgcccctcagcgaagcatgtgctcaaacacccgttcttctggagcctagagaagcagctccagttcttccaggtagagacgtctgttctctttatccagagtcttcatttaatgtttttcagattttgaaaatacagaaaaggacaaagaataaaataaattgcccattaccctaaaactggaagataatcatggctgatgttttaatgttttcttcatatataaaagtataattgggatctaaccgtatatacagtttcagaatccctttttttaactgtacatgatattttaagtttctttcatgttaaagttctaaaattccaatgaccatagtattctatcatatggatgtgccataatggttaagctttatattatggaatttccaaatatataatacataaatgtttaaatgctataatgagcactcctttattcatccctcaggttcaataaatattaaccttcaccctctccccaccccaggttatttcgaagtaaatctcaggcatcatataatttcattcaagtgtcataagcttatttatttatttttattttttttgagacagcgtttcactccgttacccaggctggagtacagtggtgcaatcttggctcactgcaacctctgcctcccgggttcaagtgattctcctgcctcagcttcctgagtagctgggattacagatatgcaccaccacgcctgcctaagtttttttgtatttttagtagagatggggtttcaccatgttggccaggctggtcttgaactccggacctcaggtgatctgcccgcctcagcctcccaaagtgctgggattacaggcatgagccaccaggcccagcccaagtgtcataaatttcagtgctttcttatattgtatttgtttctatcatcttttacacagtcttggcccagatctccttttgcttaaaataggttctgcaaagttagaactcctttggtgatttgactgttttaaagctttgtgacaatgtcaggtgacttttgaagaggtaatgtgtttttcaaagtcttccatgtatgaattgaacataactcacccgaacgcctcctgcccagcacgtggctctgaaagcaggcttgtggggcagtgcttttccccttgggtccaggcagagtgcagcttggtgggcaccgtactgagaagtgaccatcatgctctcctggggtctgactggggccttggccagagggaagcccccagaatgtaagctcctcgaggacaggagtgcttgactgctgcattcactactgtgtccctgcctcctagggaggacgctgcctggcccaaccattcagatggatcgggttgggaagagtttaatgctgtcttccatgttgtagcatatggattggtcactgtgtccatggacataatgtgaaaattctcaagtccatatgtcttccagggacttgtgaaaactaaccaggtcattttgatcgcaaaatatagaacaggaataaaacccacacaaagggaccttcacccaccaagggacaggatttaaatgcttagtatctccaggtcatatgtctctcgaacacacctggcttccactcaggtcatttagccgtaacagctttgcagctcagacacgtgtgttcccagtgtacccaagttgacaatctaacctctccacagcttctctctgacaattgtaaattaggagttcagccagtctggcttcatcttcatcatagaaaaggctgctctgagaaaagggtctcctaaggctacttaacattgatgtagacagggctcaccactccctgtgtcctcagctgtcgacctgtcttactggtgggacttcaagaggccatacttgggtgcttcctgaccctctccttattaccaaagtcaaatgcagagcaaggtttgaatcccaacaggagcctctggagcccatactcttgccaccaagtttcctctttgagaagaaggcccagcttcacaggtcttttctactggtggagggaagagtggcgaccctccaccagttatgggcttgagcataccctgtttcagtgagtagacaaagcacgggatgcacatcaaatctgagctttccttttctttttggttttggttcattggatatagattgcacttgcggctccgtacacatggcgtgtgtgtgcacatgtgaaattcagggtatgcgttcgtggtctatatgcaggtgtactctgtgacacctctctgacatgggagaagctctctgtgggcctgtgcttcgtgaggaacagagcagctcacagggaaagtcatggatgagggagggagggggcagggtgcctgctgcccagctctggggcaggcttatgtgtcagtgatgatctgttactgagtcccagtcgcacagctctcagcatctccagcactgaccatcatctgctgcccttgtttctctcacaggacgtgagcgacagaatagaaaaggaatccctggatggcccgatcgtgaagcagttagagagaggcgggagagccgtggtgaagatggactggcgggagaacatcactgtccccctccagacaggtgatcatgctgcagcgtgtgagagggcaggttgcaaaagtcgctgccgcctttccaaaaagtaaacgtggaaatggccgctccaggctgttcaggccccacatcccacctgtcaggtttgagactttcttgggtgtgtcctctgtggtttggttacactgatgtgtgtttcatttttgttccctagagtgacaggtgagtgatggtgtcgtgctctaggtggtcatttctgacctgggtgtgatcaccaggtggggttcagggggataccacccttgggttggatgggaggatctgctcccatgcctaggtgtggagtgacctcacctttcagtccaactccctaatcccaggaccccatgaattgttttcttttaaaatgtattagttttaaatttgattacccattgcttccctcaatgtttttctagacctgcgtaaattcaggacctataaaggtggttctgtcagagatctcctccgagccatgagaaataaggtaagcagtttgtaaatgctggggaggagacccagtggccatgacatggacaccttcctcctttcatccattctttataaatcttttatctgtactggcattctcatctctcaggagctaggcggcttcagctggacttggcaaactgcaggctgttgcctctcttacgctgattttcccttcagggacgtaggtgcaggtgaagctccgggaagcagtgctctgcggcccatgtccctcatggtctctggtcgctgacttttgtggggccctctccctgtctgatgcagccactgtgtgtaaacatgtataaacatacctcaaatgcggggaccccactgggacggacactccaatctcaggcgactttactcctcctgaggtggccaggagtgtctccaggtcctgactgtcacagaaggcctgagcaccccctggactggctgggccttgctcacttcaaggcctcctcctgagtgagggtagcaggcgagatgacggggctggattcttggatacataagccttttttctttttctttaccaaaaaccaacactcacattctgtctcttccttgcatgatgaaagggtgttttgccaacatttcccgagctttctaacccctttctaatctcccgagctttctaactctttgcagaagcaccactaccgggagctgcctgcagaggtgcgggagacgctggggtccctccccgacgacttcgtgtgctacttcacatctcgcttcccccacctcctcgcacacacctaccgggccatggagctgtgcagccacgagagactcttccagccctactacttccacgagcccccagagccccagcccccagtgactccagacgccctctgagcgagggcggcccctctgttctggtggccccagctgtgactgagggcctggtcaccacaattagagcttgatgcctcccggctttgcagggagaccaggcttcccaaaccaagtgccttgagctgcctgctctgcagcccacagaggacagtgctgaccccaggaagtgggagaagtggcccctcgtgacctacagggaactgggaagatgctggccccaaaagccttacggtcatgatgtctgcaaaggagggcctcagagacagcgcgagtagcacccccagccatctactggataaacttgcttcagactttttaaattcctgcttaatgtcagtctacaggcctttcaggaagggagaggagggaatcgtacattttgcttgcgtgctgggacagctaggctgagatgcaccaagtacagccttcactggagaccggaattgagaggtgggggatgctgaggagggggaggacggagttcagagggtgtcgtcctgcagtgtgagatttctcattgatcacagatgtgcccagagtagcccaggtcactgttaactagtgtttctgcagaggcagcaggagccatgagcatgaggtgtggcattagggactggtcagctatgcatgctggcaggtggggttgtgtctgcaggtctcagaaatgaagaggctgctctgttctggaggcagccgtggcccagtgccagtggccagaacagtggcctttggtgggtgtgtcccgggccatctcggggtggtgctcaggagcgcctggggcaagaggtaaagagttccctggccttcaaggagagcagcgaagacccagacaggggccagccttcaggaccagagggaggccgccgaatgggaccctcctggtcaccaggagaaagccctgggccagcgagtaggcagtcaaactccttcgtccccaaggccggtggaacaagaggctcgtggtgagtcagggccagggtgggtggccaaggccagggtcaccgtgtgcttcatgggccagcttttttgtttttcttggcaaattttaataactatattttgattatactgtagaatgctatgtcagcataagtaagctaaacttgaagctttcttgtgaagaataaatgcaagatagaatacatcttctattttttgtggtaccaaaaatcaccatcccctcaagagtgttcatgtatagaacattctctaatgctgaagagtaaaacattatagcaacactatgtaaatgtattgaacagtatcaaagaaatagtctctaaattgtttgtaccatatttttttttctaaacttaacataatttttagctttagtttcagtcaaaactttgtcttttctctcccgagagccttagaggttaaaatgcaatcagcctaccgtgtaaggagatgttgtccatgtactttctccagccagttgggggatcattgcagctcaggcctggtgaactcagagattccattcagtattaagaatgggattgttgaattttactcacagagaaatcactgtttcttcatgttgtaagatgttttctgtttgtgtatttgtatcatggttactcatcaaaagctctcattctgcctttgtagaattcagttcccttcctttcatcatagctaaagtgacttttttccctactattaacgtgatcctacatccttaaatctcatcgattacctcacttaggccttggaaccttggcccttggtcggtgtccttggcgtcttctaagcaaggctgtgcgttgttcagaaacgtggccagaccgcatttcctgctgctcccatgccgcatgccaggtggcctgagacagagctccccatacggctgcaaggtgctttacctgtgggctttggcagtaacccaagagaggatcagaaggtggagaaggtgccacgagtgatttaacaggcctgccacagggagtgcccccagcccagctcgttctcagcacaggttttctctttgggagtacccaggtgatttctagtgacccaattttgtgtcatctccctgttttagccccacttgcctagagacaactgtttccgatgccttttctgcttatcatactagtttctaaccacgcagatttctcaaaatcatttattcaatgtattttatttgagcacttagtgtattgagctaggcaggatatagggtgccggagatacagcgatgaacaagacaggcaaaacttctgctttcctaaaacttgtgatgagagagaacaataaaaaagtgttgctgccacaaagaaaccaaagtgtgtggggaagggcgcgtgtttgcggtttacatctcttctgtcccagaatcacagggatctggtccggtcacctctggtctttcctcttagtcgcctttaggagccctggttcccgtccatcctctggggggtttgtttgaagagatctcgtgtgggtacttgtcatgaaaacaccttgggcatcatctggtgtatccagttctagtctcgagaattctggtttcccactgtgctcagcaagtggaaagttcttttcaggccagaacagctctgcaccatcacatatcgtgttgcggcttagctgtttggtctgtagttcaggttatgggacttctccaatcctggaaggctgttgagctttttagaagtactgtacgctatcttcaagatggagcttggtcacatctgttaggaatccaaaggacactatgacttatttaaatcttgtcttactaaacctctcttgggcacgtgtgccagaatttctcttgttgcttcttgagtctttttaatttcagtgttttttcgtttgttttttgtttttttgagacagagtctcgctctgtcacccaggctggagtgcagtggcacgacctcagctcactgcaacctccgcctccttggttcaagcaattctcctgcctcagcctcccgagtagctgggattacaggtgtgtgccaccacgctcggctaattttttatattttttttagtagagacggggtttccccatgttaggcaggatggtctcgatctcctaacctcgtgatccgcctgcctcagcctcccaaagtgctgggattacaggcttgagccaccgcacccggcctaatctcagtttttgaagtgctccacaagtcattaggcaccaaaacattttcacctggggaacactggcatttccctgattagctgtgaagcaatctagtggctaagtgtgaaatcctgggtgcgcaggtgttctcactcccgccgtgttctcagtgcagtggtggtcagaggcccttccaaggagacatcactctgatcagttacagatagatgttctggaagatctgcaggtgagtagatccagcagagtttcttcccaccaactctagaagaaagggccttatcagagttgaccctgagcctttggtaaggttttgtgtgcatgcgattcagttatctttggcaattcttttcttgctgcagtgagagattaattggttgctgatcaaaccgttcatgcagatggggggacctttggattgtacggctttctcctcttggctgctttcttttcaggaagttggactttggccaggtttggctttcccagagccgttcctttctctgtcctttccttgggtcctcatggtgtgcccattggatccttggccttgtgatcctctgggaactgggggccagttccacttttgcagccttctgtgctggaagagaagcccagcgccctggaaggagcctctttaagtcccccatgtcgctttctctctctgctcttttagtgtctgagattgcctttctttgaatttcccagtgtttcttttccttgtcccttccctcaccaacctggagttattttggttgactatgtcctggctttggcttctcctggcaggaagtcatcaggcatcctctccaggtgagccgaaattccaccctcccaggttggacatcatcttttaaacccaatggtctactcccctccttctttatgaaacagtgatttcccgtgagtaactctggttctgattttttgtaccggcgcttaaattctttctgtagacgttggaaagccacaaagaacgtgactgcagtgagcctcccactggagcagccttaaccaacactttggccaaagcccccccacctcccctgtgtactgtgtgtgtgtttggtggatacagtattccttttcagtgtccctaaagctgtgatggggagtccccacttacctagaaagcattaccagtcacctactctgcattctcagatgtaaaccttgtgtagtgttctttttgcaatgacctatttatttaacctatttatatttatttaatttttactctgaaatgtatccagttacaattgtacttgcttaaagcacatcagatttgttttggacaacacccttgaccattttaaaactggaaaagtgatactgtatccttccatgggatggatgctttacagtagtcttattattaaagggtgattaatttggtcggggtaaaatgttaatttttaggtgatttttaagaattctgtgccattatgtcttctgtgtggatggttaattgtttaattagtacgtgttaattgtgtgatacagtcttctttgtggaacccaaaatcctctttttagctttatattttataaactgccagattgtacaacttttatgtgcatttttaaagcttgaagacatgagggtcattatctaagttaaacagcctatttttgtgcctcctgtacagttttataattctgctgatggcggcatcttatgtcgagccaaccacaataaaggtagttttagattttgga

SEQ ID NO: 205 - DNA, 109167 bp, Homo sapiens
  source 1..109167: mol_type = genomic DNA
tctgcggatgctgaagagtgattttcaaaacatttactaacgctttcaattatttaccccattaatggaatttgtcaacagactggagtccttgacaggattgtgaatgcatagaggatgcaaagaaatggacacactgaggtagctatgccagtggtctgcatgcgcaggcagtaaactgaagacatttgagcggtgaattacttggtgagtagttgacagctcttgtttataagaaagattgtaatggggggaaaaaagacacagcccacctgggagctgagacgctgattgagatacattagttttactgcaatatgtagtaaaaaaaaaaatttaaagaatgaaggaaagaaggaaagaagggttaaagagagccttcgagatactttaagtcaagatttgagctcaaaggctctcatccaagctttcgtttagtttctctcatgattctttttttattgcttcctgatgttgtcttatacaagctgttaacttgattcaggctgtaattagaaagacaaatcaatctttcatagaagtcctcggcttgacaagctggtatgaggagccatttccctcagagctatttgtcatagtctttctttgtacatgtttaacgaacggtggttttctgtgtgaagccaggcttcccatcagattgtaaaaactacctgaaatgaaattatgcatccctatgctctagccgctttccatggaagtctgatcccatgcaggtgttcacacctgagtaacctaggcaatggccccagaacaactgtgggccagtagtattctatttccaaaatttcataccttcaaactttgttttagttatatccacatttcccattaaccccaggaaagactttagtgagctaatttttttccttaaaccaaaatcagcaggtggaggtttagggcatcctccccctatcttgcccctttctttccctccctccctcccttccttccttccttccttccttccttccttccttccttccttccttccttccttccttccttcttctctcccttcattcctccctccccttctttccttccttctttctcttcttccctccttccctctcccttcctcccccttcctcttttccttccttctctcttcctcccttccttccttccttcccttctttttttcttttttcttttttaaagaataagtttccttctgtaaaatcttgagttgggggatcaagactaaatcctacagcaacataaaactttctggttgtccagggagtcctaacagagttagaaatatcaccaaatgcatcacatcggtaccagaaaaaatgtaagggcagaccttcagcttgggaaatgtttatcttgcagttaacaaagggaaaagagcaacaaaaactgagagtgaatgccaagggacactttgtggcatgtggcctgaggagggacccgtgttgtatgaattttagaaatggtataaaaaatctaactttttagaatttggggtgggcattgtgcttaggagttacctggattataacacaaaaatgccagccttacacctagaatggacagttaatcactttgatctgaggggcaccaaaagtttcttcatttttttgctcaaaaagtagtccatcctcctttgcctacctgcaactgatgcttgaaatagacattatattattagagattaattattttggcataaacttctccccagcccttaagagagaacaaacaccactggttggggaggaatacaggaaagtgtcaaatattatcattcatttacatattagtgcaaatcatttaaagagtttctttctttagagttgttttctctccattaacgagagggcagagagagctgtgctagaagtctgaagacaaactttaccccttgataattttgccaaaggtgggtcttgattaaggcctaaaatagagcattttaaataacatggtaatacaaaacattttatttgtgctccatatctcctcttcagtattaattcaacatatattttttgcgcacctactatgtgtcaggcactgcgaagggcactggagatttaatgttaagcaaaagcaagcagggaacttactaacttggttttctccctcctgaggtacatgcttgcttttcttgtttagatttcttggccaggcccttatactctcccattttttttttgtagttagtcttagcacagaccaacttctcaacgtgtgtttgttattaatgataataagataaccagtgattttaggagcccaggttttcagtgtagcataactccagcattgtcggggagtggggtcttcacatcacagaagcttgacagaggattccaggccaaaattaaaaatgatcaggaactggatctaccagatagaagcaagtactttgggggaatccaactccagtgagaagctaattagagcagcaaaggctagaaaatgttgaatgaactcagcagtttcaaagtgcagaggtttagaaaagtaactgcctagacaaagtacagaatcccaggatggatggaggtcagagaataaagggacttgctgatctgctagtccagctaaaggggaaaaaggagagacctagagtaggcaacaatctgttcaggtcacatggtgagttggtgcagaattgggtccaggaccctggccttctgattcccagtgcagtcctctttccaaatagggaggaagaaccagtgtttattgaaagacaactgtgcacttagtattctaatttatttacttctttatctcaaaatgattaaattaaatttacccccactttgcagatgaggaagttgaaaattggggctaatatgctgaagggtgtaccctcaagatttccattctcaaagattaggattagctttacatagaatacagtggaactggtgctccccacccccagctgtgcagcactgtgccctgagtgaggagtcagtgggcagtcccagggctaggcttgaacactagtagcaaattacttctggttggataatgaatttcttggtggctcctcccaatttactctgcccctccccaactctacctaatttattctttcatgggtgactggggaacttctttaaactgcaaatgaatgattcgaactcagtttgagtaacatagcaggtataataatggtagtctcattgacttcatagatgaggggctatctgcagaacttctatctagcacagggctcaatcaactggggtgcaaatctccattctaccgtggtttgcccttaggcaagttacttaccctttctgagcctcagtttcatcatctgtaaatagtgatgataataacacctacttcaaaggactgtgatgagttttttaaattcagtttttaaaatgagacaatacatggaaagagtgtagcccagcatttgacacacagcaagaactcagtatatcttagactttgttagtctaagtgctaatttctggattaaatgcacagatactgggaaggaacccatgaaactagtgtgtttggggaagaagaggcagtatgtcggctttcttgccctgttgctgtgaatagggttttgtttcccatatagagctgtcctcactgttgcacattcctagtggtcaaaagagtgaggcctataaggacagagagataatgtagttcaatatccttgtcacaatacagaccagaaatagagatccttcccatattactccagatgagtggctcctacagtgtcctgcctcccaaattttgccatggcagagaaaagagggaggctggaagaagctggaagagaagcttgtggctcttgactagagctcagctctgggttgggagctctttgaagcctgagtcaacacctcacacttcatccatcctgtatctcactctcatgcattcaacatagtgcacagaatagatctaattttttggaggcaggttagactggattatctttgagggcctaggaataaatttgaggctcttatgcatataatcagctcagaatcatctttccactgtccccaaagcaaagttagaagtcctcccccatcccacacacccctcagccactggcttatgttgttttgtgaactgtttgctcccccaagactttcttgactctcattcaaatcagctttcaccaatatacgaatgttggggcatactatttgtggtaggtctttaagattcactagatatgcctcagattggtctcttcaggagtcaaggtttctcataaaattaggagtgagagtcaagataataaccaacagggctggcacagacagaattgttgctgcccataaacaaccagtttggcctgattggtgcacaccagcgctgattatcagccctgaagaaagctatgccattattttgatctttgattagaattaaggatttactaaggattctccttattaacatctctgtgacctatctttaagtgttgtggggtctcagggttttgtcctttgtcttctttctttactccacaaaaggcatgttttaaattaccctctatcaattgattacactcaaatttataactcttattcagctttctattaagaatttataactcttgttcagctttctatttttttcctaggccctccagtatgtgctgttatctactggatattgccacttgttggccaattcaagatctctatcagaatgcatcgtctctcccacctccttcctccagtgtttcctatctcagagacttgtgccattttccaatcagtttcctaggtctgaaaagctcaaaatcatcctagagtcctcctttcttttcacttaccttctatatcttgtcagtcaccaagttcttgttatttctgttttcttaatcttgatatttttaatcttggaggagatgatcccattcctctaggtcttcactaccactctcttggtctgtcatcatttctcatatggattattgtgacagactccaaactggtctctttgcctccagtcttgctttcttccaactcattctccacattgttgctagagagatcctttaaaatggaaatctgataatactatttccctgcttaaaaccattgggtacagtattcaatcatggcatatcttggtgatctggcccttgccttgtctgacatcacagactcaagcagaacaaatgctttagaattctaagaatccatatatatatgtatacacacacacacatacatatatacacgcacatatatatatacacatatatatacacacgcacatatatacacacacacatatatatatagtctgtctatctatctatctatctatctatctatctatctatctatctatctatctttacctctgggtctttctgcatgttgttccttctgtttggaaggctcttagcatcttagcaccaaactactcctgcaacttcattcacctggctaacttttcttcagtactcaatccagagagactgttcttcctcccttctctcctcccctgaaatctgggtttaggtgatcctctctgtctctctgtttgggctacctcaatcatagcactttttactctgcattgttattatctgtttacatctatttctctccaagagagctgtatgggagagaaaaatggacatattgaaaactataataatgatactatgtctaatataatgccaatgacttgccaggctctgttataagcacttgccgtgtgttaactcatgtaattttcaaaacactgtaaggtgggcagctattactgaagttgaataaataggaattggtgatagattgaatgtgggggaagagaaggagtctcagtgatttccagttttctgaaagaagcaagtgggcaaacagtggatggatgtgccatgtactgagatacggggtacaggaagaggaggagttttgtcaggatgggggaaagaaacttttagtttgggcactgccattttttttttttttttgccattctttcacaaccgatgatttccagaagcttcagaaataatgtgagtaacaaaccttttcctctgattgacaggcatttggaaacaccaccgtctgtgtcgggaaagcagaataactctccagtatctcgtcattagcttgctggaagcaggagggctatgttcctgggactcgggcgcttttctcgccttgttctctggtttgcggctttcaggaaactgctgggacaccatggccttgcatctgccaagttcctgtggtgcttgtgccttctgtctgtcatgtcccttccgcagcaggtgtggacactcccctacaagataggggtggtgggcccttgggcttgtgattcgctgttttcaaaggccctgcctgaggttgctgcgcgattagccattgagcgaatcaaccgggacccatcttttgacctgagttattcttttgaatacgtgattctcaatgaagactgccagacttcgagggctctctccagtttcatttcccaccaccagatggcctcaggatttattggacctaccaaccctggctactgcgaggcagcctcgctcctgggaaacagctgggacaaaggaattttctcttgggcttgtgtgaattatgaattagacaataaaattagctacccgaccttttctcggacactcccttctcccatccgggtgcttgtaactgtcatgaaatatttccagtgggctcatgctggagtcatttcctcagatgaagacatttgggtgcatacagccaatcgagtcgcaagtgctcttcggagccacggcttacctgtaggggtcgtcctgaccacaggacaagacagccaaagcatgcggaaagccctccagaggattcaccaggcagacagaattcgcagtgagtgctttctcccgctgaaatttaaacgtgacttcagggaaagagattacaatctccaaaaggtttcctaccctcacaccctagggtagcacatcccttcccatttctttacacatttgccctttttcactcacacacaggtcccaagactgccctgcttcaacagagcctattttatgaactgaataacagtacaaagaactctgtgcttcatatgcctgtgaatgctagtgcctgctcttagcgcctgagtgaagaatggtgtcaagagcactgtagccatacatcctttctttctgcccttaggaccttggtagcttcgaaagtgccaaaatggtatggggaggcgcgggtcttcttatggcttcatttttgtttgttctagtcactgaggagagatttacttttgactcccttctggatactttccttcaacggtacccagtgtccttgtgggacacttacttagaatctgtcttctgtggactccgaaatgtccataccttctgccttttctcaaagcagggcttttctttttgcagcacacagttagttgatatggggggcacctagctgatgaatgaaagcatattaaaatgaaaagactgtctaaattttaagtttccccttccaatggaagcttaatgttcaaagacgattcttgcagagacgatagacaaaatgtgaagcaaaggacttgacccactaaagctatcattctcaaagttagttgggtgcattttggcaaaagggggccctttctggtcctcttgaatcagatctcttttactcacacttatggcaagcccttgtgacacctagttttgattttttctattccaattttttaacctccattttaccttcctctggagatggctatgattcatgggaacgctgctcattcccccactgcagccactccaccactttaggatggatatctcagaaactatttgacaaactgattccttcaaggattagtcctggtcccagtcatttccttaaccattgttaaggaaatgtttgttagagaatggtccagcttaggcctggcctataatcagaagcctgttttaagtttcaagtggcttcagtattggaccttaattatgatgatcacaagaggatgagggcaagaggagtttttagttccagaactacagtaatctgcctccagctccagttgacaagattccgtgatgtttagcaatcagtatggctctgattacttcataatagagcttgatactttcaaagcagagcatagaattattttgaaagacataaaatcatttgcaggaggagccatgccagaaacaggctaatatatttagtatcataactttataataggttacaaatcttcttgaagcccaatgtctcctgcaagtttatattccatgaatgtttcacatcccacccatttgtatactttgaaatgacattttggcctctaccataaaatgttaaataaatccaggccctgaagctctttgggctgccagactgagaagaattaggattgagtgctaaccacccacaacccctttgaggcagggagggagcaaatgcacatattattgccctaccattagagattcctttacgtcaagggttctcagtgtggctgcatgctagaattacctggacatcttttcaagaatactggtgccacagcgccacctccagaaattctactagaattggtctgtggtgggtcccagcaaaggtattttaaatagcttcccgggcgcttgtaacgtgcagccagagttgagaaatgctgctttcacttaataataatcaaataaatatttcttgctttaagttcccattgttttaatatgacttcgcttagtcagattgttttctttattacagtacagatctgctcactaagggaatggaaattttgaggatgcagagaaaaaaacccagagaggatggttatggagcaaacgaagaccttgaatagcaaggacagcaacaggaagtggaggagggattcagaaagagagattaaagggagtgaagacaaaagctctgcactgcaggattttcctttgttttttgacaaaacataggcagattcagatgaggcatgctgggacctcagtgacatgagtcagaatgtgggtggggtgggggcaggggaactgagccattggttgggctgtggcctgagtacaacctcaggcagctcactgtgctttgttcaaaggagtgtgtaatacccatacatggtacaggcacatgtctgtatctgagggcatgccaactggtgggtgaggtgtgacagggggaatggtggaaggggagtgagtgttaaagtaagatagaccttgcccttgttgtccacttgatcatttgttggaaacaatgccccaacccatgggaacatgtaaagcaggatccagagaatgaacaaaaatagattatcagagctttagctaagtggcctaagggtcaggccacatcttttgtcccattagaaaattggagatttggtgagaaaccaagccagaagccagtgagtacagattgggtcaacacatcagtgaggaagactgcaacacaccatccgtagcacataccggatcaaatctttagctaattttccagctcctctcaactgctgggactgaggctgctaagtattcctggatgttatctatctggactgagaagaactaaaaagacaacaaactttttgtgtgatctcagctgagaaggtctgaggaaggcagagcctgacttcttccctacttggctggatttgaggctactttttaacactgtggacccccaagcaaaccttcagagaggacactttgtgacatacaaaatacagtggaaagggaccccttcctttggaggggcctagaaatatttggaagtagtaggaataattgggaggtttttttttttttttcctgatctgttcgcaaaagcagtgatggcattgccacgtggccgtagcagtggtggttgtagtgatggtgtgggaggggagagaagagcagcctattactggctggtatgacacttctggttcttataagttaatatttccaattaggaactctcattggcaacttactggagttagaggaagcgcctttctcagaaacaggtctaatttgcacttacataatatcaatgcaatgatagatttaatagtaggcaataatagcaataataatagccatgcactcttgggtgggaaaacagcagaggtgttactatatgctgccatagagacaataaaagcaaccatactattactttacgtgtaaacagctctctacattttacaaggcatttgcacatagatctcaattaattctcaggattatccaggagataggcattttctttcaagttttacaatacctgtgagtctcacagtaataagtacatatgtgtaagcactatcaacactaaagaaggaataaataaagtctcagagtagggggattcagcctctcccagattctcaactcaattctcttaagccttgggagcaactatttctttgctttgacaaagtcaaataggagagttattaatcaaagacaaaggccttaatttatagtcagggctgctgtgtgtggttatgtaggttgtgccctgcacaaggaaacctagctgattggacttgagggccaaaatccagtccagtctctgctcctcaaaccatgaaccctgttggaagtttttgtccaatggcacaaaaggtcatttacttaccaagcagggcacctgtagggttgcattcattcaggaggggttcctcttctaattcctgcgaaggttagcaggaggccctacctgcagctctttagagaacttttcaaatggctattctaagccctctcttctcctcgccttcttgctgatcagccctgtgcttggctgattgtataatcctttcaatctgggcttaccgggatgttggaccatttgggatttcctttcaatccttccaaattgggaatgcttcattacaacatgatgttaagtaaatatgacaccattggaatagccttctcttgctcttccaaaattaggtacctgattgctatcttattgcctgggacagaatggcttcttctcatttattgaagattcttgtatataagaaaaagatagcaataaaaataatggtaatagttaatatttattgggaatttactatgtgctagtaatttttcaagggctttgtatggactatgtcatccaattattgcatcacccctattaagtaagggcaattattgtttacctactttatgaataagacttccgaagctaaaaggggttaaataacttacccaatgtcatacaactggtgaatgagaaagccaggatatatattcggagtagtctaaagcagtggctctcaaatctcagtgggcatcagaatcccctggaagacttattaaaacacagattgttgggttcctcctcctgagtttctggttcaggaatgctggtgtggggcccaagaatttgtatttctaatactgcacattctcaggtgacactgctgctgctggtccacggaccacactgagaaccactggtctattgatagaccaatactatactacctcctgaagcatactcacttgagatcctgtgttctatatgtggcatataattcagcccttccacctttctttcttaacttttggacccatagatacaattcttttatgtgcctcaacgtaccaggtgtcagccctgttttcctatactgataacaacagtgatactgataatactatgactaggagccttagcatcaatagggaatttggtataggatttggtataatgtaacaccaaatgtaagtaaatataaatggcaagaggacaactggctttcatgaatggcaaatgatcactaatgatcaaattattgaaggcttgacacaagaggaaatctctaaacatctagacttcttgcatttaagaggccttatgtacatagcagtttaggaaaaacaggaggaaacatatgtttcaaggtatggagaaatataaaaccttatctcaagctgggcagcaatgttaaggcaacattgctgtacaaattgcaatacaagtttgagtgtggaaaaaaacatggtctgatgcagatggaatagtctttgaatgttatatttgtgtgccatcatgctgagctacttggaccagttcaacaccagtggtagttaagtaagtggtagcttcaggacttatggccaaaaacgtgtggggtatccttagctgatagagatagccacacatcacctagtatagtgttccaaaagtctactttgagagcctcctgcactgagtcacagttggggatggggcctgggaaacatgcactttccagagcctcccaccttcctcttacacagccatttattaggctgggtgggagaaaactgagagggagagtgtaggaatgtgcttctttcacaatatggccagataggaaagaatcctgagagaagatgagacttgggataaatctgcatgctgccctcctcctctggtctgcctcccctccccgccctgttagcaactgttcaaatgaatgacagtggcaggaaatatcacaaaggggttacaataaagagcaaagacagtagaatgggggggtgtctctgtggactgtgagcaatatcgatggctcacaaatatgaatatggctcctaaggactcctttagcagcagcaagtggaatcatttccatcttgcaaggtgtgaaactgggcccagtttcctccatggaggacaccatagccagtaatctgagagaaataagtgacctttgccttttcagaaacacagttactctctctcaagaaaatatttgatataatattttaatttaggaagagaaataggaattgagtgacatggaaattggcttctcccggagtttcatggcatttcctgctgctagtgaaagaaagggtcctagacagcctgctatggttggtgccacaatataaagacatagacactagacagctcaagtagctcagagaaagtgctggtgtcatatcctggtgagatgcgatctcagaagggtgtatttcctggtccttgttttgactataaagtagcttgataggatggaaacttacaaattagtattattcagtgaccacctgttgacccaggccttgtttaggatttaaggtttctgtacactaatcctttcctgacaacaacttacaggtcaaatcccattttaatgaatgtaattttaacataataaaactatttagtaaaattatcttgtagaacagatgtatctacaaatccctgttcacgaagcactcaatctattaaattaagatgctgttgtttgaattcagtatttatgctttctactttaatcatgttcaatggcaagatcttgccaggcaaaaaatagaggagcctgtgattattccctgttgagtttcctatttcttcttctataaaatgatggggacaggttggcctacttggtcttaaagggtcttttcagttataaaaattcggaccctttgaaatatggtcagtatgggtcaatgaaagaaaaataaagaggagagatttagggttgagggtaaggtactgggcatagttaatgatagtaggcatgaacaacaggcatggcagtatctacctgcccagcaaatatcacttccaattgttcctccatcctaacaatcaatatatgcccatatctcatatctcaaggaacccacaaaaaatacccaagtgtacaagctctcttcctgaagaggctgttagtttacaaacattcatctaaacaacattcattgtgtgcataatatgtacaaggatatggaaataaataagacacagttcctgacctcaaggagctcacagtttggtagtagaagctgatataggtaaataacagcaataaatcttgtaagtgccaggataaaaattatctcagggtaaggtgggggctctaatccagtgtcacaagtcagtttccctggaaagcagcctgttagatggagctttgagtgcaggaagcttactgaatgagtattttcaaggagaacacctgtgaggaagagaagacagtaggattgggcagagagaactgaactgcagtgcagccacaacaaaggcctcagccagtcttagaggggagctctagagctggtatgacccttcagagttgtccagaattgagataaggagtctgggctgttctacctccatgtggaattgtcattaggttcagtctcacccacagaaaggggcacagtgtgtaataataattgtttaacagtcagatcttcagatggaaaaaagttttgatttgtagtgtttgctgatttccatagtgtaatcactcccacagtggtcaatttcaagctaataacatgatgttaactggctcacaaaatctctgaaagttgaaccagcaaaagcgaaccccagcacactactgagaggatgtaaccttgagagaggtgcctttccttagctgaggccaactctcagagaaaagtcacctatcagctactaacacacccagcagctggtggaatgagtgcttcagtgctgaagtgtgtatcttgatggcacatcaccatagcacctactacgtgtaatgtatgttaaagtatttgctgtattgcaatcagcaccaaacactagttctatttaacattttccatgcagtaaagtcattttaatattcctttaagtaaattaaatcaaattgtatcactgttgagtaaccttgaacaaatcactcaatctctgatttgcagaagaaagatgctaatactgatctacttgctgaggatactgttggacaaactggccaaccgaagcctctgactaaactcattttccccgcctcaatggacctatgactatactaatttgaccaaactaatttacttttaatggttcagccaaatgtagagagtgagaggtcttcagttctactttctttttctaaatccaactcttgcattgtcaaacatctctggcactccattttcccatgatacaatgtgtgattataaacaagtgaggctgaattccttgtggggctcatgaactagctccaaagatatccttcgagaattctaaggaaggtctgaacatcagaatacatgtagaacctcttagcgtaattattttgaaggagttaatggtcatttgaaaactcatgtcatgttgtggtgtgtgcatatgtgtgtggtatgtttaaataaacttcataacttattagttacactttaaaaactaaaaggtaccagctctagctcaaagggaaactttctaggggtgcttagcaagtgtaaaaaggtgtttgaaaatagatgaaacaatatgcaaatgccaaagacaagtcattgaatgtagttaagcacccttagttcttgagattaaaggttccatataaacatgtataattaatatttaccagtagcaatagagtctttgcctttcttcaaggagctcagaatgcttgccaggcattatctaattaaactactcagtgtacctgtaaaatgcattggaatctacattttaaagatgtgggcactgaagcacaagtgggcttaaactaaacttatttagcatgccaagggtaaaattggatataagactttcagtctcatgatctagctgccatttttcaaccgtggcccccttgaatccactctattctagcataaccttgccaaacaacatagtttcataagtctaggaagaattaaattgagtccatagtaatttcaattacagggaagttagattttaaaaagttggacatctcacccataatattacacagagtacgtccttaatctgagaatctgaaatccgaaatgctccaaaattgaaaacttttgagcaccaacatgactctcaaaggaaatactcattaaagtatttcagatttcagatttttggattagggatgctcaacaggtaagtataatgcaaatattatacttaatatcccaaatctaaaaaaagtctgaagtctgaagcacctctggtcttcaatagtttgtataaggagtactcaacctgtagtaacatttataggtgagtgagttagtgcttttcattgtctataatgaccttggtaaggatgagaacaattggtcaaaatgtattagagtgcatgtttgtaggagatggacaataaaaagcaatagtggctgtggtaacatctcccatcctctcttactattctctcttctaattcttaggtatatagtagctactatttattgtgtgctatgtactaagtaaatgacttgtctcctttcttcaatcatcactaccatcccataagtatatattgttatctccattttatggacgagacagagagcggttaagtaatttaaaaaagggtacacagttaaaactggtggtgttacgatgtaaagctgatttttccaaccctaaagcctcttttgttatgctactccccattgattatactagttcttgttcctgtctgagtattaggctctgcagcctgtaggcatctctctcttgtcactatccccaatccagagtccatgagcatacctcagcctcagctcaggacaacatcttgcttatcttggaggcataagaaaccacttacaaattggttagaacacatttatttttcctctctgtagtttttggtactgtgctttactaacagtttgcttccataacctccttgctttgttggtttcagtaatcatcatgtgtatgcattcagctttgattgggggagagactcagatgcatctcttggaatgtgctcatgatctgaaaatgactgatggaacctacgtctttgttccttatgatgccctgctctacagtttaccttataagcacaccccctaccgggtcctaaggaacaacccaaagctccgggaagcctatgatgcagtgttgaccattacagtggagtcccaagaaaagaccttctatcaagccttcacagaggcagcagcaagaggtgaaattcctgagaagctggagttcgatcaagtaagtacacattcataggttgtcatgagctgagaacctaaaacatcagcatggtaaattattttcagaccaacagtctcaattccataggaggcccagtcaatggcaggcaaccacagacaaattaaaaacatctttagtttgctgaaaacatttgtgaaacaaaggcatattatttgagattttgttcttttatctttaagcagcccacgatgacattatatagtcaggaagaataaatgtatttaagaacagataaacaaaactttaatatatactggtgctgttcaagggagcctaataaaaataagtcctgtttgtggtgtaagttctgaattaatttaacaataaggcaaaagagctagtatataagaaactatttcctttatttttgataacactggtattggaggatgcggcttctacctgtaggcatttgagcttcccaatactgaacccaaggattaaacaaacttctccatctggccaatggcattgctggaccactgcagtcctgccccatgagggcaggtcttttttaaaatgtgtagtctggagaggaacagcagagcatttgcttcttttaggtagtctgctcccaagagaaagaagacaggaggggctgagctacacatacttacttctccttccaaactaaccagtcagattaattcatttttcctttgtggggaggaatgagtaagtgggtgaagacaggccacttggaatggggaagaagtcctcccttctgatatacaagaaatagtatttatatgtgtgtagataaatgtatgtataggcatatttcagattccaatcatagccactgaaggcttagagaaagaaaaaggagtgaggaggggaagaaagtagagaaaacaatggagagcaaagacaaaaacaaagaggatgaatacaaagaagacgaggaatatgagaggaagatggggagacaaaagaagccatttagattggaaaaaatacagagggacgtttctgtacactggaggtcagatgtagaaagcagacattttcaaaagtacttagaacaacatacacataagtttaaaagctctggcatttgctagaatactgcattagtcatattgcttccagctgtaagaaatagctcaatacaaaatggtttaagtaataattctttttcaaaatttgaagatagggcttcagggttggttaattcagcagtcaatgatgtcatcaatgaaacatgttcatctttccactttacaagccatagcatgctaagcttgccctcatgagctggttcctcttatggtcccaaggtggctgccacagttccagacatcacatacgggtggcaatgtccagaggtgaaagtagagactgtctttcccttgtgtctctttttaagagtgaggaaatcggccgggcatggtggctcacgcctgtaatcccagcactttgggaggctgaggcgggtggatcacgaggtcaggagatcgagaccatcctggctaacacggtgaaaccccatctctactaaaactacaaaaagttagccgggcgtggtggcgggcgcctgtagtcccagctactcgggaggctgaggcaggagaatggcgtgaacccaggaggcagagcttgcagtgagcggagatggcgccactgcactccagcctgggcgacagagcaagactccatctccaaaaaaaaaaaaaaaaaaaaagagtgaggaaatctttcccagaatctccccaagtagacttcttcccataccttgtttgtcacgattgtgtcccatgcccatgcctaaaccaataatctggaaggaggaatgtgacaactgtgattgaaaagtgtgaacaaaatatatagctgctggaaaaatgtgaacaaaattgagattctgttagcaagaaagaagacttaggtaggcagttgattgtgtctgatattcatattcttttttatctgtcctttatttcatcattctgtgggctgcttctctgtctgaatagtgattcaaatgaaatttaggtttatgtatctctttctgctcggaggatttatatcaaatattttgctgattcttgttctaataaaaaaattaataacagagatattaacaatgctggatttggactttattgttactgataagtttataataagtattactgtcttttaggagacacacacatgcacacacacacacataactgaaaacaactggtcagtttagtcaagaattgcaaaactcaaattgctaaaaatggtcggtcaaaccagttgtttgatgtgtttataggcaagcaacaagatggtaactttttgtactttttagccaatgatatggcatcacatagatacaattaaagtcaaatttctattttaatcaaaggatcaaaggaaggaaggagagggtgtatgtgtgtgtgtgtgtgcacatgtatgtatgtgtatgtatattgttcatatatatgaacaggtattttgatataaaaactcagaccttcttctcttgatatttgcatcaatccttttgagcttgtggaaaacataaggtaattaaggcaaaaaaaagacgccattagcttggttgctaggcagcctgcactctgctttacacaaggaaatagaatagctacaacaaagaatccagagcttatgaaaaagcctgtttggatgcatttgtacccctcagtttgcaggtgcccagtctggaccttcataactgaagaatgataaaagggtgagataattatcttcatgtctctgataaacaaaaccccaattttccttaaattatcttgctcaaaggtactttagaaggcagccagtatagcagaaactgcatgttaagctctcacttttactagctgtgtgcccttcggcaagttacttagacatttgagtctcagtttctctatgtgtaaaatgggtaagtgagctatatcttctaggactactgtgaaaattaaacaaagtaacatgtaaaaagtgactgtcagagtgcctggctcacagctacctttctttccactttttctcctttgaggctaggatgaccttattgattggtggtgacctagcatctaagttacaatctttagcttcctactctcttgaagttttctgattactggcagagagtctctcaatatttccagctttcaaaattataaatggcatattctcagatcaaattatgtagtttgatatttgcctatccctgggcttctgttgtttgttccctatttggtcaacaggtcaacaactatttattgagcacctctgatgtgctaggcaatatgttgaacccaagatagaacactatacaagacagacagggtttctagcaatggtatgttagagccagtccagaaaagttgattctgtgcatcttttcccagctctccattcagtgacatcaattggtagcttgaaatcaggcatgatagtagtagttacaccgcagaaacaggcaaatgctacaaataagagttttttttccctctccatatagctgttgtcaaacacttactagcacatcactcattgccacccttatagaccttagattttagtgagagagacagataataaatggttaagcaaatgcattaacaagatggctgtatttctcccttgcccaataactttcaatgaaatagagatttctatgtacaaggagcattgcctacagcagtggtctgcaacatctcttaatttgtacccttgcttctttaacaagtaaaaaatgaaatgaacaaaaagctatcaaagcgatacaaacacatagttttaaaagtcaagaaatgctaaaaggtttatatcaataacaaagcagtctataaggcctcctttcttcccttcatcagaagcaaccactttcatatttttttagctctttattctggtatttacttctatgtttctaaatgctatgctgctactggtgactctcgattaatcaattttgagcattatttgttgtattactattatagttgaggagcactcttagtctttttgtacttccttactctcctttaaaccttaaatatggttatgtcccaatttatagttaaatccatatttagtatttttaacatagtaactatgtaaatatcatttattgctaatccacatgaaataatatggttataattcttgtcacatgtaacttcatttttaccggggttaataattacttcaatttttaatttgtttaccttaatttgaatgtctaagtctttccatactttctgataaggctgtaaaatcctgtcaaaacaattttatgcatagtaaagcctattaaataccttatgaatttcatttgtttttgctggggctctctgtcttcctattccaatctaaacattttgctccctaaggctgctgcacagctattaatattatgctagttttctattttcataattcttaaacgcctctttctttctcttctctgcaggatctatgttttatgaatctcatgacctatattcttggtttaatctgtcatttttgtggagcacatcctgtagtagctttttacaggaggtaaatttttgagattttgcatgtccgaaaagtcattatttcatcttcactattgattgatagtttgaatgagtatacaaatctagggtagaaatcattttccctcagtcctttgaagacatgtcacattgtcttccaatttccactgttggtgttgagaacaccaatgtcattcttattcctaatcttttgatacaacctatttccattcctctttgtcctctcagaaacttttaaaatgttctgtttatttctgatgctatgaaatttcatgatgatgtatgagtctttgacacatgatatgctgtattggtggagcctttcaatctagaagctgattccttctgagaaattttcttctattgtttatttgataatttcttcaacaacattgtctttcttctctctggaaatactataagatatataagatataagatgtccttggttgatcttttaattgtcttattatttatcttatatggtccatatttttgtttttagttttcctttctgggagagtttctcatctttgtgttctaacacttttactaattcttaagaatgatttagttatatttttaatttccaagagttcattcttgttgttatcaatatagtatttttcctattttcttgaggtactcattatagtttttttgaagttttcttctgctctctattttatccgttttttcctcagttcctaatttttcatgtttttatttcatgttgaaagttttccttagatgtctgcagatttgaaggtttatgtgcatgatggatatgttgacaagtgggcttcagtacagggcaattggctaaacagttgctttttgtttgcttcttttggtcaatatctgtaggccttggctcttgagctagtctttttcttcagagaagagtcttctaatcttcttgggagtcataatcatagctgtcagtattccggaagcaatgttgggaggagactgggattctcaccattaagcatgaaaactttaacttcatcactgtttttttgtgctccacctcatttccaacttccttttcgtctagtgccccagctctggagctgctctgaatcaatttaatctgtttcctatagacgtctgcacctcctggtagaggtgggtatgggggatgtctacatgtttattacacagacattcaaagagccctcgctcttttagtgtttggcctcaccttcacttctacagtacttggtggttgtaattactctttccaggattcttaaggggcagatctgcttgttgcttatcagtaattccctctgcaagcacttaggtttgactgttccccactttgctaaatcagttgccatgtttgtagcaactttttattttcagattctgtggtacagggttacagatgtttcctaataccattagatatggagatttagtgtttctgttccttgttctctttgtttgagagtgatgtttgagaggagaaagagagtgaagtaaaaaaaaatcttgatttcattatttttaatcaggaagtctatggaaagtcatgaaggaaaaaataagtcacaaaagggtgcatgtgatattattttactggtgagttcaccaaagcctattaattaagttagtaagtatttattaagctcagatttaatatgaaggttaagatcatgggttttgaaggcagactgccttaagtttacttaagctctccatgtcttcttttcctcatttttaaaattgaaaataacaatagtacctaactaatagggttcttgtgaggattaaatgaattaacacactaaatagtttgcctggcacctgataacccctcaattaatgttagccattattattattaaagttgtggttattattattattgtgggtcaggcactctgcaggggatataatagagatcaaaatagaaatgagatctttcccccaatgaaggagaacagtttttccatttcaggtgctaaggaaattggatctaaaattgggactctagtacttcttgatcaccagttcaaaactaggacaagggacttgaacattatacttccaggataatgtttccagagccctgtgctcctcttctgaaatacaaataatagcagctgttgtatattcagtgtttactctgtaccaggtcgtttacataaatgatccaatgggatcctcagacaacacctacaaattagatattaatatctacattttgtggttgaggaaactaaggctcaaggtaacttgctcaaggtcatacagctgggaagtggcagagctgggattccaacccaagtctgctaccagatcctgatcatttaaccacacattaggcttgttgtgttttattccactgtgctaataatatctaatgccaatgctttactcaggcaaagtaacattgctaagtgactaatactttgatttgaatagatttattgaattgttttcctgtaatataggaggtactagggccttatgagaacctgtgaaaagagaacaataaatcagaatagggagatctgaggggtggggacaccagtgatgaacttcttaatttagtctcaggatgattgggcaaggattataactttgtacctttatattttggccaaattagaattctgaattagggtttgatgcctacattcttccttttcattgtattcccaatgcttgttttcagttaaattctattggccacaaatgtatatggctggaacacatattttggatatttttccaaatgtacagttatttgattaagcaaaggaaatcctcaggatttcttagaaagcttggggaccttatgctctttattgctattgttttctattaccctaaatatgggtgcctggcaggggaattctaggctgcagcagatgtggttaggactggaacattccagaatggggcccaccaaacaaggttgtcagaaaaggttgcctgcagctcacagtggctaagattgtctttctaccccattctatacaaaataagggttttgtgttgatgtgcatcacatcaaacacattggtcttttatccatctcttgactatgcccaagggttgagatcatgcattattggaggtactgccgttaataacaagaattcaattatcctttggtttcttgatctgtgcatgtgcctgactttttgttcaaaattgatgtgccattttgtccttcaagtgatggcttttcaagctaggcatgttttaatgtacacttctgaggataaaattctttggaaggcggttttgtgtcttctcagacacagtaaatctgaactgatggtagtcaacttaaaaacagcacgaaccattatgctgaacaaattcatatattactgttcctgatccagaccttattctcttggataaaaactttaaaagcctcaggtagagctatctaaagtaacagaataaaaaccaatgatatgttttaattatcattcataactaattctttcaggttcaggtctatacagtaggcaaaaacaatgggcttaatcatcagtggtctcaccattttggactgtgatgtcaacaaggtcatctctctgacagaagttcttaccaattctgtcttacttttttggagctgtagtgagaagctggatagaggcctgtagagaatgcctcttcttcctgtgttccaccctttaccttttctctttctcgttatttgtggcaagtgcaactagagaccttttgtgagtgatgctaacattgtgtgcccttgatgtttgggaagaggcaattccctttgctgaagggcaccatgggtgaagcaggaactcaaaccaactacagcacaactccaaggccttgaagtgacagtggaccatcgtgacagcccctcttttgcaagtcaatgctgttgctatagctatgctataagtctctctaccatacttttgtggctgtgagtacatgtgttgtctaggctagagaatcctgaagaacaggcttcaggtttcagtcgtcttggggagtttctgtcagtcagctccaatgggtcaatcagagcacaaagaccagcacagcctggccagctgaaaacccagtgtgttggatcaactcagaggtgggaatgttgtttttgagttttaatcttcacttttggctgtaggtagatgcagtttctttctcagaaggctctgtgcctttcaaaacagaacactagcattctgtttgctttcaggagcttgctgccctgtgtgtgtgtgtgtgttttcacttatttgttttactagtattgattttatactccactttccatccttcacttattgtcataacctaccaaagcccccagaaaacagtcagggttttgcagaaattacaaagacaatcaaatacagcatccaagaatgtcaggagagggaattagtgaaaacctcttaagggagctcagcatgtgctaggcaactaagtgtggataccttggtggcagcacatgccatccattcatgatctgtttctacagagtacatcttgagacagggtgatgaaggaagatcattggaataaaaccctctggagactgaggtattgatttctgctctgctagtagttaactctgttatgtggggcaaggcttttggcctgaacaactagaagaatggagtagctattaacgtagactgacaagactcgttgtagatggatcaggaggatttggggtgaatatcatgagttcaacattgggtatgttgatttttaacatccaagtggagatataaaagtaggccattgactatatcaatctggaatttaggatataggtctgaattggaagtatgaatctgagagttatggcatagatctagtacttaaggccatgagagcaaaagagatcaccaaggaagttagtgtggacagagaagaggaccaaggactgagctgtggggcactccagtatgaagagagacgtcagcgagatgaagaacccttaaacaggctataaaaatgtctacaagctaaattttgtccctgaactataccaagtattaggaattttcacaggagttcagagccagaagggaccacaggggacatatattccaatcaagaatgctaaactaagaaacaggagacctggattttactccttattttatgctcaggtaggtgaacttgacaggtcatgtaacttctctgtgtctccctttcttacttataaagtaagatagttagacaagatgacttctaaagtttagacattcatgattctgtattctcatttcacagaggaagaaatggaagcacagagaaagctgataaatgactttctcaaacattctggcattaggcactgatcacaggacagggtatcatcttctatactgatgtcttaaaatcctgcatgcatattagaatctttgaggagcttttaataatgctgattactggggtatcaaactaaaagcatctctttttgttggtctgggttcggtttggcattgctatttttgacactcttcaggtaattctaatgtgcagctggtgttgaaaactcccactctacattaacaagacatggcagtgtcttgctatctgctacacctctctgcatcttgacttttatttctaataaaaaatgattcactcaattttaagcccttttttttcacatgaaggttgttacaggagcttagctttctagatcttgtgaaaccaaagtagcaagtatcagctttccctgatgctcagtaaaatggcatgaccatagctttcttgaactccatcctagaagtgaagtgacatggaaaaccatgaagccatggccgcgtgtgtgaggggccatgtcgggggaggtacagagaagggaggaattgtttgctcatcctctctacctttttggaaaaaaagatacaagattttatccaaaaataaacttacaaggttaatgggcagtgcatctgggcatagtatacaaaaacattgttgcttttaccatatttatttagcaggcatagttatgctatccaccttagcagtcttactgttttaaagtggcttcttgttgaagctttgccactttgcacaccaataggttttctgactaaaattcacattctctatactctacaaactttggctctagatagctgggtgcgtatgtgtcagggtggatgtctgcgtgtgcatacatgtgtgtatgtgtaggtatgtgtttaaaactgaattctaatgttcactttctctggggagcatgtgtctagaaaaatagccattttgaactaagacaggatacagacatggactgtggagacacattatttacagtctttccacacacacctaccactctagtagtgccagcaaaatgattttaccatgcatagtgcaccagtaattaacctggcatatttactttgaactccccttgtctattctatacttgttttcttaagtgccctttataattccaaatcattttcttagtttaggagcataaaaatatattatgtatgacttggtttgctcataaaattgtcatatttgatatatttaaagatgtgacagcctgggggaaaaaaaaacagaaaaattcaggggagaaaccaagcaagtccttagaaacaatttttttcctctgggtcttcatagctctacttcactcagatgtgcagaccataataatgaacacaggcttggaatatactctgagatcgctctagggcgaccagggctcaagataattgtaatttttaaaaataggtttcaccgttgtttggaaccatctacaattcaatttactttatcgcacaagccatgaataatgctatgaaagaaaatggacaggctggtgctgccagcctggttcagcattccagaaacatgcagttccatggattcaaccagttgatgaggacagattcaaatggaaatggaatttcagaatatgtaatcctggacaccaacttgaaagaatgggaactccatagcacctacactgtggacatggaaatggagctgctacgtttcggagggacccctattcacttccctggtggcaggccccctagagcagatgcaaaatgctggtttgcagaagggaagatctgccatggaggtaaggaatgcaaaatcactagtagtcaatttggctcagcttgggttacaagggaacctctttaggagaaggcacattttaatattgaaacactcataaaatcagttatttgcattcgagtgacatacacttcttggcactctatctagttaatttaaaataataagaacaatgagaggtactttgcagccttgaataaccatccacaatttaaaagcctccccaccactcttttcaaaaagaatcccactctttcccaaagagcttactctaaaaagaggaagacattagccttcttcttgctcttttgtaggctatgacctatgattgtttctcctgctttcaaggtcccctatccatcccttgatgtttccaaatcctgccaatcaggtcctaccacagaaataccgtacctatactctctcctctctgaactcccattgaagtaaaagtctgtacctcacagcttagcacaaaattgcttttcaattgtttcttgtgtactgattgtctctccacttccactcccaaatatattgcttgttgagggtagggaccatagctaataatttttatgctgcccaactgcccaacacagtaggtatccagtaaatacttgcagtttgattgactggtggaactcctctagcttgtggaagaggggaaactttgtccaatctctcagagccagaggggatcattggaaggacccatattgttattatgcaactgtataccatacacttttaaaaccaaatgcatctatttgaaaggggctttgatttctactttgctttaacatgatatacccaactacctcttcactcacatcatatttccctaaaaaatcttactaatctatccaaatatttagattttatggagactaatttacattctgatgaaaacactaattatcaaaaccagacttaccctcacccttgaaggagaagtaccacgtttttcatctataactcatatgggctcaggtgaattaaaaaggccttttattttatgaaggcaagataatacttaactttcacaggtgagataacatatttattctcaagaactctattgctgtccaacttaaattaaggtactcaaagttttccatttgtggactctttcctccaaagaaacactctggtcagccttaattcatgtgatttgttattgtcagagtggttagtggttttgcttcacaacagtgaaattgctttctgtgtccataaagtcaacaagacagactgtgctgagaaaaaatggaattaggttaggtagatgtggcttgatattagagtcaccagaaagcatgaggagtcactctgtggtgccctttatttactgcctctctctgataatgccattcttcctcttcctctcactctctgcaggcatcgaccctgcctttgccatgatggtctgccttactttgcttatagccctgctgtctattaatggatttgcttactttataaggtacattttttgttatttttgtatataaaaaatacaagcccatattagccttgttaatactgatttccaggaagtcctgtttcggtacaattgcctcattacatgacccactgattttcttttttccacagtggtttaccattcctacaggccccatttagagtgaagtgttttcatgatgccaagaataacttcctcagctgtgttgtcagtgttgttgcctgtgaatagatctggctctcaacacaatggtgaaataagagaactagtactttagggcctgtctactccctatcgttgttctcctttctcctagcagagtctcctataaccatctccttgcccaaatgatatgtgatgatagggaatggaattgagatattttaatgaattccaagaattaggcagattttgctagaatccaagctctagcaataatggtatgaactcataggattataatggggattaagtaaactaaaataagtaaagcacctagaacgatatgtgactcatagtaggtgctcaataaatggtaaaatctcaaccccttcccagacacaaggaactctcttgctgattgttggaagctcaggatcttcactttgatactcatgccttttgtccagggtatcacattctagatttctaccatcttgcttccttgggcaaaagttatcctgtctaatcatcaacatctttattatcatcaagttttgtcttcctctctcagatcccttagtacatgatcaaataatctaatgagctacttcagaatcagggataagtggctgaagatggcctaacatgacacctctttcctataaactttgcattttaacacttggaccctctccatactggaataattgggggaaagtgaaaaataaaataaattataaccatcccattttcccattgctaccctgcaaaccacatcattgtcacctcttagtaagggtggtcctgacaacaatatgtcatggattggtagggaatggagtgaggctgttttggtgagttgtaagaaaaaaatttctatagtgtattaaatagctgtgtgaccttgggtaagccccctaacctttcttggccggaattttcttatttgcgcaatgaagaaattggattagatgatgtttaagagccctcccagctctgatattttaataagtctgggaaatcctggattgaaaccataacagttgttactcttagtgtttaaaatgttagcatagctgtgaaaacttctattatccaatttccccagtattagaaatttgataaagtcgcacagagtcgtaggtaacttatgaattgttaaaacacttgataaagacactagttcaaaggaagtttttcttttaatttctgtaactgggacatattcctgctaagaacagaaatttaatatctttaacttagctgctgccaaagaataaagtatttaattaacatcattagattcttagcaaaaataaactctatccaatcaaaaagcttccctctctagagagatttgaggagtgacagactctgtctacctaatgccaaaacatcccatggcaatgtgggaaatggaatcactcagctgtttatgttacttgtcaaccgccgcaactgacagttttcactggtctttcccactgtatggactggttctttgggctttgagtgagcctagtctgcaattcttggaaaaggaaggaaaaaagaaaagaaaaaaacagtggggaggggtttgtttgaagcttgtgggctgaagggcaaagattggagaggaaaattattggagagggacatgattagagaggaaaatgattggagaggaaaatgagtttgagacaattcgtacttcaaatggtcacagaaaactcagagatgggaaagaggtacatcatttcccagactcacttggtccttggttcttcagctaacaaagcacaaaagataccccctctttgctgccttcctccctctctctgcccaccacggctgcaatcagaagagctgagcagctgatgagattctgtaatagacggtgattacttgcaggagagtaactctctgttccttccttttctgtatgttttgattgtttaagttttttttcagaaagaaagacatgcaaagaacccaaccaccccaaaacaaaggattctttgaactcctcctttctctctactcctctggaaccagattgcatcgcctttctataaagctctcccgcgctttgttatactaatgatgataatgataataacgatccctcatacttttataatgctttatgcttttcagagcactttcacatacattatctgatttgattttcaaaacaactctataaagcaggtaatgcaaggactattatcctgctagatagatgaggacactgagccatgaagaggataaattatttatccaaggtcacctggacctggctaattaatggcagaatctgcaccacaccccaggtctctggattgggagtccagtttgctttctactagagtgtactctgtagcatgattatttttacaggtgtgcctgttttaagacaattcaccacacatatgaaacagatcagttagggagtgatgctgtactttgccaaaagattcatgtgctctacccaagaatccactacagggctcttttaattttctctgcagggcagcagctcccacagtgataagggacatatttgttggcagacaattagaaacacgttaattgtttgtttacaaaccagtggaatcactgagaaaaactgagttgctgatacttaaagctgcagtgacattgtaaacttctccttaaagcaacttgacgaagcattttgattcagtggttgttttctccaccatggctcttggctttaacacattccacagagtaaccattatggggttatggaaaaagcaaagccaaattgtagctgtcagagcccccaagacaaaacaacaaaacgagcataccgactaatcaagattccctccaggtcttcaagttacccagtcagacctacctgactgcgtgaatacacatcataaactcctatatgtctagtaattgacctgtagaaaataattacattcactacaaattaatgggcatgtttagagagaatcgggtttaaactgtgtctgtaatgctcagacaagagaccaattcagtaaaagaaaaaaactcagtcagcctacttgtttggaatcatgtagacaaagcaaccaactgactgaatttttccacttttcaacctgttgctttggcaacacatagatgcaactttacaagacaagtgtcttatgggcagaaatctgggcccacagccagggagtaaggattcaagttccagctctgcctcaggctaggagatctcatgccaatttgctcaattttgttttgtttctctaatgtgtttttgtctataaaatggagattaatgattcttggccctggtattattaggataaatactatggcatatgagaaagggtgttgagttccttaaatgtattcagaggtgttgttttgaatgtgtccttgatgtgggatcaccattttattagcctgagataccattcccatgcagagccttcgcacctctcttttggtgcctcttcaagagcattttaatttttcttttttggtctttgtaactgcaagttgtgcgggccagggttgcttccttcttttcctgtgggtactatggtaaaaatccatgtgtgattatcctcccaattaccttgtataccttgtatattctttaagtgctatcttagggcaaattaaccctggctttgccaaaacacccagtcccttgtgaccctctgatttcatgtttgttttaggcgtcgtataaataaaatccagttgatcaaaggacccaatagaattctactgactttggaggatgtaacgtttatcaatccccactttggcagtaaggtaaggagtatcctcttcttttgctgccctgtccaacatggtagccacaagccacaaataattactcagcacttgacgtgtggctagtctgaattgtgatgtgctataagagtaaagtactcagtgggtttagaaaacagtataaaaacatgtaaaatatcttattaaatttaaaaaaaaaattaaaaaaattaaaaatgttaattaaatgtcaaaattaaatattttagatatattgggttaaagtatattattaaagttaattttacctgtttatttatttatttattttttattatactttaagttctagggtacatgtgcataacgtgcaggtttgttacatatgtatacatgtgccatgttggtgtgctgcacccattaactcgtcatttacattaggtatatctcctaatgctatccctcccccctccccccaccccacgacaggccccggtgtgtggtgttccccaccctgtgtccaagtgttctcactgttcaattcccacctatgagtgagaacatgccatgtttggtttcctgtccttgcgatagtttgccgagaatgatggtttccagcttcatccatgtccctacaaaggacatgaactcatcattttttatggctgcatagtattccatggtgtatatgtgccacattttcttaatccagtctatcgttgatggacatttgggttggttccaagtctttgctattgtgaatagtgcctcaataaacatacgtgtgcatgtgtctttatagcagcatgatttataatcctttgggtatatacccagtaatgggatggctgggtcaaatggtatttctagttctagatccttgaggaatcgccacactgtcttccacaatggtagaactagtttacatcccaccaatggtgtaaaagtgttcctgtttctccacatcctctccagcacctgttgtttcctgactttttaatgatcaccattctaactggtgtgagatggtatctcattgtggttttgatttgcatttctttgatggctagtgatgatgagcattttttcatgtgcctgttggctgcataaatgtcttcttttgagaagtgtctgttcataaccttctcccactttttgatgggattttttgattttttcttgtaaatttgtttaagttctttgtagattctggatattacccctttgtcagatgggtagattgcaaaaattttctcccattctgtaggttgcctgttcactctgatggtagtttcttttgctgtgcagaagctctttagtttaattagatcccatttgtgtattttggcttttgttgccattgcttgtggtgttttagacatgaagtcctttcccatgcctatgtcctgaatggtattgcctaggttttcttctagggtttttatggttttaggtctgacatttaagtctttaatccatcttgaattaatttttgtgtaaggtgtaaggaagggatccagtttcagctttctacatatggctagccagttttcccagtaccatttatgaaatagggaatcctttccccatttcttgattttgtcaggtttgtcaaagatcagatggttgtagatgtgtagtattatttctgagggctctgttctgttccattgatctatatctctgttttggtaccagtaccatgctgttttggttactgtagccttgtagtatagtttgaaatcaggtagtgtgatgcctccagctttgttctttgggcttagcattctcttggcaatgcagggtcttttttggttccatatgaactttaaagtagttttttccaattctgtgaagaaagtcatcagtagcttgatggggatggcactgaatctataaattgccttgggcagtatggccattttcatgatattgattcttcttattcatgagcatggaatgttcttccatttgtttgtgtcctcttttatttcgttgagcagtggtttgtaattctccttgaaaagttccttcacatcccttataagttggattcctaggtattttattctctttgaagcaattgtgaatgggagttcactcatgatttggctttctgtttgtctgttattggtgtataagaatgcttgtgatttttgtacattgattttgtatcctgagactttgctgaagttccttatcagcttaaggagattttgggctgagatgatggggttttctaaatatacaatcatgtcatctgcaaacaggcacaatttgacttcctcttttcctaactgaataccctttatttctttcttctgcctgattgccctggacagaacttccaacactatgttgaataggagtggtgagagagggcatccctgtcttgtgcccgttttcaaagggaatgcttccagtttttgcccattaagtatgatattggctgtgggtttgtcataaatagctcttattattttgagatatgtcccaaaccaaatccagcagcacatcaaaaagcttatccaccatgatcaagtgggcttcatccctgggatacctgtttccttttgtttattaattgtgactactagaaaacttaaaattacatatatggctcatgttacacttttattaaatagtgcagccttagaacagtgttgtggaagtgaatgcagtgcacttggagcaatagtttagctttgactttatgtagttctttgtttatttggactcaacatttgatggctatttcttcaagggcaacaatatattttttaaaatgttagcctgacataatgcttataatatagtaggtgcttgtgaaggtttggtgaattaaacaactagtgaaagagttggatttcaccaaaaggtcttctctggttgtgattgtaatgtaattggtgatcttcattaaaggtgtgcctctatgtcctacccctggggctaggccttgtgaaagatgacatgtagtcccagatttcaagaggattacagttaagttagagagacaaatcataccacacaagagagacaatgagcaccatgttgtacgaagaaactagaatgtggtaggacttcagaggaggcatatcagtggagggaggcttttcagaaactcagcacaaaaactgagtcaatgaaggaatgatagggtttatttaggtcacaaactggtaaccacctttgtttcaccctcacagttatttaaaaaaaagccagaattttgaaattgtgaaattacatataaaaatctggatttctgagttttctttaaaagttttaagatctgtcaaccttggatctcatcatgacaatcggctataactcagtagtagttgcgttttgtggaaaaggcgtgttctttgcagtttgatacaattcccaccactctatattgtcttatactcagcatatttcacgtctttatattacctgtctggccccataggcgaggtgtcctaggcagaggaaacagtataaacagaagcttggagaagagaatatgtagggaagagtactgtcaaagctagctagtgtgtcttcttgtgctagtatatgtggccacagtaaagacactagactgtaatttatagtatggtagtggatgtaggaaaagtatacaaatacattatgttgtcttcatgtgccgtttactcttgctacacaactgtgccagatttgagaattaattgttgtctcagtgaccaaactgctcttctgcctgaatgtgaaattgaaaggtatatttaattagttggctgggtgagaatggatttacatggtactaccctgagcagttggagtcaaattaattgttcagctgtttgatttaattttcaattataaccctaattcttacttatttaaatcatcagatctttttgtaaggttaatattgtgttcctggaaacatattgctgaaagccaaaactgtcactgtggctgaagcctacattccacccttgtgacataaaaatttgttgatattagtccccatttttggagacaccaaaggaccctaggactcatggtagtggaatttgtctggatttgccatactcaacatgccttgtataaaatttcctgccttaagtagaaagtatagatgttaaaatacaagctaggaagcaatcctaatatataacccaatactaagaaaaaagtattcacttttgtgacaggatgttttatcgagaaatggatgtttagtagtaaaagtagatgactagaagttattgtctaaatgtagcaaaatatagtaaagtttcagtcaaaagcaataaacctatttgtaaaatccccacttctttggtggtatccatgtcaaaatgacagttcatatcaattgcctagatgttttagctctaacatatcaaaatgatacacatagctcaattttggattgaatgaggcttttatttgtataggctttgcaatagtccagtgtagtctataagacctccacctatgcctcctcttttttatactgggacataaaccatatttgggtgactaaagcataccaggcctcacaaaattaccataaatagctaagcagtgctaccttcaggtaaacaaagtacctagggctttaaaatcttgctcaccatgatagtttttttcacttgtgcataaattttgacatgagaataaaaagtcatcactttttaccatatgagtgagaaaaatgaatagtaagagggctattaccgttactaagggattggtatactcttataagggatgggtagccttatagtagggaatgttcttttgtaaataaaaaaaaataaattgttttatttcattttattttttttactattttggccgaggtggaaaaggatggcattaccctagaagaacatagctcttggcctccagatcccttttggcatttggcttgtattggaggttctgatgggaaaagataggggaagcatacattttccttaattgctgtgtagtcacaaacttgcagctggctgtgcctaatcagtcaagaagccaagccaagaattccatccaaacggaatgtctgaaagtgtaaactcttagtgaatataaaattaattctgtctagaaaaattggcaggttaggagaagtcaggttaagaaaggaagtttttagaagaaaatgaatctgaagtcaaaatgtgtgtggattttggcaattctctcactttctcctttgcccttcatggagaggtctatatctcaatatacagatctaggtactcctgctgagatatgaaaataaagaatgaaagggaaatagattcctccctgaccttgctctgttggggagtgttcaggttgatacagaggttatgtgaagagtcaagttttacatcttgtctgaattttgagctgttgagatttcagcacattgcgggctgggtagagtttaccactgtcttggaactttgtgatagtcttcatagaaggagcttaactctgggctaactcaggtgtaatctttagttgatcaaagactactaaggtgtaatctttagttgatcaaagactattaaggggtagagtgttgggaagtagttaagattaatttttattggcaagcaaagtaaaataaagcataatgtagttgtagagagagcacaggactagaaaatataataccaagattcttgtcccagtcccgatgtacttctctaggtctttgtttcctaattataaaataaggatgttggagttgagggtaggggcactcctagacaataccaaaaggtaacggctagctctggattgctttaattctaagaaaggcacatttggaggtatggagaatatgaggaacctgttgacttatatgtcttcatgtgaaataagtctactggttcaattgaagatacagaggttcaattttaaaggttaacacagattgcaggtaactcttcctcttgtcattcaactgtgcagttccgagccctttcctaccagacttatgtgtgcaagttcaaaaatcaagaaatagagaatgtgacctatttaagcatcagactcataaattatatataggcatgtgatctgctcactctctactattattgctttctgggataccctctgccgttaatcttatctgcacaaagaagtatgccattcagcatagtatcacaaaaagagccactcctgagagtcagcaaggtgggatgctgtcctaggtctgctatagattttttttaaatgtcagatttttacaaacaataatcttgtaactaaataattgactagctatatgatattaggaaacttatttcatcttttttttttggtcttacttttttgtctataaagtgagggtcccagattaaattatgactggcattctttcttgcccccatctgtattttaatcctctctaggaggtggaagcacctttataattttttggtgctgcatggtggttaaacagggtaccaacactgaactgaaaaaaaaagttcagaaggatagggaaaatgaatcaatctcatgtttacagggttcaactcatatggttattttcttaggaataaaaaagaaaattcagataagctctgtgccaaatcatgagtattttggtcataacttttctttcctaatcctttcacagagaggaagtcgtgccagtgtaagcttccagattacctcagaggtccaaagtgggaggtccccaagactctccttttcttcagggagtctaactccagctacctatgaaaactccaacatagcgatttatgaggtaagatattcaacagctgtctaatctactgctttcttggatttcaaaatgaggcaatgatttagtaattagtctttgggtaaaaatactggggcttttggcaagtctttccagtttggtgtctgtgtttgcttatggactcgtttggttgacattcttagcaattattttcctcagcaacaaatctacttatttataacttcactgatctttcaactccatgtatttactatgcatgtagaaaaaagttcttgagacccaaacatttaaatgtgtctgtcactccagaagatatatagataacaatagaagaaatgactccctgagtctattgtttgtaatgagatgtctagagacatgcgtgtgcatggcagggtttggggtacccttctcttcaaattctagttgttcttcctgtacttgttatcctctgatactgagactttaaaatttattcagttatttatttttcttcacctgttctgcctcttggagtaacaggttactttctgctgctgaaaatagaaatcctttttattccactgaggtttctgtgtttcaagctttaagaggccaccctgtaccacctgatctaagatactagaatttggcaaccagaacaaatcttgcatcagagagatgaactgtttcttctcagcaggaatgagttaagcagggggtaaaagggaaactagactgcctttctgttccttctaagtgaggccttctcagtgtggtttccttgttttgtttgaagatactcccaagagcagcaaacactctcaacttaacagtaactacaaagaaagtccaaaacaggacagaatgagtttttagattgtcaaccacattggatttttcaagtgaatactcttctccattagataaataattgacagggaccttactatggtttgaatgtgtccctctcaaaattcaggtgttgaaacttaatggccaattgatggtataaagagatggggcctttagaaggtgattaggccatgaaggctcctctctcatcaatggaattaaaacccttatagaagaggattcatgcagtgtttggctaatttgcccttctaccttctgctctgggaggacacagcattcctcccttctggagggtgcagcaacaaggcaccatctttgtagcagagagcagccctcactagacaaccaaacctgttggcaccttgatcttggacatcccatccttcagaactgtaaaaaataattttctgatctttataaattacccagtactaacagactaagacagaaattggtaccagagcagtgggttgttacaaaaaaatacctaaaactgtggaagtggctttggaactgggtaatggggagaggctggaacacttttgaagggaatgctggaaaaagtcttgattgctgtgagtggagtgctaagggaaattctggtgaggatttggaagaagagatgaactgtatggaaagcctgattcttcttggagattacttaagtggtcgtgaacagaatgaccacattggtaaaaatatgtacgttaaagacaattttgaggaagtcttagatggaaatgaggaatgaagttggaaaagaagcattctttttataaattggcaaataacttggctgaattatgtccatgttctaggaccctgtggaatgtagaattcgtgagcaatgaatgaggatttttggtggaagaaatctctaggcagcaaagcattcagggtgctgaatagcttaactgcttatagtaagatgcaaaaagtgagaaatgacttaaagacagaatgtatttaaaaaaaaaacaagggaatcggaacatacagagttgtaaaattctcagccttgccatgtgaagaatgaaaaagtatgtttaggagagaaaaccaagagtgtgacaaaaaaaaagtttgataaggagattggtatggatagaaggaagccagatgctattcatcaagatgacgggagaatgggagaatgaccccaaagacattttagggatcttcaaagctgtcatgtccattacaggcccagagtgccggggccttgagggtcaaactggtttcaaagtagaggcccaggacactgatgcggtccagggcacctgtgagatcccagggcttgttgcctggggctgactcaaatctctgcttcccatatttcagtgcagggctctttggccttcccagttgtgactcagctggtccaaggtgtggcttggcctactgctctggaagatgcaagccatacatctcggtagtatccacgcggtgccaactttgcaggctctcagagtgcaagaggtatggaggcatggatacatccatctagatttcaaaggatgtcttgtacagcttcaggacccaggcacagacttgccacaggggcagggccactgcagagagtccccattagaacaatacccagtggaattttggggtctgcgccaccgcaaagagtcctcactagggcaatactcagcagaactgtggagtcagggccaccacaaagatcctccactagtacaatgcttagtggggctttgggacatggccacccttgacaccccagacctgtaaagccaccagaatgcaatgccagtctgggagagctgcagtcatactggctccaacctgtgagagctgtggcatgggttgcacccagctaagccatgaaggtggaatccactggggccttgggggcccaacacccaccccagtgtgtctgggaattggaacatggagtcaaagattactctcaagacttaagacttaatgttgtttgttttgttggattttggaattactttggacctgttacctctttcttcttgcctacttctcatttttggaatagaaatgtttatcttgtgcatatcccaacattgtatttcggaagaacatgatttgtttgatttcacagattgatgtgatgatattaagatgtgaggacattaagaggtaattaggccacaagggcttctactttgtgaatgatattaaggctcttataaaagaggcttaatgcagccttcagctagcttgctattctgtattctgccatgcgaagacatagtgttcctcctcttgggagaggatgcagcaacaaggcatcatcttgaaagcagacaacagacctcaccagaccaccatacctgctggtaccttgatcttggacatcccagcctccagaactgtgagaaatatattcctctctttataaattacccagtcataggaattctgttatagcagcacaaatggactataggccttcaacaccaacattggcatggtgtatgtttgttcagtctatgtgagggctttgacttaaattagtagcaggaaacctctggatcttgccttggacttaattcaatcaaagaggagaactgcttcaaatgtaaacttgaggtattggggaattgtcagctctactctctcaaagacctaagatagggtaatcagatggcttttgaatgtcaaatggaatgagctgatggctttagaaatgtattgacacctctgggattctgaagtaaatctccataaccttggtttttatctgtaaaatgaagggttgaactaagttctcaatcttggttgcttactggaatctccttggagaaatttaagaaatacctgctcccaggccccaccctcagcaattctgattcagttggcatgaggtggggccaggtattggtatttttttaaagttctctgatatgtgcagcctgggttgagaattgctggtctaacagatctctaaggccttttctggctgaatatgctatcattctctgattctgtggaataatttatgtgttaaattgtggtatgttttacttggtggggctggaaggttatagtgtagaattgagaaggggaaaaaataaacatctgtatgtaactggcctttaagagtctgtcagatcttttcacattttggaaggaggcagagagctaagttagttcccagaatgactattggtcagtcagatcatgagtatttctaaatggtgtaggccaaatcgtgtaggccaaatggggactttatttttacaaaaggagggtgttatgagaataatacctacacggtgaagtcaatattaggctgatggcagggtgtgaaggaaggcagctgaggctagaaaactggcctgactaaagaggactgactaaagaggttaaagaggactcaaagagggaacataagccaatcgcattaacagatgaaacaaagaagtagtgtgtcttctgaaacagtactctattaggaatgttttaaagaagacccattgtctagtttctgtttaaaataaatcaaattttctttttttttttgctgttatttcattattgtttattttcttttttttcttcttttttctttttttattattattatactttaagttttagggtacatgtgcacaatgtgcaggttagttacatatgtatacatgtgccatgctggtgtgctgcacccattaacccgtcatttagtgttaggtatatctcctaatgctatccctccccactccccccaccccacaacagtccccagagtgtgatgttccccttcctgtgtccatgtgctctcattgttcaattgccatctatgagtgagaacatgcggtgtttggttttttgtccttgcgatagtttactgagaacgatgatttccaatttcatccatgtccctacaaaggacatgaactcatccttttttatggctgcatagtattccatggtgtgtatgtgccacattttcttaatccaatctatcattgttggacatttgggttggttccaagtctttgctattgtgaatagtgccgcaataaacatacgtgtacatgtgtctttatagcagcatgatttataatcctttgggtatatacccagtaatgggatggctgggtcaaatggtatttctagttctagatccctgaggaatcgccacactgacttccacaagggttgaactagtttacagtcccaccaacagtgtaaaagtgttcctatttctccacatcctctccagcacctgttgtttcctgactttttaatgattgccattctaactggtgtgagatgatatctcattgtggctttgatttgcatttctctgatggctagtgatgatgagcattttttcatgtgtcttttggctgcataaatgtcttcctttgagaagtgtctgttcatatcctttgcccactttttgatggggttgtttgtttttttcttgtaaatttgtttgagttcattgtagattctggatattagccctttgtcagatgctggcaaaccgaatccagcagcacatcaaaaagcttatccaccatgatcaagtgggtttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcatgctaaaaactctccataaattaggtattgatgggacgtatctcaaaatcataagagctatctatgacaaacccacagccaatatcatactgaatgggcaaaaactggaagcattggctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagacggcatgattgtatatctagaaaaccccattgtctcagcccaaaatctccttaagctgataagcaactttagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatggataggaagaatcaatatcgtgaaaatggccatactgcccaaggtaatttatagattcaatgccatccccatcaggctaccgatgactttcttcacagaattggaaaaaactactttaaagctcatatggaaccaaaaaagagcccgcattgccaagtcaatcctaagccaaaagaacaaagctggaggcatcacactacctgacttcaaactatcctacaaggctacagtaaccaaaacagcatggtactggtaccaaaacagacatatagatcaatggaacagaacagagccctcagaaataacgccacatatctacaactatctgatctttgacaaacctgagaaaaacaagcaatggggaaaggattccctatttaataaatggtgctgggaaaactgtctagccatatgtagaaagctgaaactggatcccttccttacaccttatacaaaaattaatttaagatggattaaagacttaaatgtcagacctaaaaccataaaaaccctagaagaaaacctaggctttaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctgcaaaatgggagaaaataaattaaattttcataagaattgtcattggaagacctggaatttccagataaggtgcccggagtagcagatatagcaaaagacaggtttaggacatgccatcacgttgtactacgctcacacaaattcacacttttattgtacacacagatgcataacctttggaattgtgtgggaaaatcagcccttatttcacagatagcctttgaaatgtgaaaggaaagccagatgagcggactgccaggcagaaagagctgtgaatggcagatgcagtggggacatgtcaggatctgctctaatagttacagtctgggtgagatggggtgtggtgggcagcagtgtaaccctgacacattcagagagaacccactgaattcatcttccctcttcattttctgactactctttcctctttgcttctccctgtgttttcctctttgtctcatctttctctctctccattcatctctctttctcagatcattttttctgtcttctcacattctatatcccttgtagctctctccctgccgcctcccttccgtcaaccatcttttctttcttatcacagaatcgcagatcatcagagctaaaaaatcatctagtaagtccagaaatcacctagtaagtcctaaagaatcatctagtaagtctagctttatcagtgaggaaactgaggctcaggcagattgagtggctgttctaaggccacccttgagtttgaagcagggccaggtctaggatctagtgctctttccccttattaatacaccgtggctttagttcaaaactgatggactttaaattacttctaaaaagtttagtgaatagagtttgatgtttcttgctcttaattaaaaagtgagtgatgagtgaagtattttatcattctctcttaaaagaaaaaaacaaaacaaatagtgcatgtgtggtgaagataaaacttgcccatttcctcccttttcctcattattcatgaagtagaactcacacagactcaataaaaatttgcttacaaagtttgtgagaattatttaaatcttaaaacaaacacacacaaatctcccaaaccaaagaaagcctaacgagaggaaagagcaacaaagtaggagatggaagaccttgggtcaatttgcggctcttttactacctagttttctgaccttgggacagtcacttaatctcttaagttttcagtttctttatcaaaatatgaagggattgtgttatggatacctatgaccctttccagctctcacagttgttgatttggcatgaaaaagctctgcttagctgctcgtggcacttaataagccagacagaaggctagcccatgtttgcaatagggctggctctaggaagaaggtatcaggtaccaggtttgaggcagagtcaggactgcgagtactgatgttcaggttgtgtactgcaaaagggaactacatctaagagggtaatattcacattgtaacatatgccaatttatgcgtgagtggtaccaaagtgggcacagagattctggcttcccagcctagttctggaatgaggtggtagaagagccttctcacatctacatctatactggcactcccagctatgcacatacatcatcactggtaaactcatgtgtagctgggtatgtactatcttgactatgttccagaagtttcttgaggttgcttttctctcctgcctaatattctcagagaaccaatttcgacttctcaccccctctcctaaagcctgactccaaaggtgacaaggaggcttcactgggcagatagaatttggtgatgtgcagagcatccatgctgctagtggaatgtgctccctggtgtctgggggatgtatccataaatgagagtatggtacttgtatgtatacagccagggtgtgctgcctaacatcacagggctgccacaggctgtatgatgatatactcacaaagttaagattttttaaatttgagagaaaataccctttctaactagcacaaaggtgccatagtggctagcagtgaccatgggctcagtaacatagctgcaaaggtgccgggaaggcttttttgttcaccagtctttcccacacataggctgattccataaattttcggttagagttttattctttcagcttaataggtagcctttgatcccgctaaaggacaaagttctctgaagggtaaaacttcaagcttgtgtcaggccctcctgacttctgtgaatgacttttcgatccctgactgagagcagattttgatgaaggaaacgtagtaagaggtaaatgaagagagtgtgagtgaggagagttccataaatacgaggaaaaggcaaaggctgggatggtgggtcacaaattttcacctgtattagagtcacgtggagggcttgttaaaacacagtttgctggacctcaccctactacgatttctgatttcgttaagtgttgggtggggcttgagaattggcctttctaaccggtttccaggtgatgctgatgcagctggtccagggaccacacttggagatttactggatcaaatgctttgaccattctgctgcaggcaggcactgatccggtactacccttctgaactctctgggcactgagcctggccagtgcagttttttttcttttttttttttttttccagctgctgaaggtctctgagggccatttcttagttaaaggactttgagctccttggctagtaaatgctaatacaaagtgctggcaggtaactcggaagcctgcagcttccattagcctttgcctctggcaggtttccagatgcagtgccatagctggatatattccttaataagagagtggttacactcttttttttttttttttccagacagagtctagctctgtcgctcaggctggagtgcagtggcgccatctccgctcactgcaagctccgcctcccaggttcacgccattctcctgcctcagcctcctgagtagctgagactacaggcgcccgccaccacgcccggctgatttttttgtatttttagtagagacgaggtttcaccatgttagccaggatggtctcgatctcctgacctcgcgatccgcccgcctcagcctcccaaagtgctaggattacaggcgtgagccaccgcgcccggcccggttacactcttatttttggaatttgactgcacagtgccctctgctttattatctctacttgatgacaagttggtgcagcccgaaatggaatctccaggctgtaggtaatggatgtgaaagcactttgaaaagtagagagcattgtgcaaatgtaaggcattattactattatggagaaaaaagaatctatattgatattttttttaaaacaatttgggttggacggaaactaaatagggctttatgactgatgaatccttgaggctatgcacgtagaaaaaggttatctatcaggcgctggtgttgaagtgaaaacaataaaatagttgttgtttttaacttgacagaagccttaaaatagcagttttttacttaataagtcagaaatagacttttggaagactctagattactcacattactatggtagtacattgagcactcaaataaaaaatatttaatctagattaaagacaattggattgtgactaaagcataagacagccccccctccatacacacacacgaatggcctgtcccacgagagaaaaatggatcaaggtaaatgcaggaaacatttgctgcactacatctcccaccctacatttccctctacagacgcctcaaggcagtgggaattgcaaccactaactatcaccattaatcgcagggaacctggtgctacatcatttagctatgaaaaagtgaaatgacctagcacttcctgcagttagttaagaaaggctttgcaaagagtggtatcattccgtttctggagtctacatacttgcaattgtttccctgtcttgagtaactgtaatttttaagtttaacttctgtgcatgacctcatttcagctcagaatgcagaatgtctgtgaggtggagggtgggagagaaggaaaatgtctatttggattgctggtataggtataaaccctttatgtggaagggacatttttctaaaactgctggcaactaagtttcatcactattcattctcctccttttctttctagggtgattgggtgtggctgaaaaagttctcccttggagattttggagaccttaagtccatcaaatcaagagcaagtgatgtgttcgaaatggtatgagaaatcttcgtttatgtaaattcccactaaaataaatctgttctccaaagtaactaacatcagagctgtttaggaagaccccttaacaaatcagtgcagggaaactgcagggttgctaatgggttggtatgatcatatcatgcaatggcaaaggtatgtgctctggagtcaaagagacatgaagcactcaaatctcggctctaccatgtaagagctgtaataacttgggcaagtcatctaaactccctaagtcttagtttccttatttacaaaagggttatattaatgtctaccctttaggttggatgaggattttaagagacaatacacgtaaagcatcttgcgcatttcctggcacatagcttctttatcaagtggtagctattatgattattatcaagtaaatatcccatcaccattccaaatcttcattttccagtcacctggtaatttctatttgaaaagtggttatttccctaatcccactaattatgttcaaggagtccttggatggcttgcttaagaaagcagcctgtagataaggcagggatactgatgatccttcctaagccattttaaaatcttggctcctccttagactgagtccatacaagacttgtgaatactatcttgggtcccttcaggttcttgaaagtgcaattttaaaaggcaatcacagattgctctacatttatgaagtgagcaatttcaaatcattccaacaaatctgaatgaggcaactgctacttccagagcactgaacaagtgagaaaacaaaggaaatggaagacatgtggcctgtggaagataggacatgccctataggttaggaagagatgttatgatttggtatttttctttctttcttttctttttttttttttttgagctggaatttcgctcttgttgcccaggctggagtacaatggtgcgatctcagctcactgcaacctccgcctcctgggttcaaggcgattctcctgcctcagactcctgagtggatgggattacaggtgcccaccaccatgcctggctaatattttgtatttttagtagagacagggtttcaccatgttggtcaggctggtctcgaactcctgatctcaggtgatctgcccgcctcagcctcccaaagtgctgggattacaggcgtgagccaccgcgcccagccaatttggtatttttcttacacgtgattgtaatgcttggagatgaaggcaagataatgagacatgagtccagaagggggatcaaggtcagaactaaaatagacaattctacactggtttcgtaatccaaattatggtgccaaaacaggccaaacctgagacagctgatacactagaagtattgacccaaggtagagtgtgtccatgacatcttttttggggtagcttttaattttgacataatttcaaacctacaaaaagcttcaataataattcaaagattcagcaattgtgtacattttgcctagttgctttttattatctatttatatatttatgcacattatttttctgagccatttgagagtaagttgtagaccctatgcccttttacctctaaatacttcagtgtgtacttcctaaaaacactacagtataatgatcaaaatcagaaaatttaacattgctacaatattattatctaaactacttcccatattctaattttactaatggtcttatacaatacagctaatattcccacaggtcagtttccaatccagtctcacacattcagtttgctgtcatatctttttagttgcttttaatctgtaacggtttctcagattttctttgtttttcttcattttgatatttttgatgaattcagatcaattatttcatggactgtccctcaattttagtttgcctgtgttcctcaagatcgatttagactatgcatcttcagccggaatactacagaagttatgtgtctttttcagtgcactttatcaggaggcactttatcaggatgatgttgatcatcccattactggtgatgttaacctgattacttaatttaggtggtgtctgccaagttcctccactggagagtaactgtatttatctcattgtaattaatacataacattgggggagatactttaatctatgtaaatatcctgttcttcatcaaagttttacccaataattttgacatccattgataaatgtcgtattccatcattgtttctgcatttactggttgacattttattataagaaagaatcttctcttcttcctcatttatttattcattcaattatttatatcagtgtgcacatatggatttttattttattcaattagtatctataatattcatatcaatcaatctgtctatctaaaaccataaattcatactaaactctctaattctaatccagtgccacagtgttaattccgtttcttttttaacttttccatatttgtaatttccttctctgacagtgaaaaaactgccttcccattatcctcatgacatctgtttatgtgtttccttcactgacttgggtggccatgtcaggtatagagtgtaactcaaacttagaaagccaggattttctagaatttaccatgtagatgtgctttaatgctttttagttgaatgcttttttgaagctggaggtggatctgatcatagtgtcactgtgagtccagcactgccttgactacttatgtgtattcatgacctcaaaacgttagggctgggtaccaggatccagatggaaagcagatctttgtgagccagatatagaaaggagcagtgcacaatgggatggatgtccttgaaaaacaaacagctggagtcagaaggccacagagctgataatttccaacatcttttaagatcacaacttctgcaaaattgcgtgcaggaaaattaggctgtatctcttagtctcatgttcttccccataatgtggaactgattggcatattccctgtactcctataaaggcaaatggaaagtatcctggagttctttaaaggaaattctcagttgttagagagtgtctctttctttaagaaatgtgaagagaaggaaactgcagttgctgtgaaacaaagtgtttactttgtgaaaaaatatttggggccattctagagcctctattgagaatattatcttccctgtagccatttcttctccagtggggctgttattatgcctcagtacctcaagatcatgaccatgtggtgaaattgtatcccctgcttactgatgacgcttcccaaacaatgattcttttgcctttgttaaacacattcacaagcttttgaggctaatgccattctctgttttagcatcttctacacctcctgttacttccatctactctccatattcgctacccttaatttattgaatattttgggatatgtatcatggtcctcctctctactccaagacctgctgttatgctggtgacatcaattggacatggactgtggacaactatatatcttgactatttcattctttgccatatcatcctaataatcttctcttccattctactttggccaaacactgctaccattatattaataccttctgcttttccatcttctataactgctactgaaaatgcttcacctggccgggtgtggtggctcacgcctgtaatcccagcactttgggaggccgaggcgggcggatcacaaggtcaggagatcgacaccatcctggctaacacggtgaaaccccgtctctactaaaaatacaaaaaaattagccaggcgtggtggccggtgcctgtagtcccagttactcaggaggctgagacaggagaatggcgtgaacccgggaggcggagcttgcagtgagccgagatcacgccactgcactccagcctgggcgacagaccaagactccgtctcaaaaaatagaaaaaagaaaatgcttcacctcccaaattatgaattcatcacactctctgattacaacctccttttatcccaactgtgcctatatttgactatatcaggtcttccagtctactgacctctgctttctccaaactcacaagcccttgttttatttactttattgtccaattcagagtctatagtctatcatttgaacatgttcttattaatatttctgtctttttggtcagacacacttgcaaaactctagttctgtatgatcccaactcttaactttctttgtgcttgcacttgaacagccaaatattgtagcagaaagttatgcagcaaagtatattgtttccactataaattcatggtttcttatatttaaatgtcccttactactacctcataattccattatacttcattggttaattcacttcctaccacccatacatcaaagcttctccattttccttgaagctccaatgtccttctctttctcgatttttactattagtatcctggtccaagcaccatcatctcccactagagctactaagattgtctttttttcttttcatagacttaatttcttaaaaaaatttatttccatagttttttggggggaacaggtagtatttggttacatgaataagttctttagtggcaatttgtgagatttttgtgcacccatcacctaagcagtatacactgaacccaatttgtagtcgtttatctctcgcccccctcccaccctttcccccgagtccccaaagtcctttgtatcattcttatgcctttgcatcctcataacttagctcccacttatgagtgagaacatacgatgttgagtttcccattcctaagctacttcacttagaataatagtctctagttccatccaggttgctgtaaatgccattaattcattccttttcatggctgagtggtattccatcatatatataaatatatgtatatatgatgtgatatatatgtacacacatataatatatatatatacatatatatcatatctatacacacacacacacacacacacacacacacacaacaatttctttatccactcgttgattgatgggcatttgggctggttccatatttttgcaattgcaaattgtgctgctgtaaacatgcgtgtacaagtatctttttcacataatgacttcttttcctctgggtagatatccagtagtgggattgaaaactgaatgaaatggtagttctactcttagttctttaagaaatctccacactgttttccgtagtagttgtactagtttacattcccactagcagtgtagaagtgttccctgttcagctgggcatggtggctcatgcctgtaatcccagcactttgggagcccgaggcaggtggatcacctgaggtcaggagttcgagaccagcctggccaacgtggtgaaaccctgtctgtactaaaaatacaaaaagtagctgagtgtggtggtgggcatctgtaatcccagctactctggaggctgaggcaggagaattgcttgaacccgggtgacagaggttgcagtaagccaaaatcatgccattgaactccagcctgggtgacaagagtgaaactccatctcaaaaaaaaaaaaaagtgttccctgttcactacatccacaccaacatctagacttaattttttggaactattttgggttcacaggaaattgagcagaaagcacagagagttcccatgtatctcctgtccccacctatgcacagcctctcccactattaacagggtggctcactgattataatcatgaacttacactgacacatcattttcacccaaagtccatagtttacattggggtaaactcttggtgttatatatcttgcgagcattggcaaatgtataatggcatgtattcaccattatagcaacatacagaatagtttcagtcccctaaaaatcctctgtgctccacctgttcacacctctctccccctaacccctggcaccttgcaattgtcttttaagtattttaatcacatccactctcaaatccattcttcacattgcaaactactcttttcaaaattgagtctgattttatcacttctctgcttaaatctctttaatagattcctattgttctttcctttgtgtggtgatttcaaataatagattcaatttctttaatagatactggactattcaaactttctgtttcttcttgtgccagttttggtaagttatggctttaaaggaagttgttcatttcatatatgttatcaaacttattggcacaaagttgtatatgatatgctcaagctgtcttttagatatccttaggatctgtaatgatgttctctgtttcattcctgatactgataatttatgtttttttcttaatcagcattgctagaggattattaattctattcatcttttccaaatatcaactttgaactttgttgattgttctctattgtatgcctgctttgtgtcccattgatctatattcttatttttccttccttctacttactttgtatttaatttgttgctcttttactagttttctgagtgggaagctgtgatggttgactttaacctttcttattttctaatttagtcacctacggctagaaaatctcctctaagcactgcttcagctaccacccagaaatttttcttttttttttttaataaaaaccactttttgtaatcccagcactttgggagactgaggcaggatgatagcttgagcccaggggttggagaccagcctgggcaacataaagagaccccatcgctaccaaaccaaaaaaaaaaaaaggaaaagaagaaacatatgcaaaataaacaaaatagtataacatttatgtgtccaaaactcaccttcaacaatcatcactatcctgtattttttcatctataccttcacccatttctcacatccctaatttggtggtggttattattaattttcaattctgtatttttaggtacagttacacacgttgaaatgcccatatcatttctctataattttgataaaaggacccctacaatctagacttctatcatgatataaaatagggattagcaaactatggcccatagcctgtttttacagactggaagcaaagaatattttctacattttaaaaagggttatgacaaaagaaaacaacaacagaaaccatgtattatctgcaaagtccaagttatttattatctgtagtttatagaaaaagattgctgaccctgatataaaacattcccttctctccaaaatttcacttgtgtcccttagaaaatttgtgttcaccgaaaaccagaggcaaccacagttctgtttttctgtttgtttgtttaacttgcattaattttgctccttctaaaacatcatataagtggaaacagacaacagaaagactgtgatattcatccatgtataagtagcttgttcctttttattgctaagtagtattccattgcataaatatagcacaatttaattatccattttcctgctgatggacatttgggttgattgcaattttggctattgtcaatataagtgcaatggatattcttgaaccagtctttttatggacacatatttgaatttctcttgagaatttctcctagaaataccagggagggaatttctcggttaaagaatagtatacacttaactctataacacactgtgaaatattttctcattttactttcctgcacacaagttatgagaattccctttggtctacatcattgccaatatttgatgttgtcagttaatttaattttagtcattctagtgacttgatgaggttatctcatagtgttttttatttttaattctgctaaaaagacataaaatttaccaccttaaagtgtacagttaagtagtgttaagtatattcacattgttgtacaacatatctctggaactttttcaccttgaaaaactgaatttctgtacccattaaacaactctccatttccttcttcttgaagttcctggtaaacaccattctattttctttttctatgaattttcactacttcgtatatcctatataagtagaatcatacagtatttgtcattttgtgactcactcatttaacttagcataatgtttcattgtgtttataaaatatgttttctattcaggtataatcaacataaaataaaatgtacacatgctagatgttctgttcagtgaattttgacaattgcatgtatctatgtaaccattctccaaaaaagttactaatatgttcattacaccggaaagttcatttgtcctccttttcagtaatttatcctatcccataggcaatcactattctgatatctattaaaataaattagtatttttttctgttctttgattttatgtaaatggaatgatacagtgtcttgtgcctgtcttctttctgtcagcacaatgctttttaagattaacatatgattttgcatatacctgtaggtcactttttaaattgcctagttgtatttcattttatgactatatcacaatttatcattctcctgttgaacatttggcttgattctaattttttagaagagttttttttgacaattttatgaataaggcaactataaacatttttcattatggtaaaaaaaatcacataacataaaatttaccatcttaaccatttttaagtatacagttcagtagtgttaagcatattcacattgttgtgaaacatatctccagaactttttcatcttgcaaatcttaagctttttcatcttgcaaatctgatcttgaaaatctccccttttctatttccaacagcccctggtaactaccactctttctgttcctatgaatttgactactttagatatctcatgtaagtgtaatcatatagtatttgtgtttttgtgactgtcttatttcacttggcataatgtcctcaaggttcattcatgttgtagcatgtgacaggatttccttcctttttaaggctgagtaatagtccattgtatgttattcatttgttcattgttaaatgtttgggttacatccacctcttggctaacgtgaatagtgctgctaggaacatgggtgtagaaataccgctttgagactgtgctatcacttcttttgtacatatatctggaagtaagattgctggctaataagatggctctatttttaatatttttataaagtttcatactgttttccatagcagttgcaccattttacaatcccaccaacagtgcacaagtgttccaatttctccacatgtttgccaacacttattttctgtagccatcataatggggttaaggtgatatctcctagaggttttgattttcatttctctattaattggtggtgttggccatcttttcatagaaagctataaagatttttatatatgtcttttgtgaacatatattttcacttctcttgagtagatacataagaataaaactgggtcatagagtagttgtatgtgtaactttatgtgaaacatccaaactgttctccaaatcagttttgacattttacatttccatcggaaatattccagttgctctaaattcttaacatttgtctttttgatatttgcctttctagtgtgtgtgaaatggtatcttatactttaatttgcattttcttgatgactaaagtttttgagcacccttttaatgtgtttacaattcacttgtatatcttcttgtgtgaagagcctgttcaagtttttgcccagtcttaaacattgggacttttttgtatttttgtttttaaattacagacattctttatatatcctgaatagcctttgctgaactatttattttgtaattatttttctcaatctgtggcttgtctatgatgtcttctgttgagcaacatttttagtttcaaggaagtccaattgtccaatttatcattttattttcccctccaactcccctccctttccctctccttctccctttttcctccccctttgtccctcctactttctttctctttgtctttctctctctctctctttctttttctttctttctttctctttctctcttcttttctttcttctttctttctctttttctctctctctctctttccccctccctccatccctccccctctctctttctttttcttcttcttctttttttttttttggtggcctaagaaatccttgtctagtccaagattctgggtttaggcctatgatccattttgaattactttttgtgtagagactgagacaatgatcaaggttcattttttgcatatagatacccagggttccagtaacaattgtttttaaaaagctttccattgaattaatgttgtaacttggtgaaaaattaactgaccatatatgtgtgcatatatttttggagtctctgttctgtttccttcactcattagtgtaaccataatgccaatatcacactccgttggttatcataactatagagtacctcctaaagtcaagtggtgtaagcctctaactttttttttcaagattgttttggacattgtaaattctttaaatttaaaataaattttgaaatcagcctgtctattacttccacaaggttttctgtaatttttgatggggattgcaatgaatttatagagacatttaggtaaaatggacatcttaataatactgagtctttcagtccattaatgtggtatatgtcaccatttatttaagttttctttattttttcttatcaaagttttgatactattatacatgttgagtagaaatggtaagagcagacatctttgccttgttcctggccttagaggaaaaggaatcaatgttttatttttaggtttgatgttacctgaaagtttttcacatttctgagtttctatgattcttttaatcataaagaggttttatatttatattgctacctattgcaattattcagtggttttgctcttttattctgttaacatggtgaattacatagtttttgaaagaaatattaagcacatcctaatatccccgggatgaattccacttggtcacgatatattatcattttaatatattgctagacgatatttgctaatcttttaaaagaattttgcatctatgtttttaagaagaattagtctatacttttaatgtttgtcagggttatgtttggcttcataaaacaagtttggaagtctttgcctttttctgagagtttctgtaagactggtattatttattaaaatttttaataaatttcatcaataaaatcatttggtccttggattttctttgtggggatgtttttgaaaacaaattcaatttctttgctaaatatagggctcttaggattattatttcatattgtgccaagtttaatcagttgtgtttttcaagaaatgtcaaattcgttattgactttattagcataaagttgtttaaaaattcctttatcatcttactgatatccgtatgatctgtagtgataccatatctttcattctagatattaataattttttctttttctttttgtcttgatcagtcttcttagagatttattaaatttattactttgttttaaagaacaatgttttgattttgttaattttctccacattttggctattttctatttttatctgctcttattgttattatttccttctttctgcttatttttggtttattcattcttattttttgaacattctttctttttaatttaagcgacatatttacatttaagctctgctgtagctgcatcctgcaaaattttatgttatattttcattgacctttcagcttgaagtaattatgatttcattattcttttttgacccatgtattattttgaaatatatgcttaattaccagatatttgtggcccttctagatatcataattaatagatttctcatttaattctgttgtggtcaaagaatattatctgcaaatttaatcttgaaatttatcaaaaactttggccatagccaagcatgtggtctgtgttactgaacattccacatacatttgaaattaatgcatattgtacagttgtttggtatagagtcctatcaatatcaattaggtcaagatggttgatagtgtgattcagatcttctatatccttactgcatttttgtcaatatgctttatcaattaccgtaaaattttcctattttctaattctgtgagtgttttcttcaggtgcattgaagttctgttattaagtacgtacatattggtgtgctagtaaatgtttaacaacaggctttctgaaaaagatccctaatttggagcattttctgatttctgtgctgtgagtacctccattgtaactaatctggggctacccatgtgatgtcactgaacacagagatggtaagaaatatgcaaaatattcttcttatgatccagcacatcaaatattcttcttatgatccagcacatctttgcacatatacattttattattatgtcttattttatcattatgaaatgtccctctttatgtctgataatacttttttcttgatttctattttgtccaataataacatagccaatttagctaattagttttttgcatgatttactttttctgtactttttctttccatgcatttgtgtctttggattaatgttcatcttatttagggagcaggcatttgtgtcttgctttttatctccccattctgcaatctgtcttctaattgaaatgtttaggctacttacatttaaggcacttattgatacagttagatttctcatcatctattttgctatatgttctctatttgactcatctatgtctctgtttgttcctttgtttcccttttcttgctttcctttgggataaaagtgtttttcatatattccgttttgtttcctatattggcattttagcgatacatttttgcacgttttagtgactgtcctaggaattgcttaaatgcatcttgaatttatcatagtcttcttagaattaatattccacttctttacttaaaacataggaaatttgtaacagcagtgtcccatttactagcctactattctttgccctattgttatcatatgtatacctacatttattgtgaaccatataatatagtgttaaaatttgttttaaacattcatatgcatttcatacaaattaagagaatgaaataaaaatatattctgttatatttatcaacatatttactatttctgataactttaattatctcctaatagagccaagttaccatttagcatcttttctcttcaacctgaagatcctccccttaggcattacttgtattgcaggcctgctgatgatgaattttctcagttttcgtctatttgataatgtctttgattttgaatgatatttttgcttggtacagaattatgagttatctgtgtttattttcttttggcatattaaagatttcgtttcattggtttttttttttttttgcatttctttgtttctgatgagaagtcagccattattcatttctttgtatgtagtgtgtactgtttttctctgactaccttcaaaagtttattttcatatttcagggttttgactgttaaatgtctaggtattgctttctttgtatttaatctccttggtgggtcactgaacttctgagatctttaagttcatctttggattgtaggagtttgaatatgatatatgcagggcattttctttgtgtttattctgtttgaagttcaatgagctccttagaattttaagttgatgtcttttactaaattcacaaaggttttgaccactatttctaaaaaaaattgttttgctgcattttctttatatccttctagaactcaagttacctatgtgttagtctgtttgatattgtccccacttatcctttttccctctgtttttcagactgggtattttttattgatctctcctcaagttcattactcttatgtcatttcctaagcccacctagcaaatttttttacttcagttattatattttccagctatatactttccaattggttcatatttatagtttctttttctctgccatgttctatacccatatattcattttgcatatattttcctttaaatcttcaaatatatttataaaatctgtgttaaaggccttttctgctaattgcaagatttgtgtcattttgggatgaatttctattgacctttttttttcctggagtatgggtcacatttttttctatttctttgtacatctaaggctttttggttcattactgaatattatcaataatacattttagaaactctggatcctgtggtgttgctctaaagaactatttttttgttcttgtaggtaaacccaaattttactcattttagttgtctttcaaatatagttctacctccatttctgctttcggtcactcttcactgtcttcaaatggtttttagaatatttgattcatattttataggtttctttgtctactgagtatttaaagacagtgttcaattgtcttctgactttgttatgcattcccaagtatctaatgttttttattttatgctagatattttatgtaaataaatggtagaagctccaggtcataatttctaccagcaaggacttttctcttttcatttgttaggtggattgggtaaggaactaatcacattaatcgaatcaaagattgagcaggattgaagctgtgttgcagttttagttagactcagtccaccactaattctactgtttctcaggcatatccttccaaaagtctacaagtctctctcctccactttgaaagattgggatattcagactgtacttcataacctttttcctctactctcaatccatgctgcttccaaatttggcaaatttcttgaggaagacaccaaccgaatgtttgttgcaggccctatttcttcagtgagactttgtcttctaaatatttggaaactacagaagatctcaaacaattttacagaagctttctagtctcctctatagcccccagactcagaaaatatgctgtggggagaaaactagctcacatttaggcctcctgaaatttattaattgtgataccagtcttctacaattgccaaaagcattaccagtttttgcattttcccagcaaattctttctgttaggctaagcccaatctttggcttgtgctggaaatcagcagatgtcctcagggaagaaaatggctgacaacagcctggttatcttagaagggctcttgcatctttgagttttagattctttttttgcacctacatgtccccagtggttttttttttaatatattttttcaatttttctagctgttaaaagctgtagcatcaggaatggtggtctgccataacctactacaccctacttggtattcaatgtccctataatcatttttaatataaataaatagctacttaaaatgacctattagattctgtataatctggctcttccctgtctcttcagtcttatatcaccatcatatttccctcaaccgctctgcttaaggcacactggcttttacttagtgtttgggttgtgatatgctcccagcgcaaagcctttacctgttctattacaacccctaaaatacttttccttcccttctttgcatggtttaatccactcatcttttaactcccagatcaattcttacttcccatgaagcctgtcccaacttctctgattggtcaaagccccaattatacatactcacattatgtaactctcctccataggacttgtcagagtcgcaaattttgtatcattgtgtaatcatctggttaaaacaagaggtcagaaaccatgtaacattttgttcatcatttgtccccggtctgtctctcagggactggcaaataataggtactaaaaagttttttaaatgaataaaatattgctagtgggaaatataggatcagaagtctttcactagtacctggttaatgtgttctatatgaccattgacttctgggtgttagatagtgggtaggttgatacggggataggaggtcttgaacaatagctctttacaacaaaataaaaataaaaagaaatgcaggaaacagacatgaatcaccaattaactcatggaggtacaacattttcttgtcgaggccaggcacagtgtctcgtgcctgtaatcccagcactttgggaggccgaggtgggcggctcacctgaggtcaggagttcaagaccagcctggccaacatggtgaaaccctgtctctactaaaaatacaaaaattagttgggcatggtggcacgcatcagtaatcccagctatttgggaggagaaatagctatttgggaggagattcgcacgagaatcacttgaactgggaggtggttgtggcagtgagctgagattgcgccactgcactccagcctaggcgacagagcgagagcgagactctgcctcaaaaaaaaaaaagaagaaagaaaattttcttgtcaaaatagacagcaattgctgatatagctgcgggtgagcacttatgtggagaatgacattttcataaaggtatacatacccacctctaggatgggatttcagctgctgtggaagagggacacgtagagattaattctggtgttatgacatcctaggaacttttttcaagtgggtgaaggagtccttcagataacttaggtcagtatttgacttaggaacagatgtctctggtggctgtatgcttaaaggtgtcgtgttacactttgggagtctaaggcgagtggatcacttgagtttaggagttcgagaccagcctggccaacatggtgaaaccctgtctctaccaaaaatatgaaaaattagctgagtgtagtggcatgcacctgtaatcccagctactcaggaggctgaggcaggagaatcgcttgaacctgggaggcggaggttgcagtgagccgagattgcgccactgcactccaacctaggtgacagagtcagactccatctcagaaaaaaaaaaaggtgtcttgtcaaatatgaagctaacaaaatccttgagagacaggacacattcaactcttaaacatttgatggtagccagccagataggtattatggaagaggtaaagtatatgtctaccctgtaaatgctcatcttgctaaagctgatgttgcaaactttctctgcatcctggggttgtccagaatcttggtaggacatgactgcatgtaggcatctacctgctctttatatgggatcttctctgttggttacagctgaggatggatgcctataaagatctatcaaagatctagacagaattattcccatgctagtaccattagtgtaatgctagatgttttaacaaatagaccttcaaatatgtaatgtctcaaacacagcagaagtttaattttcacccaaataacagcacaaggtgggtattcctgtactgttggcaggtgactctcttccaatatcatgactcagggacccaggctataaccatctcatggctctgctatgtcttagggccgtgtcatcatctgcattcacccatagaagtgggaaaataatatggaagagggtataaaagccttagcctagaaatggcacgtctcacttcctctcccattttattgcctagaggaaggggcatatatcggttcctcttctattccattgcttggaattcagtcatatggctacacttaggtccaagaaagactggaaaatatggattagctctctgcccaagaagaagagaaaatacatttgtgttgaacagctagtagcattgaatatgacaactttttactttttcttccaacagagttccagagcccagtagttttggctgcttgcttcataagaaaatagaactttaggagcaatgcctattttgctgtttgtgggctgagtttctgtccaccttaactggtttaggttgcagtggatgaagagaattgtcatgggtgccaggcccttatgcttagaaggcaaccttggtggtcaatagctgacattcccaccagggataatttaacctttgcttggatcatattctaagaagcaagctcatattctaagtcctatagtgtaattcatctcaataaatggcccaccatccgttccgtgttcaaaatagaataattctttatttcattctttcctcccctccccacacaagaagtcacgtgatttatagctccaaaatacatctcagatctgccttttgctgttcatgtacactgttaccattctaagcctatctctctatctatttagatagatatagatatacatatctgtgtaaacatgttgtaagtttctataattaataaattttaatggtgaaattcaccagacacttttcttcatcttacctgacctctctggtatttatcacactttcctgaaattctttctggcaggcatttttctcactttcctgaaactaatcctgtggttttaacaatatggttttaaataggcttttctctacttcctggcctttcttctaagtcttattattgcaggctgttcttccttttcccgctcttcaaatgttgatgtttcctttttctctttttctttatactttccttgggtaatctcatttgttcccactgattttacctaaaatttaattgcttacaattcccacatgtatttatactggtcagaactcattccttagtttcaaaccctgaatatacaactgtctttaaaatagttcccccttgatgttctgtaggtacctcattctcaatacgtctccaactgaatttatcagcctttccacccccaaatgtgcttttccatctgtcttaggtcagattccccaaaatctgagcctgagatggaaattcttgttcaaattatttatggagaaaatgctttcaggtaaagagtgagggaattaggataggacagggtaaaagttaagcaagtatttgatttcagctggaaactagcaacagtatgatcttatggggaaatgctggagcacaagttataccatgaatcttaccttgaggctaggaagctggacttttgtactgtcctcagtgagtaaattactgcctgaggcctgtgggtgggacctaacctctcaggtaaggtggctcaccattaatttgggctctaggacagtttttttttttttttttttgaaaatggagtaactatgagttatcagtcaacattcacagcagttgggggatgcatggttaaaggcatatgggtggggcaccagcatatccactattacctcatccctgaattccctatattaatatgtagcaccactgtctacccaggtatccaagtagaaatctgggagtgatcatggagtcttttttcctctctctcatccctcatttaagtagtaataataataaatgataattattgagtgcccacaatataaatttcaaattccatagcatggttcataaagtctcatgggatatggctcctgtccatttctccagtctggtatttaatattctcttccttacactccactgtggccaccctaaacctgttgtggttttctccacataatgtgctatcactctcaacccctctcatcatgtcatcatcacctgatcaactcttaattgtcctttgagagagtccacatattacctccttagggaagccttctctgactaccctagggtgaattagatacttaacatttgagctcttacagcatcccatgcccccatttttcagaacacatttcacaacaaaatacaattgttggattacttgcttatcacccttcattgaatgtgagctttttcgggacagtgattttatcttgtttgtctctttttctctagcatgcattccagtgtcttggatgttgtgaacatgcactaaatgcttctcacattagtgaaataaaatgaatgaatgcaaagagaaagtgtggccaaaattctaaatgtttcttctgaaaaaaattgtataagctctggcctgatgtttatatagggaagctattttaatagatgctaggtagatgagtattcatagaaagacaacctattctacattttacggtatcatctctctttagtcctcttgagccactgagctccattccagaaagtcccaaaggaatcagagagaaatctgcagcttgagtttcacttataattatgctaaaagagatccctctctgaaattttcccctttggccattgaatttgttttctactgctgctgtaacaaattagtgcaaacttagtggcgtaaaacatcactaatttattatcccacagttctgtagatcagcagtcaatgccgactcagctgggtgttttgcttggcatctcaaaactctgaagtcaaggtgtcagttgcactgtgctcttatctggagacctgtggcagggggcagggctggggtgagggggaaccatttctaggtttcttcaggttgcctgcagaattcagttcagtggggtcataggatcaatgtattagtccgttatcatgctgctaataaagacatacctgagactgggtaatttataaaggaaagaagtttaatgaactcacagttccacatggctggagagggctcacaatcataggggagggtgaaggggaagcaagacatgttttacgtggtggcaggcaagaggacatgtgcaggggaactcccctttataaaaccatcagatctcgtgaaacttattcactatcatgagaacagcatgggaaagacctgcccccatgattcaattacctcctagtgggtccctctcacaatatgtgggaatcatgggaattcaagatgagatttgggtggggacacagcaaaactatattaattgaggtccccgctttcttgctgggtgtcagctgagggtggttaccagcttctagaggctgcccacattctttggcttatagcctccttcccccatcttcaaagccaacaatggtctgttgagtcctcatattttgaatctctctgatttatcttctgcactcttcttttgtttttatgggatcacgtgattagttagattaggctcaccctgataatctcctttttgttgtataacaaaacacaatcacaggagtaacactaggggttggagatcatcatgggagtcaaaattctgtcaaccacacaaccaatcataagaagggtcaagagaaggttatgtgccctcaactgtggtccccagttgagacaggacagctgtgactctcatttctgtctctcatttccagatgaaggacttgcgtcatgagaatattaaccctttattgggtttcttctatgattcggggatgtttgccattgtgacagaattctgttcccgagggagcctagaagacatactgacaaatcaagatgtgaaacttgactggatgtttaaatcatcactcttgctggatctcataaaggttaatgggaagactgaggaaatcttggattttctctgtagattagaactttaatgttttgggatattttattttcctcagattgttgtgatcatttcactccttactttctgtattagtccattttcatgctgctgataaagacatacctgagactgggaagaaagagatgtttaattggacttacagttccacatggctggggaggcttcagaatcatggcaggaggtgaaaggcacttcttatatggtggtggcaagagaaaatgaggaagaagcaaaagtggaaacccctgccaaacccatcagatctgatgagacttattcactatcacgagaatagcacagaaaagaccagccctcacgattcaattacctcccccgggtccctcccactacacgtgggaattctgggagatacaatttgagttgagatttgggtggggacacagccaaaccacatcattccacccctggcccctccaagtctcatgtcctcacatttcaaaaccaatcatgccttcccaatagtcccacaaagtcttaactcatttcagcattaacccaaaagtccacagtccaaagtctcatctgagacaaggcaaatcccttctgcctatgagcctgcaaaatcaaaagcaagctagttgcttcctagttacaatgggggtaaaggtattgggtaaatacagctgttctaaatgggaaaaattggccaataccaaggggttacagggcccatgcaagtccgaaatccagtggggcagtcaaattttaaagctccaaaatgatctcctttgactccaggtctcacatccaggtcacgctgatgcaagaagtgggttcacatggtcttgggcagctctgcccctgtgactttgcagggtacagcctcccttctggctgctttcatgggctggcattgagtgtgtgtggcttttccaggtgcacagtgcaagctgtcggtggatctggagaatggtggccctcttctcacagctccactaggcagtgccccagtagggattctgtgtgggggctctgaccccacatttcccttcctcagtgccctagcagaggttctccatgagggtcctgctcctgcagcaaacttttgcctgggcatccaggcattcccatacatcttctgaaatctaggcagaggttcccaaacctcagttcctgacttctgtgcacctgcaggctcaacaccacatggaagctgccaaggcttggggcttccgccctctgaagccacagcccaagctttatgttggcccctttcagccacagttggagcagctgggacacagggaaccaagtccctaggctgcacacagcatggggaccctgggcccagcccatgaaaccacgttttcctcctgggcctccaggcctgtgatgggaggggctgccatgaaggtctctgatgtggcctggggacatgttccccatggtcttgtggattaacattaggctccttgctactcatgcagacttctgcagccagcttgaatttctcctaaaaaaataggttttgcttttctactgcattgtcaggctgcaaattttctaaactgttatgctctgtttcccttttaaaacagaatgcttttaacagcacccaagtcaccttttgaatgctttgctgcttagaaatgtcttctgccagataccctaaatcatctctctcaagttcaaagttccacaaatctctagggcaggggcaaaatgccaccagtgtctttgctaaaacataacaagagtcacctttgctccagttcccagcaagttactcatctccatctgagacacctcagcctggaccttattgttcatctcactatgagcatttttgtcaaagccattcaacaagtctctaggagagtccaaactttcccacattttcctgtcttcttctgagacctccaaactgttccaacctctggctgttacctagttccaaaatcacttccacattttcgagtatcttttcagcaatgccccactcgtagtaccaacatactacattagtccattttcatgctgctgataaagacatacccaagactgggaataaaaaagaggtttaattggacttatagtttcacatggctgtggaggcctcagattcatgatgggaggcaaaaggcacttcttacatggtagcgggaagagaagatgaggaagcagcaaaagtggaaatctttgatgaactcatcagatctcgtgagacttattcactatcatgagaatagcatggaaaagaccagcccccatgattcaattacatccccctgggtccctcccacaacacatggggattctggaagataccattcaagttgagatgtgggtgggatcccagccaaaccatatcactttccttcccaagtttttaccccaccacccttctcacagtccttttgtccatatctgttatatgatacagatatggaaaaggtttgcctgtcctctccccagtttgaggtccagatttttctttacttcctgttgccattaagcactcttctgccttaagcgatcctttctttcatccaatttctctgctttgtggatgtgggaaagtgctcattcccagattatttggtgctacttagccctacctcctagttttcacccttctaaatggtggctcagtctagaactaggtgagaggtctttacatacaatggctgtgtatgtggaactcagtgccactggaaaaccaaaagaccagtggatctatcaggcatcacctttattctctgagccaaagattcctgacagccaaggtagggttcatagatgagtcccatggaggagcttctggggatcccatgaacgccatggaatgatatgcaaattgtgtatatgtgcattttttacagggctgatctgcatactcaatgactttttgggcttcctgcatactgatcatagtcttgacctttttctgctagcctaatcctttttcaggggccttgaaagggaaagacattctctcatgccaattccctttaagataggtgtgattagcctccttttacagaggctcagggaggttaaatgaggtactcgttgttatagagtgtctggcacatatagtaggtactcaataaatatttctcagccaactattaggtggcggagctgataataaaatccaaatctcctgattcttattctagtactttttctgctcacactgtaagctaagcccagtgagttaagggaggagcctctatatgacaatcccctcaaggccatgatgaatgaaaagcaaccgttagacaacatggggggaatcttgcccactgtagactctactcagaagtactgaagagtgcagactatccaagagcacagggtgaaaagaattccaagtacaaaggggtgtcacactgcaaaagagccagatacttaaaaagacttttagcaaacaaagttctgaaatgactgtactagaatataaatgtatgtatatacagaatgaataaatccatctgaacgagagtcctggtcacatttgaataccatatgaaggctgccaagcaagtgcagagatcggcactagacagctttcttctttctggttgcctatttttaattacaaaaataatatattaagtgtaaaacgcaaatgacatatattggaaaaatactcgcatttactcaaccctctttcttcatactccccctcaaagttaactactgctaacaatttggcaacccaccttgtaattaatttcttgtgtatttatatgcattacagatgacttttttgtttgttaaatatacatgctgtcacatagttctgtaattactatatttcacttactttatggattagagttgtttctatgtcagctacatacagatctatcttattctttttaagtgctgcagaatattccctagtgtgaatgtaccacactctagccagtcccttattgatatttagtgcatttccaattatatactattataaaagcaaagctacaacaagcattcttatctttgtctctttgtgtatacatgcaagcatttctctggaggagaggtagaacccctggatcatagggtacacatagtttaaattttgatagctattgccaaattgcccatgcacaagtttgtcccagtttccattcttgccaataatgggtgagagtgggttagaacttttggggaaaatcaaaatctccaaattcctggtaattatatgtatatggatccattctgtatctgaaatgttaataaatctagtaacacataattctctgcacacacaagataacattctttatcaaagcataaaattttagagctacgagggatctgaaaactgactcaggttgtcaaaggtttactttgcctgcatagaagagaaaaaagctgagttctggatcataatagctcatgccattaacaatctcagaaattggtgttaaaagcacaaaatagttaaatgagttgctaaataaatcctgttgtgtcatctacagggcatgaagtacttacaccacagagagtttgttcatgggaggctaaagtctcgaaactgtgtggtagatgggcgttttgtactaaaagtgacagattatggctttaacgacatcttagaaatgctgagactctctgaagaggaatcttctatggaaggtaagcaatgaattgtacccttctgatgcacacgaggtaactccaaagttcaaatgaaaatatgcactgaattaaagcctcaggctgatttcaactctccacttttgttgaaaatccagcctcatttccaagccaagggacttgaatgaagtaggcctgctgtaacctcggcccagccaagctttctgaacaaagccagtgtaataatgttcagttcctgctgtggcaggattaggatgtattgtttggagaccccagcagtccctggaaaaacttgctgagcactaggcacacagtaggtgctcaataaatacttgtcaagttgaatggagagtaatttggaagctggacccccacaacgtacattttagaatgggacgtcactagagcataccagcacagtctctgtcagagaggaagaagcgaggagtgatctctcagcaaataaatgctctgtggtttatgtgggaaggcttcaggcagaactgtggccttctagcaaataagtagccatgcctgtgtcaaagtcaaataaaaatatagggacaaatctttaaatgaaacattttatttgggaaaacagaatttcattttgtggcatgcacatagaccagggtggtccttggtgtgtccaaagaacacagaaaagttgggggttttattggaaagagaaatgttatatatggtttttaaagaaaactcattggcactaccaaagttttggggagcaggaaagctccgattggtaagtgatggctgtaggtaaaactcgtcttagagtcatgacagtttctttcatcagctactaggtaaaactgatattaagattatagaaggtcatttcggtatctggcttgcaagattatccctgggcaggcacttgtgccccaagtgcttttctttttctcccatggtctctggactccaatttaattggatataataagataactccagttcatatcatcaattttcacaccaacaacgtccattttgtgtttttgtcttctgtctagtgcaccagtggtagcactaaacaatgccagtaggagttataacagatcaaagaaataggagaaatctgagatgggggtgggtgggtgagaaccagggaagaaggagcagatagatgagggggagaaagaggaaaaagaaagagaacaaatatgatgaaatacgtataggaaatgtgggcattaaatgttttaaccaatattgcaagcataaagaagagagatagtgacacaaaagacagaaaagcaaacagcccaaaaaaagatagacagagacagagagatgcaaaactacatcatatatccatattcttaaaattacctttggcgtaagttttaaaactgctgactttactacataaaagaaaagaagaatgaaagacacacagagagagagagacacatgcatagacagagagtccagtcattggtggtatctggactttataagactttgctctttataagacttgtgggttattaaatttagggagtcatctagtccaattccctccttttacagatgagacaactgaagctcatgatttgctccaaacctgcagtgacttagcagcagttctaggacttcaaattcaggttttctgaattctagcccctatcctgtagagagggcaagtacttagtattttgtcaaaatcaattctctataaaacacaataccttgggaggctgaggtgggcagatcacgaggtcaggagttcgagaccaacctggccagcatggtgaaaccccatctctactaaaaatacaaaaattagctgggcgtggtggcgcgcttctataatcccagctactcaggaggctaaggcaggagaatcgcttgagtctgggaggcggaggttgcagtgagccgagactgcgccactgcactccagcctgggtgacagaacgagactctgtctcaaaaaaaaaaaaaacaaaacgcctagcttctcagagttccatttaatttccagatgggcaactttgaaacttaagaaaatctagtcttagggtgggtaaaggatagctgcagggctctcttttctggttttgtgcttttgggtggactatgtctgtctgtctcctctgtctctgtctctgtctctccctcttatcatattactccattctccaaattgcagtggcagtatggatggtcagtccattcttcacacactgcagccagaaggagctttctaaactgcaaatctgatcatgttacagctgtgcctaaatctatcgaatggcttcccattgctctaaggataaagatcaaattcctttacatggcttacgagctgagccctgcatggcctggaacttgctgacctctcatgctaaccactacccccctgctttatgctctggccatgctgaactgcttctagttgtttatttacattacaccaggctgtctcttactactaaatctccacacaagctgtgtcttctgcctgggacactcttctcttcccactctttcatatactcatctgggtctggctaaattctatttcttcagggttcaacttaagtaccactgcctcaagaggctttccatgacccctatgctgggctaggttgccctctttataatccttcagggccctgaactttgttgtgataccatagttcattagcattactcattcaattaaccttgtctccccccacccaaactacaagctctgtgggggcaggaaacaggtttgcctttctcagtgcctttcacagttcctgacagaatatttgttgaatcaacaaaagaacaaaataaaatgaaataaaggaacttgtctccctaccttagatatgaggctaaatgaatctcataattgaaaggccattggatgtcatctgacccaacttccattttatagatagggaagccaaggttcagaaaggtagctacttggtgaccaagctaagattttgaacccgggtctctagacttccagttctgtgttcttttatactataccacagtagctctccaaagtcaattctatcaccctagcaaagctcagagttaatagtggctccagcagataaaaaacaaaccaaagtaatttctctagttttcccgagagttcaactctaatggtagttagtggctcttacttggttctggagtggagatgaggaaatgggggcggattgtaaatgtattcattactgtccactctcgattatataagtatagtgcagaaaagcctcattatagccattaacaacatacatgtaagtgctctttggaaatactattttgtaatgattgtatttaatcacccagcttttaccagagagttttgccctctttttccatcttgtgcttttaaatgtgcagggagaaaggatgccaaaaagaagcagccacatgccatttttcctgctctcaaatattcatccttgcactcctctccaaaaccatggtgcctaaaatcccgcaactataaatgtattcctttgacattcaatcattcaagtatcattcattgttttccgtttgatttgtaaatataaatcttcctaggcagggagacataggggcaaaatcactatagtgagtgttttggagactttcatgggtgtgagtgagtggtggatggtgggtggaagctcagaggggtctggttgggggacaaagcctggggacacttaaagagcaaagagagaagatgggtacatgattggtggtgaaactggaatttcttatttcaccattttgatcaggattggctgaaaataagaatttccatggtggatttctctttcctgggttttgctaacaaaccaaaataatctctcacctttcacccttcttcctatttcataggactttgtttcttggactctcttcccaatacccaaaatttaacaagatgaaaagttagccattactttctccctgataccctcactcttagcagacatttgtctccaacctcactatctggatgtcaccttgttgtttactccaactccctctcattctcaaggcacagggagcctatccttagccctgtcacttccttctccattgtagccttccagtgtatctggttgactgtgttgctgctactacccccacccccatttaggcccctctcacctcactacctgctcttactgcaataacttcctagctgatctccctgattccagcctctctccttcaatccagcttgtgcaggttgccagattaatcttcccaaacagggctttcatcaaatccctctccagctccagcacccctactgccttttgtattcactccaaatgccttcatttggctctcagggcctctcaccttctgcccccattcttccagacacccgccctcccccacttcatcaaccccacttctcatttctcattattccttaacagagcccttctcttcagtcaagctaatctgcttaccaccacccggcatccccccacccgcaatttgctcctttctgcctcttgttcttttgcacatgctgttctttctagggagaaaaaagcccttaccttctcagctccagaaagttgcatccttgaccttcctaacaagcacatttaaaatttaacttttccaggaagtcttcctggattaatttgatcagctcagttttttttttagtttgaacctgatgaaattgccaatatctaactgtttttgattcacagaaatggtaactttatataattcaatctaaaacactcttcttccagcttttgagtactgtatttctattgttaaattatatttctttatacattgcttacagtgccccccacccaagaaaaatttctgacattctcactgccataaactctgaatgcagaaataatgttttgtccctgacggggcctgaaatgcagcagagcacacaatgggtgtttaactttgacctttaatggattcatttccctttactatgtagtggccctcatcattccctctcttttattgcagttaggggtgcatatgtctgtgtttccgactggtctgtgaactcctcaagtttgattcatctctagcaccacctctgtgcctagcacagggcatggtacatagtagaccatcaataaatatttgcagaactgagttgaaggaattgttgcacctttttgcactgcaaggaataggaaggctggggtaactctaatccttttagaggagacctggagaaagcaacttgtgaatctcttagccccagcacaatcaaattaccagacacatatagatctcagcaaacagcaaatccatggcaaccagtgtggtagcacacttgcctttccctggaaacctgccaactgctacttgcaggctcaagaaagcaagcaccagagaatttctatactttgagcttctgtgccctttcccacatcgctgctgtgtctgcctgcgtggtcctggggtggagagagtagtatgttttctctgttcataattccttagaagaatagattcagaccctgggggatggggggcactagcatggcagtctgtctaataaaaatataaggcagtcaataaaacagtaccctctgagcccttgagggcattgcagatattgtcagttaatcctccctgcattcattacacaatgctttctttttagagctgctgtggacggcccctgaactgttgagagctccaagaggcagcaggttaggttcttttgcaggagatgtctatagctttgccatcatcatgcaagaagtgatggtccggggtaccccattctgcatgatggatctgccagctcaaggtaagcgggaggtgagaaaagggccccaggggtccaccatgaccgagatcatcagaccaactcaggctgtcatgattttccagaagagtgttagtgctaacagcctgatagtctgcaagcagctcaagttatgtacaggtgggacttatagccagacagctttaggcatctggaagaaatttcgccacccaagaagctggccttttttcagactgtgatgtaaaacaagggcctacaggactgatgccagtcccttttgtttttctttttaatttcacagtcccctctactcctttgagacactccctgccaagtattttagtatccctcatgatgcttctggatgtcaaggccttaccactgtttccctgtgacatgctccaggcttccatccaaatctcccaccaagacacttggctattaggcaatatccatcaataatgacaaaatcagtagacaaaactttgaggggaaacaggatatctgtatattctcaaagtatgaacccacaagatacttacaaattgcaaatggaaaaaacagagtttacaagtagaggatcctgtagacaccaccttaaacaagcaatcaagattaccaataataagctattaccagtaatacagcacacccatgttatgtacccattgacatgatacactaagaagggcataatgtcacctcggtgttattcttgacaaaaaaaaaaaaatacataacctcaatctaataatgagaaaactttagacaaaccccagctgacattctacaaaataactggctaggactaatccaaagcatctaagtcatgaaagacaggaaaagaatgatgaactatcgcagactgaaagagacaaagacacaacaattacatgcaatatgggatcttgaattggattgtggaacagaaaaaggacattaagggaaaactgatgaaattcaaataagaaccctagtaatattattgtacaaatgttaatttcctttgtactatttttctgtaagttattaacaataggggaagctgagtgaaggtgtacaggcaattgtactatttttacaacttttctggaagtttaattttttttcaaaataaaaacttttaaaaatgaaaaagaaagaaaaactagaaccacttagctaggctttgtcccactcagggttccacattattcctctacttaaagccttccaactgttcctcatcactttttaagtgaaggtgagactcctcccatgacatacaaggccctttacaatctggcccctagctacctctccaggcttatcttctgtcactctctatatcccagctaaaccacatgactggccgggccctgaaagtatcatggtctctcccatctctgtgccttttcacatactaggaggtggaatttttccacctcctcccaatcttgcctcatccaactcatgtcaccttctctgggaaaccttctctgacttctttagtgtgggtcagctgccttttctatactcacaagtgcctatctcagctagagcacttatattgtttgccactgtttattgcaattggactgtgagatccttaagggcatgaatcatgctgtgcctaagcagagaggtggcccattcaacttgatggtgttctgagaaagggacaaagacttcatctgccagagaatggatgaggcagtcaagtttcagggagtacatgctcatggaatctgttgtactgagagcacgatgctgtaatggagaaatcattactggtacagcctgacctgggttaaaggaacagaatgtgtgatgtcacaaggagctgagaagtcagaggcaacaactggaattcttttatggaggcaaggggctcgtattagggataaagcagcactgttggagtgttatagccaattcaggggtgggaaggtcacactggtggggcaagcaaagcttggttcctgatgtggcagttagaattggaggtggtggggaggggattaaagatgagaaatgagcctgaagagatagggacaagagcctggattttactctgtgggtgatggggagtcataaaaggcttttgagcaagaaagtgatacggccagatctgtgttttaggaaaggtttggagaagggtaggctggaagcagagagatcagtttgaggccccagtgtgggttgctggggatattgagagataatgatttttttttttttcctgctgccagggagttttctttttgtaaaaaggtcagtctgactgctctagaccttttgtcactaatggctgttgggtctgaatagggagtctaagaattcccacgtgaagtctgagacatttggaagcaggacagtgtaacaggttgagattgtctgggttcaaatttgaactctgtcacttactagccatgtgacctcgggtaagttacttactctcttcatgtctcagtttccctagctataaaattaaaataagagtgcctacctcacttgtttgtatgtgagaatccagtgaaataatgcatgcaaagcgttcagcacattactggtatatagtaaatattccactggaagtggagttcatggaccgtcaaccaggaggatcttgatgaggccttgaactgtttactgcagttcttaattccctttgcctagacaccaggtagagacctggacctgggctgggcctgggcttgtaagaagagttaagtgggtctattgtggggattggaaggcttagatgattggggatgggtgaggggagccaggtccctgaagttagagcattagaattgccatcagataggcagtatctaaaacctagcagaagcagaataaagtgcctaaatgataccaagagtccaactgattaatttctcactcctcccccattgcctaatgcagcttttgctcaaatatagtctatattcaggccacctaaggagagagcaaaggagatggcccttctgtgttatctcctaacctacccccttcttggctaaaagtcagttatctttgccaaatcttggtcattttttccatgatttgtaaacggttctcttctcgcatctggacagaaatcataaacagacttaagaagcctcctcctgtgtacagaccagtagttcctcctgagcatgcccctccagaatgtctccagctgatgaagcagtgctgggctgaggctgcagaacaacgaccaacttttgatgaaatatttaaccaggtaaggactctgaatcttatcattgcccaggagccttcctgaagtcagcctacacaaggctaactccttgggtccttgtcatattgtggaaggaacctcttgcaaggggtaagggcactcctcttggaggaacagcctgggagtggctactttgaggctcttggtgctggagtgtcatcagcacatccttcaagagcccaaagattggttctagtgttcttctgtgtctgaacctctgttccagaccatccacaatctgacctgatcaacctttcagagatggaattgaaccatcaggcatttgtaaggcaatggcattgaaactattagatgatgggtatcatggaatagatggggctcctcacagagccatgtttactttggggataccagagaactctcatgagtgtaccaattaggtaatttcaggttgtttttggaaggtcaggaaaaatatggagtgtttgaaagggtgttcaagatggaagaaagagaaagtgcaaatgtggcgtgcaaaagcaggagattccttaagtttccaggcaatggggtacatgaaaagtgataaccttcctccttaagatactgaatttctaaagggggtgattctctccctagaggtggggattgaaaggggagtgaaggaaaggacagagtgagccctgctgtggaagctaaggcgcaattccaatgttggagcatgcagtttaggctttgttgaaattacaggacaccaaaactgagggtgctcaccatgagtgctgtgtcagctctggcagagaggcttttgtgcctggctggagtacagcaatgagatgctttatgagtggcaggtatctgaggcggaaagaaagaaagagttggattgaaagcctgaggggccctgcttatgaagtcatccgtgtccccagctaacaatgcctccattagcccggctgagtttcttgaggacactcaaacaggtgttcaatagtatggaagaggcgaaggaccatgaaggtcaaatttctaaaaccttaccatgaggcaggagaaagagcatttgcccctgtgttgatgctagagatgttatttcagaaggcagcagagaagccagtgatagatagggggagtgtacatcatgagactttcaaacaagacattgctatagctgccctcactgaaatgcttcagtggaagtttaggctgtctgatgacaaggctagccacctaacttcctgcagttaataaaacttaagtgggaggaggaggaggagagggaggttccctgggttaggcaatagggggagcccaaagcatctaaactggctacgaggttatcctcaggactttgatggacctgcagatgtgaaccaggctcagaagggaaactcctagtgttggccttggggcattgggtgctaggtggagcatgtgtggcccagctatatataagaggttcactgggacagagccctagatgtctgtttagcaaaaccacctccgattttttgttgttgtgaacacagtcatgtgcatgttgactatagcagtacagaggggctacccctcatgattctaatactatgcctagctccctgttactgtagatagacaaggtcccaaaaaggcgtattgaaaatttgtgacatgcagacatctctaaggcatcagggcatagaatgggggcaaaatcagttgaattttacatcactctgactgaccaaaggacaggtgctagaggacaccactattcttggactccacggtaagaaataggggttgattttatcacgtggatcttgagccctctgtaagaggtcaaggaacctctcattgttcaaaaactggcaacatagtggcatttgaggataagaatgatttagtaaactgatgatccagaagagtaaaatggtactttgggccctctctccccttacctcacacaaaattggcctgggctcaagaccaaatcctgttgtcttagaagtggctactattcacgtgatagcatctcagaactgaaggagccggctcagaacacctttgctcaggcttgaaagaaccagaagggtaggggaagaactggtggggtcgggggtgggggaagaggtgcagtggtagtgccctgtaaatgggtcagggtgacagtgaggatgggtggtgacttttcctatttatatctgggttcacctttcctgccctggcattttggtggaatggatttgtgataaggggacctgctccatcatctctgagtttgatgagtaagcattttctggttcccttttctattttacttccagtttaaaacttttaataaagggaagaagaccaatattattgattctatgcttcggatgttggagcaatattctagcaacttggaagatttgattcgggagcggactgaagagctggaaattgaaaaacagaaaacggaaaagcttctaacacagatgctaccaccgtatgtgagaacacctgaggagtgtgaatccttataacagtgtgttctgttaaaaaaaaaaaagagaaagaaaaaaattacccatcaactaactgctgcctccccttgtcctgcaccttctcttctcctagtgggctttagtcacacctttaaatcaaagtaaaattggaaaccaagggagcagagcacacatcctaattttccactacctgtagatcatgctggtcatttaagtttttgtgcttgttttttctgtgtgtcacttcgtgactttgctaggaggttgaccgattaaaagaaagcagttctttgagctcctagaggaaagtagcaaggtcgtttttccaggtctttcctctcttagctgaaaaccttatctgttgctacagtttccaagttttccagggcaccttacttattatgttgtaacatgatcttctaggagataattaaggaaactagcctcatgaaagggcaatcacctgggagcattccccaggggtctgagttagaagtatagagagatgaaaaccctccacatgaaggcacagaccaggtctgtccagtgctgtattccagcacctggcacagttcctgaccgattgtaagcacttaacacttatttgtagaataaatgaacgaattaatgttttcatccatgtaacactttcttcctcatcatttattagcagtgatttttagaggtttatttggtgtatttttagcaggtgtatgtggcatgaagggggaccagtgtcatcttaggaatagctgtgtctgcttttcagatcagttgctgaatctctcaaaaagggctgcacagttgaacctgagggctttgacttggtcaccttgtacttcagcgacattgtgggcttcacaaccatttcagccatgagtgagcccattgaggtcgtggatcttctgaatgacctgtacacactctttgatgcaataattggcagtcatgatgtctacaaggtaggttaattagcaggaaaatatattccatagtgaaatttttatatgaggcccatccatatgtattctaaaattgaagaataaaatttatggaatattgttatttaggaataacaaattaaatagtacaccccttccattggtatatcactggaaatgagagccgggtagaatgcatgtaatttcccaatttacaaaatagcaactttcaacccagcaaaagattgccagtcagatttcttttgaactttttttctagaattgggactaagaagatgttgggaccaagagagttattgcacatcagtggctgagtactaatagtgtaggcagtactgtactaggcactgaaggggataaagaggaagtattggtgttttgcccataggtggtgactgctacagagttcatcttggtaaggtttgtgtagatctaatacatgctataaaaatttggtctcctccttcaggtactgttttatatggagagaacttgacattatagcagggaaatattagactcgaggctctttgggattgctacagggtaaccgaaaagctgcctattggtctgaggtctggggaagtgattaattgtggggtggcaagcccctgttcccaccttctctcactcctccagcctttgaattttcactctttctattagagtttgcaaaatgactgcattgactaattttgatgccatgcctccttacctttttttacatatgttgtcttgtctctaggcaaaaatgacgaaaaatctcatagctgtgcagggacatttctacattgtctgcatcatggatacttgtcttattgatggagaaagatgccccaggcatcctaaactttagacagcttctctgtcccaggaccaaagtagagctggagaatgagtagctccattcattggattcttcacagtagtctgaaatgttctagctctcaaatcacacacaagaaagtgtgtttatctcagattagacagggccttttcaggtcagatagagagcctcagggctaggccaagccacctaaatagggctcagaaataaacatcatacctgtcaatcagcaggagctgcaagctaatcaagaagcacacatggaaaccacgatgcaggaaaaatccatggaatcagagtacctgtcttaacttgttgaactcaagcagcctgaagagaaaaacaaatcactgaaagctaattcagttgaaactaaaatcaaagatgattcagcgtgggctgtaacacagctactggtttaatcaatccagctgattctgttcagacaattgttgggggtcttagcaataggccattagatattttggtacttaatggttgcagtagggagttaatgggctgttctcagaacagagcagggctatataaatccaaaaatgaaatttatttttttcagccctatttattaaaaacagcacagtgcaaaggaaataaaaattgaaccagcagcaaatgaccaaactcatttgtgtttttattttctttacctgtaaaatttgaatcacctcccctggtacttgataatctgaaatggaagtgagaaggctactgtagaattatgaagttagtgattcagtttcagttttcctgccactatctgcatcccaatcgcacccttttctaaacctccttttccctcagcacccttgtgttgactgacacaacccacaattttccacagcagtctgtacaccaagaccatgcatgcccatactccctgctcttctaatctcctcatccatatccttggggcctcctgggtgactgactcatcaaagctaaagggtcaacaactaatctctgataatggccagccactgacttccccttgcatgtagcatttacattgtaatccttccttcctgtgtgcaggctggcatgcctatctgagggtaggtatcctttcctcaaattgcacaaggtaagggagaccttggatggaaacatgttgaggcagaaagtcctatagattgaaaggattattgttattggctatagtaattcatgatgaggagcctattgctgattgctaaacttctttctctggagctgaatcatacccacagttccagggctggtttcaagatgtacctatttgataatgatgatgatgatgatgataatgttgatgatgatgatggtgatagcttgaactaattatatagtatcatccaataggcaggttttaaatgctttgacatatattaaattatttattccttagaaaaccctacgaagtttttactatcattatcactatcttacagataaggatactgaagtacagagagattaagtgatttgcccatggccacacagtttgtaagtgttgaatcttaaatgctaatcaagatggtataacttcagagtttcatgttcttaactgttgtattctgtgagtgcagttctctgggaacacatgggttttaactggattcaaacttgtagtaacacagtctgactggcgcatttcataaaaagtcccttcagcttagttattttttggatttacccaaaaagtttcaacttactggttatctaaaagtgagcacacttctgtggggaaggtgaggaacatagatttggctttatttccaagtgtccagccctaaccgtcccctgcaaagcagttgagggccagtactgctgctcctcagggaggtagcagtaggagaggaggaggtaactggtggaaagagactcagttctcatacccaataggcctgcaaaactaacttcatcgtattagcaaggcaaagcagagggaatgttcttcctttccccttccctatattttccttaaggctaccctagcttatttaccccaaataatctatagaaacatttgctgggaagcatcataggcactttctcctaagatgctcccccatggacaccctagggacagtcccagaaatctcccttttctcttctccccaaatgtctcagagcctggtatttttctaaggtcaatcaggagcctgtgaggtagctacacttatttcagaatctcttggtgtggggcctagacttcagtatttttaataaagctccttaagcaattctaacatgcagccagacttgtggatcattgacagtccctctctgcctttctcactttacaacaagaccacctggcctccattatacccttacagctctgtgctaaaaagaagcacaaataagttgtttgctaattctatttttcctaattcccaggtagagaccattggagatgcctacatggtggcttcaggcctcccaaagaggaatggcagtaggcatgcagctgagattgcaaacatgtccttagatatcctgagctctgtgggcactttcaagatgcggcacatgccagaagtgccggtccgaattcgaattggccttcactcaggtaataaccagttaaagtaagaggaaacattctaatgcgcctctaggaagactaaaaaagaaagggaaaaagatagctctcccctgattcctggccaccggattatccaggtgtccgggctgcataattcctttatgcctacccaaatttactctcctcccagtacctgcactaacacagtgggcagcagctccttgttccaggtactaaactcttttaatctaccattttggttagaggcaatatttccatgtttgactatgctacaagatcaacaggtatatgttgtagttaggataattcatttaattaattaaaatccctacttctgaattattttcctcccacattcattacctactagctcctcttgcttctgtatccactccccacctttttctctctgctctgctcttctaggctcctttccttcccccatccttttcacccctttcctaccaaacttctttaaaaaaatgaatgacatccactgtgccatttcttcactgtccactccctccttagcccctttgcaatctgacttcagttctcaccactttccccggtccttgtctgcctttacctctgcagcatctggaattcatgacaagcctccctaaaatgctcctcaattggcttttatgacatgctcctcactctgtgaatgctgcttttcactttatttactggttctcttgactcttcctgttctctaacattttctgcaaagctctcagtcttgtgatctttttgctgtctgcatgtctcacctctaatttattactcaacccacagcaacctgactttcatttcctaccactgtctgataattccttttgtctctaattgtcccttatattggtcttctccagtgttctgtcaggatccactgtttttctcctcctacatactctcatgggtgatctcattcatatctgtggtttaactaccacttgtacgctgatgacttccaactccacagctttagtgcagtcttctcccttaagcttcagccttctatatcaaaattcctgctgatatgcccacctgaatgttccacatggaccttagactcgacacatctaaaacaattatttttttacccatacaaacttcctgctcttcttatatttattctctatttcagttggtggtaccaccattgacctagttactccagttagtcttgagagtcattctctttgactcctcccttactctgacctttaacgttcaactaactactaagtcttgaacactctttaccttttaaatatttattgatctctcttgtctcttattcactctcacaacccaagcctgggacaccaagatctcttgcctggatcactgcaatagcatcttcttgctttcactcttgcctcttaccatccatccttctcatagtcatcagcataatctgtgtttccttgtctgtccttccattaggctttaagctccttggtggcaggaagcatatcttactcatgtttgtatccagagttcttagcacatagcaggcgtttgattttttcttttagagaaaagccctcatctgtcatttgtgcttcagtttcacatttccaacccccctcagcatacctcttcttgtagggttcaccattatttcaaatttaacatatttaaaacttcaagtcatcttttcccacaaatcagcataaactcacaagctcatggcaattttctcatggttgtcaatcagacagccaataaatctgttgattcttttacgtctctcttattacttcttcatggccatccacttcttatcattgcctccttttaagtactttgtgcttggattactgcagcagccatctggagggttttcctggttttacattttcccctttcaatgcattttatacactgatctgagaaaaaagatcatgcaattccttgctcaaaattctctagtggttcaagatcctccatcttgtacaacccacttaatccaaccttgtctccagtttctcgtgagccatgtgaactaggcagactgttctctctaagagcttcccaaattccctgtacaatcccaaccacaagcctttgatttatgtcccttttccactgttcaaatcctactcacccatcaagacctagatcaaatcctaccttctccactggacccttcttgattgagtcaggtcctaataagcacctcctcccattttctgagttattatagcacctctgtctgtgcttcttgcctcagccatatgttgtcttgggttactgcttaattgcttcctctttgatagtatcttctcttcaattagactataaattcctggagaactgagactatgtgttacatttcttttttattccccttggtgcctagccgtaaaaacagagcagaaggccaggcatggtggctcatgcctgtaatcccagtactttgggaggccgaggtggggggatcacttgagctcaggagttcgataccagcgtgggaaatatggtgagaccccctatctctttttaggaaaacaaaatcagagcagaaaccagaaagttgaaggtgaagaactttctggatactcccaaactgacttttcagtacggctgctgaagttttctcaattaccttgaacacttaacacagccatattaaaatgtaagaacaaaaaatgctaaatgcaaaatatcctttgattatatatacatactgcttttccatgccccaacacagataattgaaagtcagctctatttgttttcagatttttgaaatgttttagaataattctcttgatagacacagtttgggaaccagataaacccatgaaagcctttcttccaaccctaaggcacaagaaaaagtcacatttttttccttacaacaaacatgtttggaccctgaatccctgcccaggcctttctggtttgggtttgatacttgtttgtccctgttgacaaatataagcatctcaggtgtaactgttacgtggaacaaaggtatacatcagaagggcagtcatgtctgcattgttataaatttgctttcttgtagggcaaagagttcactactcattgtgtctttcttcagattcacagagctatatgatggcaacttttattcttttacaaagatacattccttcctctttgcactattcctctattagcattgggtgcatacctgttgactgtaattccaaccccctgatactctatagggccggttgttgctggagtggtgggcctcaccatgcccagatactgcttgtttggagacactgtgaacacagcttctcggatggaatctacaggcttacgtgagtacctaatagagagatggataggatggcaccactctgctattgagaaggtgattcttcttcagagaggtgaaagagagcaggatacttgatgtttcaatgttttaaagaaaaataaaagataatttgagaagattaagatttatcacggattttcctggtctctaatggcaaaccagtagggggtgatgttggactgaacatgtacctttctttctctagaaatgaagctgtagctaagtgacaccaaaacagccactcaatttgataaaaacagctaaaatagtattttgggtaaagaaaaaaattggccgggcttgtgggtttgtgggagtcatgttgagaaaagaactacataagggactaatattttccatttttcaactagtttgtggagacgcactgaagccagctgcctcccagctggctgctgtttgctgttgcagtcccctttttgaaccagttaggaccccaggagttctggcttcatcaaatagcctctacaatttagctagcaataatccctcaatccaagtagcttggaattctgaaataatttattgcaacttccctgtatataaaacccttagcttctatcaaaacagacatactatcaaagataccatttcttctctgcttctttgaaaagaaaactgtacaaaccatatgccatttgtctgttgtttgtaagatgctggctcaactcttactcggttatttactaccactacagaatcacaatgtgccttttgcttatatcatggttgagcaaagcattttttatgctactataggaaaagcatagagaataacattaaattctatatgcagttttcatttttcatggattttgtaccaaaaaagggaagaaaccacttaagcccttagaagggcttaactctggcaagacgagttcttcccaagcttcagcactgtactcaaactagtccctgatgttatggtggactgtatcacagtgggtggtgccctgtctgaccccacttcccatcactcatgtgtagaaacaggcttacacaatgggtccagtcttagtcaatctagcctgtgctgccatgattaaggaggcagtatggaacttagaagctgttgtcagaataaattttctgacatctgggaaagtcttcaaactccttagatatggcagaggccatggaagtagtcatccaggaactgctgcattaatataactttgcatatgactttactcttgaagtgcaacccaagatgaagtgaaatttatcatggaactgcaatgcagatttggcacagtattctggactgatgtaagcttgtagaaggctgaagtcatattctggtctgaaccagggaaaactccacacatttcacattggaaatacaaagttgagaccagaaattgaattttgagatgtagacagcaccttgcccagtgatcagctagaacgaagaaaatggagtgaatcacccacagcaggtgtttattaagcactgactgtgcaaggaagttattgtgaagcatacaaagaagtatacgcgtgtgctctctgtgctaaaggagctggttaatgtgcttttctaaaagctaatgactatgacccaaatatgacattaagctccacaactgaatggagatctgtagagaggtagcctctcctcacattggatatgaaatcaggacatgtcacatatctattaataaaaaaattatttcatcaatatctcctttgtgctcagttgaaaccactgagattctggaatggaagtgactcgtgacccagtcctggagtgattctccctaccatacaagtggatggtggttggtatgagctatctctcttttaagctgtgtgttccctaccatcaagattactctactgaaaggctccctgaagaccagatgcttgtgggatgcacacataggactggctaggaatatactggctgggcatgtgtattttaggaataggtcaaccttttttgagtaagggctttggatgatcatgagttaatgaggaaggcacaaacaaacaacagtactgagctatcaagagaaagaaagtcactgtgagtatacacagcagaaactccttgcagttctctcccgccatgccttcctactcaggttgtaatcagctttttttttaaaaaaaatgattttctcaagcatgtgtgaaaactagccttggacttttatttaagactcaacctcaacaaggtctcacttcatagggtgacagtttttagaaatgtcaaggatcttacctgagtgaacaagtgattattcttaatcaaataattacccttaggttctaaataaaattttaacgtggcagttccctatgtaaatctcttatcccagattgagatcattggttagaaaatagtacattcatgtgtaaacacagctaggtgcccccacccaaacgtcagctataaatgtacagtcttcataaaatatttgttgaaagagttcttgggatatttctcattgatgttttatttttaagtgtagcaatgttgagagagagttgtaagaatgcatatggaaaagacatcattttgcctaagatatgtaaagcatgagagttcagccatagtagcagcctgtgaaagaagctgctgaagtcaagctttcttcaaatgacgtcacgtttcagctgagagcacagtagatgctggtttctccatctcaacctttgagttaaattaacacctttctattgcatggcctttcatttaagatagtgtctaggaggctgataggtgctacaactaatgccttatttcggcctggtgaagaaggccatcactccgtctcctcctcttgtgaaaccctaagtaaacctctctcaggacgttgctaatggtctagttcatttacaagtgaagacatttattacattgacattttctcattaattttgccagtgagaaaggagcccaaatcatgtctctccttcttttgcagcttatcgcattcatgtcagtctcagcactgttacaattcttcaaaatctgagtgagggctatgaagtggagcttcgaggaagaacagagctcaaggtataatgtctttttgttttttgagccagactacttggatacacctgcttctggagaggtcatggtctgctgaaagagtttacctgggagtctgagactcagagctataacttgggcagaatcttcagccccatttggggttcccaaaagattgctccattttgcctcaattttcttctctttaaaatatggctacagtggggaggagtattgagattttttctgcatttttcagactgtaagttgtatctttctctcttaaagaactgcacagaatttggctttccaatgagctgcactattatttacattttctaacctacattttttcactctttggcagtgccagacattgttcaataagccatagtaattgtgagtttggattttctattcactttctcagtggccacccttcctgggtgaaaggcacccattggcacactatttgcagagagactttttctttccctaagaaaccaggaggaacaaagtcagtttctatgaaaggcaaacattttgtagcccctttttccctgttagagttatcactagacctgagatataggattagaataattttagttttctttttttgccatttccactgtgttctatttatctatttctgaatgaccaaagaccaccggttgacccagttgtaaaagagctcagtgataaaataatgtaactccctcattttcagatgaaaaccaaggtccagagaggtgaagtagtttgagcagggtcacacagtcaactgatagcagaatcaggtcaagactcaggaagcctgacttcctttttagtgacctttccatgacaccatgctgcataaagatgattttctcagtgactatttttgggcaaagcaagagcagggcactaagtgatgcacaattagcttctgactttggcattccttttctaaacagtggcaagttacatgtagctagatttcagatgttaaagtttggaaggtctaactctagttgacaacttcctcctatggctagtcctagttttttccttccaataggtcattagtatcttccaggaggttggatgagtcacttacaaggggacagaggctcctttcccacctcttgcagagaactcagacagtaaaatgttggggacagggatattacttgggcagcgaatctaactgtccaaagcttttgtgatccttctatacattctgtcatatttcaacagaggagtagaaatgcagcttggtttcctgaagaccttttcctctgcattgctgggcagaggcccctcatttaaaagctgaagggttgccacttttgaaactgaaaaacgaaaatgcatccctgtcccaatggtttttattgtcccacaaattcaattcaggagcactcacatctttgggtgtttcaagtacaaaatcaggacttaacttcaaaagggccctttgcagcttcatggtttccccaaccccagggaatttgggaacatttcacagcaagttggaagaagagcctttctctgatgccacattgggcctggattattgttgtggcagggtccttatgaggaggagacattaagagggaagagaagagggcgcctcagaggaaaggaaggggcaagggaacaaggaagaggagaggaagtaaggcccaaggaaaggtcaggagaggaggagagatcctttctgtgtctgtaccctctacctccccaccagaaacaggtgttgtactttgcatcataagggctggggcacatggggtttctggtccaccagggacatgcaatatacccccaataagaccatgtcgccagcacacttcagaaattctgattcaatattttcactcctcatccactctgtgctactggaagcaagagttgctctagtacatggggcagaaatatcacatttgatggtgagcccggtgtgatttcaaagttgatggctagaaatgtcttttccttccagctgactgatgtttgaaattcctccattaaagccttttctcttgggctcaaggtttatatccagtaagaaccttcttccctccacgccatctcctccactaggttgatgacactttacgttatttcccttagtggaatcaaaaacatggattaattgggtgagagaggagaacatagggcagttgagtaattggctgggttgaggttacaaagaaagagaccaaagtgaggaagctgaagtagcttgggggaggactcatttagagatgagaagctcagcctcttgggcccactgcccattgcccacttcaagcccctcttgtactatacaggcaacaaattatcaatgcctaactggccagttctactttttcaatatttctcgccttgtgggctagtgataaatcactgtattaccttttctcgtacatgagtcctgtttcagtcactatttttctgacaagtgtggggctccttgctgagatttttgtatatatctaggcttatcagctgtatttaccagaaacttttaggtagatttacattctggggagactttctcaaatgactgctcttcagccagtttatgttgttgccagaggtggacactttaaaaatattttgtaattttttattgtaaactgacaattaataattgtgtactttatggggtacaaagtgatgttatgatttattaatacaatgtggaataattcaatcaaactagttaacatagccatcacctcaaatacttaacattttttttttgtggtgagaacatttgaaatgcattcgtttagtgattttgaaatgtacagcattattaactatattcaccatgatatgcaatagagctgaaaaaatcacacatattcttcctcactgaacagattttgtgttcttacaccatcatctgttcatttcacccacctttggcttctgtaaccaccattctactctctgcttctattaattcaattgttttagattccaaatataagtgaaaacatgcagtatttgcctttctgtgcctggcttatttcacttagcaaatattcttcaattccattcatgttgtcacaagtgatagaatttctttctttttaaaggatgaatagtattccattgtatgtatacactaaattttttttatccattcatctgttgataaacaggttaattccataacttggctaatgtgcctagtgctgcaatgaacatgggagtgcagatatctttttgacagactgattccaatattttgagtaaatacccagaagtggaattgctagatcatatggtaattctactttaactttttggaggaatcttcatgctgttttccataatggctgtactaatttacattctagaagtgggcactttctgaacttgtctttgaattctggggttaaacagtatttggttctcaggttcctaagtattagtatttgttttattttccccagtctttcccactcatatcccaaccccagcatacacacacaagcagtgtgtgtatgagcatgtctatgagcacacacatgcacacagacaggcaattaagaaatagtgagattgtactgacagatccatgaaggtcagaaagttttgcctcaaattcttgccccatcactgacttaatgtctgacatcagacaagtaatttcaccctctctctgtgctttcgtttgtccacatagaggcctcatctgacttgtggttatcaggaagctcattaatctcacaagcttcaaatttcccaatagttgctttttggcctctagatctgccttttgactccagtgtgttggagaagctttgtggtatggaaggaagagcatttaaaatttggtgtctagtagagctggtttcaagtcccagctgtgcctatttattgacaagtcatttaatctccaggaatctcagtgtccccattcgcagaatgagattaataattaacctacattccagatttttgtgaggattaaataagataggagataccaaaatgtctcataagcatcatgccaaagtaagatgctcttatatgggggatctctaggactgcttggggattgatattgggtcaaagagtttggttcaggctttagttgttgccatacttgttttctctctttttctccctttagcaaaattgtggaagtcaggtaggtaaacagagaactgggattctaagaattcttttggatggactccaaaacctcagagagcccctggagctcccctgcatactctttgatttggaagcttgcctgagtccataacacttctatcctcttttgcaaccattagttttggcatcccagtgtgtcctaagacccacccaaatctttggacaatccctctacaaagctcccttggggattggcatgctgttctgttagcctctagatctcaagacaaacagtcaaatatggctgagggtggggggcccttgagtttgaactttaatagcatgtttttccaaaataagatccagtggtgtcttgagtattccaagtgcacaagggctgagagtttcaattaatgaaacagtctgattatttactgggcaactgtctgtataagacactacactaggtactgtgtaaaaagaaaaagctttggaatcagaggagttgggcttcatgtgtttagaacctataacatggcctaatggttgtgtttaactgtactgtgagttccttaaggatggaaccatctctgtattcccagccctagtacaggaggagtggaataaatgaaagaatgagtgatggaatatattttcaagttgcttacctcttctgaaaacagagtgggctcaaatagtccaattatttgaactatttgaggcttagggagagtctgatgccagttaatggaggttggactatagtggtatgctctttctacttgcctcatagaaggcttgttcaagccttgaatcaaatatttgcaaaatgctttgagattctccaattaaatgtgctaattattatggtttttgtcattattgttaagggataaatatatgtgatataaaatagggaacagtggacttgatatttaaaggggtaaatctaattggaatttctaagttaaacaattcagaactgctccaaatgagagctgctgtgagtgagaccatatttcagattaatgagttggaaacacatcccattacttttctcagtcttggtaaacacatttttttcttatggattagaggaaatgagagaacagatgaaagagaattgaaaggaggagagagaagcacattgagaggaaagtttactggaaagagagaaaggcagaacagaggcagaaaatttgactcctctgaggtcatcactcaggccctggggtgactagcttgagtttacactccttttctcttctgagacttgtggttcttgacaaccaagtaactgacctatagatggaggccaacctggagtcttaccctacctgtaagagtcccttggctggaagaaaagaacactgcacaaatgtagacctctcaaaatagccaggataatttaggcttaaaatttaacagcctgttttccatttctactctctttttgggtttggtgagagccattgaatgagacggtaagcgggtaggtagaatctgaatatatgtactctagatacagaagacaatggcttacctaatgccaaaagatcagggcacaaatgataagcaaaatcttcaactgagcatccagacatttggttgctgtcaagccaaacatccacacattcccaatgatgaagctgtatggtggcggtagacaaaacatctggatgacagcttgatatagtgttcacttttcatctggctgctctggctcagccccgtagggaggaagactccagggagtggtgaggcaatttctgagccaacctgaatgcttatattcttttggaaaattgattatagcaggcttaagattttttatgttttctataataagggcaaaggcacagaggaaaccttctggctgattgggaaaaaaggcttcatgaagccccttcctgtgcccccaccagtggacaaagatgggtaagtggagttcacatttaattggagtcttcctatgccatactctgccacactttcttcactacctatttgatgtctcccctgccctgcaggcaagtgggccatggcctgcaaccagtggagattgcagccttccaaagaagaaaagcagaaaggcagttggtgagaaacaagccataaggtaatggccaggaggaaaacagagcacagcagcttgccaaattttcaaatctggggcttcctttggcatgcgtgccagtgtcagcctatactctgttggcatagtgtgatggagctggagaatttccaagctctaataaaatgggtgaaaaccttgttgtggggaggcctgctgcagggtgagctgcacctgtgggaaattgtctgccctggcccgagagagacccttacctcttgccctgacaacatatttgaatgctaacaaagctggccttgctatccaattatcaggcaggtacacctgtctcttttattgttgagcacctgggccacatggtgagccacatcagatctttagagacttacatctgtctaggcaatagcagtaggactaccggctattcctgggatctgttgacaagaccaccttggaggggatgtttatgtcatttcctccggaggcactgcctgatccctttcaaaggatcaattttgccaaccaaaataagactggctactctttgactgcctggcttgtattcaggacaatttctcccatccttcctcccctactaggatggtacaattctgaagcagcaacaaccatctaattatcaagaattctctccacatatttatcggtatttatctctgaggaatccattgtgttcttgggctcttttcagtatctcttctcttctttatcgtgtttgctttttttttttttaaatcttgctttcttattctctcttccatggaaactttggccctgaaacactttgctccctccacatatccttggaaatcacaagattctaaggtaaacattaaggcatctccacatactcctgctcccttgttctctaacatgtcccaaaataatcacaattctagcagccactactaaaggcatccacatactttcatattctcccactggcctctgatgactttgttgattctttgtgactgtttctgtcctaaggaaaccccaatgcatcttcatttctacaacaataacaggtactctgaactagtcgtaaacatttatgcatcacaaaggcttctgtattgagtgtgtggctcttctgcagcctcctgaatcaccctctgactcactgacacctggggccaggatttgttctacagtcttccaatttccagaaacattctttcctgtgattagggaaacacaggaacaacctctgacacagacagacacacacacagatccagacacatactctctagcctctctctctctctctctctctctgtaggaaagtgtttggaagttcttgaaggatttatccctttggaagggtagtgtggcattggaggcactgtacaagaatccatccattcctaagaatgtgttggagtttgcagcagaaaatactgcaactcacttaccatcattggctgtgtgattggtagtgctttcctgacatgcagatgcatgttgcttaggtcatttgtaaattcactcatctggaaccccttgacagagggccagcttctgtgtactgtagatatatggaacagattgaagccactgggtcaagagaggaaatccatccctggtcctggcctcattaacacatgtacttcaatcagcatgttaactgaccacatggccttggtggcctatacaaatcacaaaaatccccaagaagtacatccctgacaaatttcagaaggcttgtcctaagtccaagcactcctctgttgctgttacttgctaacaccacctattccagaatgtttccaactttctgtgaatttacaggctgacacttactgggatagacccaacttacaaaagacctatgatacctatgaatgccactgacttgctgccaccatcataagagatgttgaggaaaaacttgaaacctttaagagagccctgtggggttggccagggaggaagaaaaactgctatgaaagggggcacagctttggtgaagtgattacaggggctgcctctgaagcagggccctacacgtcacctgataactcttatcttgtgtccccaaatatccactacttctcaaacctggtttttgtatcatctggttactttccataaaatttcacctactgaggttaattttgggctgacaagccccctcttttaatcatagatgtgcttttttgagggtgagaaacaattaatcacccatatcataatgaaggtgaactgagctaactgttcaggaggacttggcagtttcgttttgattaggacaaggagaaatggggaagttggcagttttgaagaatagagggtcacactggcaggcttgggataacacaaaagcagtggatccctgggaaatagaagaagggtgaaaataagtatgaaggtggaaaagttagcttagattccacctcttttaaaccttttgagtctttattggactcaacgaatggagagaaagcacattttccttctgctatcaggacccaggactcccaccagagctttaatataactctgctccatgtgggttaaatcagcctttgtggactggctagaaacctgaccaccacacatatagcactgttactatggaggaagccactccaagttccaaatcattgatttataaatgtgtagaacatacctcattagtaagttgaagaccacctgtatattaacatgctctcttttttgttaaatttgtaaaacccttgtaaatggcaatgtctaattttgcaaacctgacacatgtaataatgtttatttgtttaacaatccaggaaagttgagcaatttgcaagctgtttatggaatatagtagtggtgtggggcttggaatcattcatattgaaatcctgtgaaaggcctaggatatataaggtatggttactgttttctctttctctcgcccaggggcaaagggctccaggatttgaatcttctcttggtgaggcaatgggaaagctcacttcagttcaagaaattgttctgcctgggcaagaaatta

SEQ ID NO: 206 - DNA, 21474 bp, Homo sapiens
  source 1..21474: mol_type = genomic DNA
gtagcaggccgggggcgggccccgctggttgctcggttacagcgcgtctctgcgctccggacaaaactctccggcgtttgcagcccacttcccgcgcacttggctgtgccattgaggcgtcaaagagtgtgggcgcctgtggtcgaacccgctacggactagctttgtggtgtcagcctttgtgacccggaattgctcctgtcaaatgaggatcttcccagtagtgttttgcgaggattaggtgtaaatataatgcctgaccatagtaaaagcgctcagaaagtattaactatcaccgccatccgggttgaaaaaggtgtgagcgcagggtacagaaatgctggctccaggtttgacctccggggcgagagatgagacaccagactagggaacttcctctactcgcctctacgtctacctgggcgcgccggaggcgtcggcaaggaggcgggggcggggcgcggaggcgggaccggggcgccgggggcgggggcggtaggcggaggcggggctggggcgccgggggcgggggtgggaggcggaggcggggccggggcgccgggggcggggcgagtccggaggactccttggactgcgcggaacatggcgttctggggttggcgcgccgcggcagccctccggctgtggggccgggtagttgaacgggtcgaggccgggggaggcgtggggccgtttcaggcctgcggctgtcggctggtgcttggcggcagggacgatgtgagtgcggggctgagaggcagccatggggcccgcggtgagcccttggacccggcgcgccccttgcagaggcctcccagacccgaggtgcccagggcattccggaggcagccgagggcagcagctcccagtttcttcttttcgaggtattttgggcaaggacaagcacttcttgcgtgttcgttgtcgacacctcgcccactctttctcaccttgccgtgtttcctttgcggcatgtctgggagtttacgtgcgttccaacaccggggcctccgtctttatgctgatctgtggacgtcacttatgggggttttgtcgtttatttcaccattccctcattgaaatacgttctaacctttagttattgtgcatcatgctgtggtgaataaccttgttggcacctcactgtttgcataaattcctagtactgggattgctaggtccaaaagtatatgcatttaacgctttaatgatccctcataaatgttgtgcggttaatactcccactggcatgtgatcgtacccgtctccatagtaattgcatctaagaactgaggctacataggaaaaaatcttaaggtccatggttgttaggtatcagatgccctataatggatgaatatttaagtaaataatggcacattgacttgctgtctgacacaactgctgaaaatgttggtgaaaagtgagtctcgaagtggtagctcacacttgtaataccagcactttcggaggctgagacggggatcgctcgaggccaggagttcaagagcagcctgggcaacataacgagacccccatctctaccaaaaatttaaaaattagccgggcatggtggcgcaagcctgttgtcccagttactcctgagactaaggcaagaggatcccttgagtccaggagttcaaggctgcagtgagctatgattgagccactgcactccagcctgggtgacagagcaagactcttatctacctgtgggaaaaaaaaaagaaaaaagtttaatagatcctgaagagttggccgggcgcggtagctcacgcctgtaatcccagcactttgggaggatgagacgggtggataacgaggtcaggagttcgagaccagctgggccaacatggtgaaaccccatttctactgaaattacaaaaattagccgggcgtggtggcgggcgcctgtaatcctagctactcaggaggcggaggcaggagaatcacttgaacccggaaggcagaggttgcagtgagccgagatggcaccattgcactccagcccgggcgaaagagcaaaaactccgtctcaaaaaaaaacaaagatcccgaagagtcagtcgttcatccaagaagccctgactgagctcttattctgtgccagactctgttctaggtgctatggatggagcagggaccaggacctacaaacacgtggagcgcattctaatatctgtgatactctgcaaaactgttaaaacaaatccttgcggccgggcgcggtggctcacgcctgtaattccagcactttggaaggccgagacgggcggatcacgaggtcaggagatcgagaccatcctggctaacacagtgaaaccccgtctttactaaaaatacaaggaaattagccaggcgtggtggcgggtgcctgtagtcccagctactcgggaggctgaggcaggagaatggcgtgaacctgggaggcggagcttgcagtgagccgagatcgcgacactgcactccagcctgggcaacagagcgagactccgtctcaaaacaaaacaaaacaaaacaaaacaaaaatccttgctaccactggccctaaagcaggaggcatagggctgcgtgtgaggagtagtccattgcatgggcttcctccagtttggctttggatttttgagctctctgaatttgttgtttgtgtcctttgcacagtgtccctcccaggttgcacccatgcctgcccctcagggtcccccactcccagtgaatttcacaccatgcagcatgtactttaagccatacatcttacgtatgttccagacatttggtaaaacgccgtttatgtgtttttcagtgactcacaaacattttatttacgtaaatgaggaatgtactcaggcacccttcgtgataccttgccctcagcaggcactcaacagcaataataactttcattccttttgtgcttctcttaacagttcgtgtttagtaggagcacagtagctgtttggggaacgaccttaagtgaatagatgtctgaaatgctgtgtgaagtggggcgcttaataggtggtgagatggttttagaaccagggttttccctctttgcttcttgactccttaaccagttttcattaggagacccctttggaggtttgcagtcagtcagagttgagtgcctactgagtgtactgaattatgaaatgagcacagttcccattaacctgaattttttgctcccaagtaagtcttgatttctgatttatgactgctttttgttgtaccccaatagtcgtctaagaaaggtgattattttgagaggcctggggagacacacatgctcattctcgagggtggcggtggtgcagagggcagagccatgctcgttcttgctatcctgagattggttgctatctgtttcctttgctgctgtgtttttttctgtcagtattaaaggtggaagaaggtccatatctttttctgtgggtgcttcaagtgttgttggaagtggaggcagcagtgacaaggggaagctttccctgcaggatgtagctgagctgattcgggccagagcctgccagagggtggtggtcatggtgggggccggcatcagcacacccagtggcattccagacttcaggtactgcccacagtcccacctgccttctgcgctcccctcccctgactcctgccctccccactgcccagtttattccacttccctgtcctcttccaaaggcctcagagcctttcttctctccctgcagatcgccggggagtggcctgtacagcaacctccagcagtacgatctcccgtaccccgaggccatttttgaactcccattcttctttcacaaccccaagccctttttcactttggccaaggagctgtaccctggaaactacaagcccaacgtcactcactactttctccggctgcttcatgacaaggggctgcttctgcggctctacacgcagaacatcgatgggcttgagagaggtgagccctctgtgagtcgcacacattctttttctcccacggaggctcgggtgcctgtttctcccagggaggctcgggtgcctgtttctcacaggggatgctcgggtgcctgtttctggggacggccaaaacctatcgcttatgcttcttccttgggactttttttgagccaactagttagggctttgttcccaaggaaaatgtcctctgggtgtttaaaggccactgcttgttctcctgcatacctgcagagctgtgtattttgggcagaagttgacattgttttgccaatctggtgtgatgatctctttttttcttctctcttttaagaagtgtattatggaatttttttgagcacacacaaagagagcaatgtaacgaaccgtcctgtcctcatcaccagcacacagccagttcttcctgcgtcctcaccaccttcttccaaatccccagattattttgaagcaaatctctcacatcatgaatttaatctagaaataatctataaacacatgaatggatagctctagagaatactttaaaaacaactccggccgggtgccggattacaggtgtgggatcacacctgtaatcccagcattttgggaggccgaggcaggtagatcacctgaggtcgggagttcgagaccagcctggccaacgtggcaaaaccccgtctctactaaaaatacaaaaaattagccaggcgtggtggtgtgtgcctgtaatcccaggtactcgggaggctgagacaggagaatctcttgaacccagcaggcggaggttgcagtgagccgagatcgtgccacttcactccagcctgggcgacagagggagattctgtctcaaaaaaataaataaaaataaaaataattaaaaaataaaaacaactctgatagtgattcacactgaagaatcactagtaattccttaatatggtcacacttagtctgtggtgatttcttgaccgtatccatatggtgcccaaaccagcgattcacaggttgtgccaacttctggccgtgcacctaacggaagcacttggtggggccttttccttacgtgcagtgatgcagacaggtgctgggacagtcagctctccgggagccaggctcccggagagactgctgatgtgttgtcagttaaaaagaggtggcaccttggctccaggaatgtgtttccttgccagaaggatcccctgacttggaaccacagaggcagcagcggatgccccatgttggtgggctcttctcccagaggtgcagcagggcaggccttgtgggaaggtgggagctcctggctgtgagattcagcactgctgagttagggcagcgacagggacttgggaagcctcctgcagctgggaccctggctgtgccaccgcagcctttcagaaccagttaatactaacacaactttcataagaagtcactttttgtctgtttctaccaagcaattcttttggaatttatgatatttatatcctcattttaacttggtatctgtagaatagaagatatgttcctggatattagatataaatttttgagacagggtcttggctctgttgcccaggctagagtgcagtggcatgatcatagctcactatagcctgaactcttgggccgaagtgatccttttgcctcagcctctggaatagctgggactacgggcatgcactaccatgcctggctaattaaaaaaattttttaagacaagtctcactatgttgctgaggctggtctcaaactcctggcctcaagtgatcctcctgccttggccttccaaagcactgggattacaggcatgagccactgcacccagcctggtattaggtgtaatttttttttttttttttgagacagaatctcgctctcttacccaaactggagtgcggtggcacgacctcagctcactgcaacttccacctcccgggttcaagcgattctcctgtctcagcctccccgagtagctggcactacaggtgcctgccaccacatctggctaatttttgtatttttagtagaggtacggtttcaccatgatggccaggccggtcttgaactcctagcctcaaatgatctgcccacctcggcctcccaaagtgctgggattacaggtgtgggccactgtgcccggctggatataattttatttgagcttttatcaaatggtttttcgtactgagttttgacaggctttgttttaaccgtgatttggctccagctaggtgcccctttgctcccctgccttattctggttgatggcgcatgtaggtgatacgggcatgaaaaccaggcttgaggacatcacaaccccaaggggctgtgcctccttccaggagtcctgccaagcccagaagttgtgctcttggccttgcgtgctcatctcggaggcggcagcaacacttcgctttggcttgaatttcagtgtcgggcatccctgcctcaaagctggttgaagctcatggaacctttgcctctgccacctgcacagtctgccaaagacccttcccaggggaggacattcgggtgagttatcctgctgttggttgtccttctgcagtttgctgttggggtgatctggaaaagtggtattttataagcattgtctcgaaaggacagttgaacaataatagtgtgaaacattttatttgtaaattagaaaatcaatacatgcttgtaaaaaaatttaagacaatatagaaatatgtagggaaaatgaatctcccttcagccaattccagctgcccactttttttttttttttttgagattgagtctcactctgtcgcccaggctggagtgcagtgggcgatctcggctcactgcaacctccgtctcccggattcaaggaattcttctgcctcagcctcctaagtagctgggattacaggcgtgagccaccacgcccggcaatcagatggccttttgtgccgagcttatttcctgaaaatgtttctcgctccttcgccttgtagcttgtgttagtatttcatcctgtttcatggctaaatgttccactgatgtatgcaccacagttggtttgtttgtacatggatgggtgtttgggttgtcccacctttctgctcttgtgtatagttctgctgtggagcatatgcaagtattcgtttgagagtccttgttttttattcttttgagtatgatacctacaagtattgctgggtaactccacgtttagctatatttatttatttattttttgagacacagtcttacactgtcacccaggctggagtgcaatggcgcgatttcggctcaatacaacctctgcctcccgggttcaagcgattctcctgcctcagcctcctgagaagctgggattacaggtgcctgccaccatgcccagctaatgttttttgtatttctagtagagatggggtttcaccatgttggccaggctgctcttgcattcctgacctcaggtggttcacccgcctcggcctcccaaagtgctaagattacaggcgtgagccaccatgccctgcccatgtttaacttttttgtttgtttgttttgagacggagtctagctcttatcaccaggctggagtgcagtggcgcaatctcggctcactgtaccatccgcctcctgggttcaagcgattctcctgcctcagcttcctgagtagctgggactacaggcacacaccaccacgcccggctaatttttgtatttagtagagtagtttcaccatgttggccaggatgtctcgatctcttgacctcgtgatccgcctgcctctttctcccaaagtgtgggattacaggcgagagccactgcgcccggcccgttttaactttttgaggaacgaatatactgttatctgcagaagctggaccattttacattccaccaacagtgggcaagggtttcatcttttccacatcccaacacttactttccattttttaattacagctatcccagtgggtgggaggtggtaacccactgtagcactgattggcattttcctaatgattcatgatatcaaacatctttccatgtgctttttggccatttgtatatctttggagattgaagtcctttgcgcattgtttaattgtgttgtcttttttattgttaagagagtcctttatatattctggaagctagatccttatcagagacatgatttgcaaatattttctgtcattctgtaggttgtcttttttactttgttgatgtcttttgatgcatagaagttttgattttgatgaaatctagtttgtctatttattttctcactcttttggaatcatatctgagaaatggtattgttttactcctgttttcttataagagttttatagtttaaagcttttacatttagttctttgatccattttgagttaatttttgtgtgcgctgtaaggtagggatccagcttcattttcttttatgtggatatgtaattgttccagcaccatttgtttaaaaaaactgtggtcttggcattgttgttgaaaatcagttggccataggtgtatgggttatttctagagtctcaattctattccattgttatctgtatatccttgtgcctgcactataatgttttggttactgtagctttgtagtaagttttgaaattaggaagtgtgagtccagcacatagtagaaacttgatatatacgtattattgttttggtcaactcattcattgaatgaccaatttattcaacaaatagtttagtctcctcagtgccaggccctttgctgggttctgtggatgtgaatagaaattaaaataaggtggagtcatccaacagttacaactgggtgccatacgaattttactataaatatgtactggacactacactgactcagctgtaggaacagagtaggctgggaagcacctttgagatgaggccgtctggatgtaagagtctgtttctggcagcagagacctggagtgtgggaggcctgcttgctctgttagggtttgaactgtatcctgacgatcatgggaggcattggaggatttttaggcaggaaaatgatgtgaagggatttgcatttaaaagagattatttgggactgggcacagtggctcacgcctgtaattccagcactttgggaggcctagacaggcgggtcacctgaggtgggaagcttgagagcagcctgccaaaatggtgaaatcccatctctactaaaaatacaaaaattagccaggtgtggtggtgcacctgtaatcccagctactcaggaggctgaggcagaagaattgcttgaacctgggaggggaggttgctgtgagctgagatcgcaccactgcactccagcctgggtgacagagtgagactccatctcaaaacaaaataaataaataaataagagaataaaatagataatttgggcaacaggttgatgttaattccccacctttgttcttctccttcagtactgtgttggctggtctgaatcttttggcttttcatataaatttctgaaactgttgctatctgttctctgcctgttttatttttgttgttgttgtttggattttttgtttttttgagatagagtcttgctctgttgcccaggctggagtgcagtggtatgatctcagctcattgcaacctccccctctcaggttcaagcgattctcttgcctcatcctcctgagtagctgggattgcaggcatgcgccaccatgcccagctaatttttgtatttttagtagagatggggtttcactatgttggtgaggctggtgtcgaactcctgacctcatgatccacccgcctcggcctcccaaagtgctgggatgacaggcatgagccaccgtgtctggcctctctgcctgttttttaagacttttgtctttggagttttgcggtttctccactgtggttttccatatgaattttcttttatttcttctgcttaaaatttgtaggccagttggtcatggtggctcacgcccgtaatcccagtactttgggaggccgggtgggtggatcgcctgaggtcaggagtttgagaccagcctgaccaacatggagaaaccccatatctactaaaaatacaaaattagccgggcgtgatggtgcatgcctataatctcagatactcgggaggctgaggcaggcgaattgcttgaaccagggaggcggaggttgcggtgagctgagattaggccattgcactccagcctgggaaacaagagcgaaactccatctcaaaaaaaaaaaaataataataataattgtaggccttccttaagaaaaataaaataaaattctaggctgggcgcggtggctcctgcctgtaatcccagtactttgggaagctgaggcgggtggatcacctgagttaggagtttgagaccagcctggccaacatggtgaaaccccgtctctactaaaaatacaaagatgagccatttgtggtggcacccatctgtaatcccagctactcgggaggctgaggcaggagaattgctggaacccaggaggcagaagttgtagtgaaccgagatcatgccactgcactccagcctgggtgacagagcgagatgccatctcaaaaaaataaaatataaaataaaattctaagccctgcaaccaactgaatggagccctccccttggtcaagggaaccccagagaaaccttggaagcttgagttcctggccgtagcaggagaggaggtcagacgcgcctcactgtacccctccctccccagccaccattaggcttcttcactaagggctaaacagaaaccagcccttttcaaagactctacactgctaatgtggattactggtttatcttcccagatacagattaaagacaagatgagattaatggttccttcacccttccctgagaggtctgcttagttctcttcctctgtttccttctatcttaggtaaaatgtacatttactgggcacttactgaagtctcacaagtacgtaaccactcacctcacagccaccctccctctttgaaggaccacatgtaattactaaacctcctgagaacctcttgggacagaaacaagcacagatgtgccgtgactcatgtttttcctgtgggcaccctcaggctggctcagtagccctcacttgcttgagatcctgaatctgcgggttggcgtctttcatggttgctggatcatactctgccgttatctcttcggatatgagttgcccctagcccactatctggcccctctctttagggacctctgattgaacatacattagaccttctctctcctgctgttcctgatcactcttctgtcctgtaattgctgcttcttgtgctgcattctgggtaatttcttctggtcttttttccagtttactaatattgtattctgttataaggtccttccattgagtgtttctttctttcttttttcccaaacagcaactcaaaacagacattgagttttaattttggttcctgtactttttatttctagaagttctatttggttatttttcaagtctgctacattattacataattttttaataattttatatctttaatagatagttttttgttttgttttgttttgttttgttttttgagacagagtctcgctttgttgcccaggctggagtgcagtggtgcaatctcagctcacagcaacctccgcctcccaggttcaagtgattcccctgcctcagcctcccaagtagctgggattacaggcacgcatcaccacgcctggctaattttttgtgttttagtagagacagggtttcaccatgttggccaagacagtctcgatctcctgacctcgtgatctgcccacctcggcctcccgaagtcctgggattacagagctgagccactgcgcctggcctttgatagatatttcaagttcatcttttttttttgcttccttaatttttttttttgctataccccatgcctccaagataacagttttttctttttaatttaaatataatacagttttactgtgtatccaagaatatctgaaatctttcgtgggtctctttcttttgtcttttgtatctgttgctttttgctgggctgagcctgcttaaaacaagccccgttagctgtaaaggtttaccttagaaagtcaggtgtcttcctctgtaactctctcccttttccatctgctccaaggcatttatttatattaatcttgacgcaaagggaagttgtgtccacttcaccttggccagtaaggaagcagtgtttggcagatgttgttactcctaataatgccagccagtgagtgaagctgacctgaatgcctcccagggctgaggcaatggcatgatcaccgaagctcaaaccagagacagtttcacctttctgactgaatagtgttcggtgtaggccaaatgcctgcagactactgtttgaggactggtgtggtctaccaggtgtttccttagcgcctggatgtctctggctgccatcccagggatagagcatggtgttagatacgctagatgcctgccgaagtaattatgggtgaaacatatgatgtccaagatttgcttttaaaggctccaatacctcctcccagattccggagggctgtgaaacaattagctatgaaaactggtaattcctgaagctgggtacatgggggttcatgatccctctctcaccttttttgggggagaatgtttgagactttaataagaacttgttgccttttccttttacagggtgttgcaggcatcttcctcaggcctgttttctctgttttccaggctgacgtgatggcagacagggttccccgctgcccggtctgcaccggcgttgtgaagcccgacattgtgttctttggggagccgctgccccagaggttcttgctgcatgtggttgatttccccatggcagatctgctgctcatccttgggacctccctggaggtttgtcagcaggcctgtgcagggaggaggctggagggcaggggaagggaggggtacaggagtcatctcatgggctgtcggcaggcctgtgcagggaggagtctggagggcaggggaagggaggggtacaggagtcacctcatgggctgtcggcaggcctgtgcagggaggaggctggagggcaggggaagggaggggtacaggagtcatctcatgggctgtcggcaggcctgtgcagggaggaggctggagggcaggggaagggaggggtacaggagtcatctcatgggcccttccagggctggtgccactttgggaaggtgaatggattcagctggggttccaggctgagggagcagcagcctgtgcaggagacaggaaggtgggaagctgctgggctttggaggtggtataggtgtgggtggggcaccacgtgtgaggagaagggagaaggatgggggtgtgggggcgaggtggaggggcagggcctcccaggtcagatcaggaatactgatgctgcagtgggaggagtgataaatccacagggactggcccggggacgtagctgcacccttggggtcagggaggcctttggggagtggagagtggagcaagcagtgccaggaggctggtcctggagaaggtggagctgtggtcgcctgagggatggcgaggagggggactggactcgcagtctgtgatgttttggggacgtgagaaggaggcgtctggcttggtctgtaaggtcagggcacttgctggtgaggcgtgatttgggagggaggatgcccagctcggttctgtgtgtgtctgaggtgtcgggaaacatgccctggatgtgttcaagcagctgttctgcgtctgcgtctgcagctcaggaaattcctaaaagctgtgatgagagcaagaaatgagaccatgaagtcagtgtgtgcgtgactggatgtaggcaccgaggacagaagggccagaaagacctgtgctcagaggggcccagggcagccacaggggcccagagcatgtgtttgttcaggcattcattgtgtgctgggccctgctccagtgctttggacatacacggtcagatgtcagtgtaagaagttatatagtttgttaggagatgattgatgttatgagaaagataacaagtaggatagaaaggctagaagggttgggaaccagctgcagtgtcaagtcaggcaggtggagttggatctaagagtttaccgaggtgaggagggtctggcaggggacactgcacaggtgacaagcagcaaggagggtggggcgaagtcagcattgatggccacggggctggagcagagaagaaggtggggcacaagtgtcatctcatgggaggctggcgccacctcagaaggtgaatgggttcagcttgggttccaggccagagtctgaagttgagaggactccgttgggtgctgggctgtgagcccaccatgggggcaagactgggagcagcagacccagcagggcccttgtaggtaatcaccggctggcactggctgggggccaggtaaagccagcagaggctgaggggtgctggagtctgggtgtgtgtgaacgcagagtgggtacgctggcacagtgcatgggaggccgtggattcccaaggaccccagggctgtggctggagcagctggaaagacggagccgccgcttcctgagatggagaagcctggtaggtgggtttgggggagctcaggaactcagccttgtttccacggatttgaggatgtgctgcggactggaggtgttgagcaggtggacatgagtctggagtccaggaaggcccagaggcaggagctggggtgctggagtgagcagacaggagagcccagggtgtggacagacatgagaatgccatgctaggcctaggatggagggacagacacaggaggagcagtcagaggggccatggtggtcagcacagtgtgggctgagaccagctgaccgtgctggccaccaggtgtggacacttgggccaccagccatctttattgttgaagtgaaatgaaaatggcctttttcctgattataagtgtatcatgtgtgtctttgaaaagattcgtacattatataaagatataaagcaaaggatcaactttttaatcccaccaactgttagcattttattctgtgtcctctcagctttcttttttttgtacaaatgcatacgtacagatggtaattttaaactaaaagttggacagcactgtacattctattctgcagcctgctgttttcacgtaacaatgtgagtccatggagatgtgctgcgttgttaatgccaacagtttcccttacacggatatgaggtcccaactgagaaacccatgtctgtaaggctggtgccatcatgaactgaatgagctggtgtcacgcacagactctatctcatgtgctttgtggacgaaatgttaatgtgtttgactgtggagtaccactccagatcccctttaggtgtgacataacgtgggatgtaaaccatatgatcttttctaaaatctcaaaaattctgaaacatattcagccacaagagctttaacatagattttgtggatttaatacaaaatttatgtaagcaatttcttactgatggacaatgataataaatagtatataatttttacattaaaagtaatgctgggccaggcaccgtggctcacacctgttatcccagcactctgggaggccaaggcaggaagattgcctgaagctaggcatttgagaccagcctgggcagtatagtcagacctcgtctctacaaaaaataaaaagatagccaggcatggtctgtgtagttgcagctatttgagaggctgaggaaggaggattgcttgagcccaggaatttgaggttatagtgaactatgatcatgccactgcattccagcctgggtaacagaatgagatcccgtgctgtagtgaatatccctgtgtatcatccttatctactcatgcaagtactcctgaagggtaaatgctgtagtgaatatccctgtgtatcatccttatctacccatgcaagtactctggaagggtaaatgctgataaatactgagaacttgccttccggtgaatatccctgtgtgtcatccttatctacccatgcaagtactcctgaagggtaaatgctgtagtgaatatccctgtgtatcatccttatctacccatgcaagtactctggaagggtaaatgctgataaatactgagaacttgccttccggtgaatatccctgtgtgtcatccttatctacccatgcaagtactcctgaagggtaaatgctgtggtgaatatccctgtgtatcatccttatctacccatgcaagaactcctgaagggtaaatgctgataaatattgagaacttgccttccagaaagatgtaacaattacactgccacaaactgtgtttttatgtagccattttatcacatcctcaccaaaaccaaaatcacacaaatcaaattggttaaaaaatgcatgtgtgtgtgtggaggggggtgcggattttgcctttctgtagtaaagaatgaagttcatcttttcatgtttattgccagttgtgtttcttctctttggattgtatatttgtacctcttgaccatttttcattgggtcattataaattagcaatataaattagttttaattttagtataaattaaataatataattacattttaatgttaatataaacttctttcttttttttttttttttttttgagacagagtcttgctctgtctcccaggctggaggttcagtggcgcgatctcggctcactgcaacctccacctcccaggctcaagccattctcctgcctcaacctcccgagtagctcggattataggtgcgtgccaccacgcccagctaagttttgtatttttagtagagacgtggtttcactatgttggccaggctggtcttgaactcctgacctcagctgatctgcccgcctcggcctcccaaagtgctgggattataggtgtgaaccaccatgcccagctgttaatataaatttcattataaattagcattataaattagttcataaattatatgtttataaatgagtttatcaattagcaatataaactattgtcatatgttgtaaatatttttgcagtttatgatgatgagaggtttttaaaaattttaaattttctacatagtagttttatgtagataccgagataatagtatttacatagtcagatctgtcattttcctttgccttatctgacttcagtttttacgcctagaacgttcttccctatccttacttgtaaatccttagttttcttcaagaactgttttgtttacattgaaacctttaatccatttgaatttttttcagtgggaggtaggaatggagtattttcctcccagataatgagccagttttaatgccatttattaatgtatccatttttttaccttgttcctcttaaaagaagctttgagagctgtatgaagaagcctgatggcaccgagctaggcctctctagaggctgggtggggaagaccatggagagacgtaacagtaactcctgctcgggggcaccagctcgtctgggtgcccgatgctggtggtggctgtcagagcaagcagggctagccagaggagatggacgagtctgtgctgttgtccctctgcgtcatgctgggagacagcgaggtggggaggacagggagaacagaacgtgctcacaaagaggaggcaggaaggttggatccctgatgagccttggaacggaggtggggaaaagcaaggatgtgtggaaacagcaagaagtgggagagagagagagaggcggaggggagaaaaccgtcacggaggccaagcggcaggagctcagctgaagaaatgagattggtggtgggttttccctatatcgcaggctctgactgccaatctgctgctcctccaaggcctcggtggctgtggcatgaaacatcctgaggagcttgtaaagtggacactgtgcccctcacgtttggcccatttttcaggtggagccttttgccagcttgaccgaggccgtgcggagctcagttccccgactgctcatcaaccgggacttggtggggcccttggcttggcatcctcgcagcagggacgtggcccagctgggggacgtggttcacggcgtggaaagcctagtggagcttctgggctggacagaagagatgcgggaccttgtgcagcgggaaactgggaaggtacagactgctgaggaggaccatccaaggggctgcccttctcactgctctagggtatggtccacctgatatggagccccgttggttaacacagtaacagtaatagctgatgatgctgtgaatcctgcaccaggcactacctggacctgactgggtgttactttcaatacctccatttagagatgaggaaacagatgctaacaggccaagcagggacacggtccagacactcagggctgatgagtctgtattcttaacagactataggcgttaccttcactccctaaaataaagcagccaacagtgtccctctaaggcctggtatgtgattctaagatgatacgggttaaagaactttgagaagctaaagttctctgcatctatgtgggatgaaggctacatgagtgatgcttttcggaagtaattggtatgagagccattgatcaattataatccgctgaggaaagccaaagagccttgatgctttctaagagatttcaaaccgcctataaacaagtgaagttacagaaaatgcagtttcccataagaatcatgtagcatgtgtagccttgatattaagggttttcaatgggaggtggtagcattaagcatttaaagtccagtgtcatgattacaggcaggtgtaacactgtccaaaggggatttcaccagtgtattagtctgttctctggctgctcataaaggcatacctgagactgggtaatttataaaggaaagaggtttaatggactcacagttccatatggctgtgggggcctcacaatcatagtggaaggcaaagcaggagcaaagtactgtcttacaaggtggcaggcaagaggacgtgtgcgggggaactgccctttataaaactatcagatcttgtgagacttattcactatcagaagaagagtgtgggaaagacccgcccccatgattcagttacttccacttggccccacccttgacacatggggatgattacaattcaaggtgagatttgggtggggacacagccaaaccatatcaactacaatatatcacagttgatgctcctcttgccttccaaggcagatgtcttaggaaatcctgatcctttttccttgtccacagctgtggctgcctcatggctcagggccatggggtcagcactctcctcacctccaccagtccaagacctccaacctctggttgcaggctgattttttaccaatcatggtcacttcattatggaggcagggaacccagctaacaatgaggcttaaacgctgagaggcgagtgcctcctggccagctcacaaggcagcggagatcttagatcagcccagcaggcttttttgagggatccttttcctgctccaacttcatattttcttttttttgtaatggagtttcactcttgttgcccaagctggagtgcaatggcacgattttggctcactgcagccctgcctcctgggttcaagtgattctcctgcctcagcctcctgagcagctgggattacaggcatgtgccaccatgcctggctaatttctgtacttttattagagatgggatttcatcatgttagtcaggctggtctcaaactcctgacctcgggtgatccacctgcctcagcctcccaaagtgctgggattataggcatgagccagcaggcccggcccaacttcctgttttcatagaaaagcagattgtaactctggtagctcctgtggagttttggaagtggcttaataggatttgaactgtataatctagtttcagagaaatgtatgtaaaatgggttatgatttcattttctgttttttacagcattactatccaaggggttacttttccaaatagtgaatgcttttaagcacatgagcatcagtacatattgatttgggtactttaagacccatagaatgaggctctccatttagccaccctgttctgcccaggcctgctgggatcctcttagcccagcacagcagcagcagtatttgcagaaagcagcttgttttgtgaaatattttgcatgtctgcagctagagctgtttgaacagagatctgctggcctgcctgggtgtgtaaacagatagctgataccctctgtcttctgtattccagcttgatggaccagacaaataggatgatggctgcccccacacaataaatggtaacataggagacatccacatcccaattctgacaagacctcatgcctgaagacagcttgggcaggtgaaaccagaatatgtgaactgagtggacacccgaggctgccactggaatgtcttctcaggccatgagctgcagtgactggtagggctgtgtttacagtcagggccaccccgtcacatatacaaaggagctgcctgcctgtttgctgtgttgaactcttcactctgctgaagctcctaatggaaaaagctttcttctgactgtgaccctcttgaactgaatcagaccaactggaatcccagaccgagtctgctttctgtgcctagttgaacggcaagctcggcatctgttggttacaagatccagacttgggccgagcggtccccagccctcttcatgttccgaagtgtagtcttgaggccctggtgccgcacttctagcatgttggtctcctttagtggggctatttttaatgagagaaaatctgttctttccagcatgaaatacatttagtctcctcaaagggactgcaggtgttgacatgagttggaaagggaaccctgggatacgtggcgtcccctctattggaacagtctgaggactgaaggcatttgtccctggatttattggagacggcccagctcctccctctgaaggtggtcacattctgttgactctccatactcagcctctcctccagaaacagatctgttccagaacattccagcactttctatctggcctccttgtccccacactacgcccccccaccctcgccagggcttcctctagtgacactgttagagctaatctctgagacagggaaggcattactcacttaaaacccaggctgagtcctggccacctgctggattgtgacataggaggtggaatccactgaactgctacttctgcacaggctccttctcctggggctgtacccaggcccagccctgatggctcaccctgtcaggcaccagctgctccctcctgggctctcacccacctgcacatcctccttcctagcatcacattacctgcgtgtttccccagacaaaagcacttcccattcttgaaccttgcctaccctgggctgagctgacggcaatagatttaatgacagtgactcccaggaagggggtcctgtgactttgcgccttaataagaacaaaaggtggaattggtgacctaggaaaactgttgaatt

SEQ ID NO: 207 - DNA, 90706 bp, Homo sapiens
  source 1..90706: mol_type = genomic DNA
acattcctcattctggggctttgcggttttgtcttgggaatctcgaggctctcccaaggttcctttctatgtttatatcatttagcagggaaggattgttaatgactaatctgtgtccatgaggcacagagccaaggaagagatgctgctgctagcccagaaggccgcctgtgatcatgcacagtacactggaactctctcctcctcctcacctcattgtctccccgacttatcctaatgcgaaattggattctgagcatttgtagcaaaatcgctgggatctggagaggaagactcagtccagaatcctcccagggccttgaaagtccatctctgacccaaaacaatccaagtaagtacctaattcctttgggagtgggttgtgtatctcacagcaacagagaaaaaatagtcacttaaaagtttctctttgacatctgtaatgtatgtcaataaatgaattctaagttagtagagtttgatgtaaagtcctgaaaattaaaaaagagagaaactaaaaaacaaaaagaagcagaagcaaaagttaatgagtcttaacagttgcttacctattgaaaacttatttagaaatactcttttaacattgtggtcacctgagtaaatcactggagatagtgcatttcagaaatgtctccgttctgattccataaacaatttgacttgtatagtgtgctatattttggtgatttatcaaatcttgatgtgagtttgggagtattgctaatgtcagatgacttgggaactaagaataagacatttaacctatgcttaattgaaatgaaatttttccctagaagaagagtaggtggaaaaagtcttctttcttgacttcagttgtaaactcttctattgctttccattttgaatattaatatgacaggaaatatcagatggaaatatttttaaaagatagaaatgtgagtatgacgaagaactttagtaataaaattgtccaaggactaaatttatagataagatacctctttgtctccttattgacagagtgaatggggcaactgtggagcctgacttacttcttttaattgggtttttattcagaagggaggggcaggagggaatgacaagtgactcaccttgaattcttcctctaagaaactcacacctgagctttgagctataaagaaatctgatgctgtttctggtgctgtcttagaatcacttcaggagtattgacaagaggggtaggaacccttagaaataatattagtgataaataagaaggcaggaagaaacttttggaggtgatggataggtttatggtatagattgtggtgatgatttaatgagtgtatgcctatccccagactcatcaaagtgtatacatggaatatgtaaagcttttatatgtcagtcacacctcagtaaagtggtttacctatctatctatctatctatctatctatctatctaaatttttttttctgttcctaaaaaaaggaagggagaagagaggaaaagatgttcagggagctaccattttgtttctagctgtgattttataaaatgatagacacttttatctttgtgttacgttcctacccccagtcctccaaattatggatctgtgccatttgtaccgtggacttttctgttttctgaggatgttgcaacaaatactgatgcaactcctggttaactgataaagtactggccagggacaaagctctcttgtcctgagacccttcctcaagatttgcagcaatttcccaccacgtacctctgccctctcctcacagctggagagggaaagtcatggaatccttgtccttcctcttgtttccacctcttcaagattgggccaattgcaatggaatatccattggttgtgaggcctttgtactctgcaaggaaaagaaaagaaatgtgtgtatgtatgagtgtgtgatggagctaacttttctacaatgtctactaacatgtcctagcctttacttcattcgcctgtttccttctcacaaaaaccctgtatgggagtttttctttactttttattattatttttttgagacaaagtctcgctctgtctcccaggctggagtgcagtggcgctatatcggctcactgcagcctccacctcccgggttcaagcgattctcctgcctcagcctcctgagtagctggtactacaggcgtgcaccaccatgccactattttttgtatttttagtagagacggggtttcactatgttggccagactggtctcgaactcttgacctcaggtgatccgcccgcctcggcttcccagagtgctaggattacaggcgtgagccactgcgcccagccaggagtttttcttatactcattttacagatgagaaaactgagactcaaaaaatacaagtgacccgtccacaggcagatagttaggaagtagcgggacctgaacttgagggcgggtctttctgactccaaagcctcttcctggctactctgatattggctattggcggaggctgggaaaacttgaaatggggaatgatcggggagcggcgaggggggaccagccgttaagcattccagcctgacaggggtgatttgttaaacccaggaactagttagacgtttcctgaaacctcctgcatagggcattttcgagagattgcaccatcagtagggaaactggaaagtttggagcactatttgttttaacccagagaccagtctaagatagctgggtgaatatttccgttatcagcgttttaattaaagaccacaatgaactctccatgctgctgtgattagggacatcttagagaggagctcagaactgctgtggctcacagtctctggattatgaatgccatgagaatgcatatcatgatgtgatagattttcaaaggctcacattgtcattaggtgggtgcataaaggacagaaaaggttctttacttcatagaaagagatttcccttccctttgctctcagtctcatttttatcttagtctctagcaacacagattataaaggggaataaaagaaaataggaacaagctagatacagtgatgagtgcctgtgatcccagcagctcgggcggctgaggtggaaggattgcttgagctcaggagttcaaggctgcagtgagctatgataatgccactatactctagcctgggtaacatagagagacaccacctcaaaattttttttaaaaaataagaaataggaacaattttcctcccaggtatttttttattgtcacagtagtttctaccagtgaagatgtagctaaaaggcatcaccatacgagtgtccttagtcaccaagctgtatgaggaggcaaaaatcattattacatacaaatattcatccttctgtcttttctctcccttctctcaccctgctctggaatcccctaacccctttgctcttcacagtgaattattttctccctcagtttgcccatttccaattttggccataaaagaacatctactattcctactctctctgctttgtaaattggtgataagatgacactaatataatgcaacttgattgcaaagtaaaattgcaaatattgcacaggaaaaaaaataagatttattctttgttaggattaagaaatataacagggttctggtgattaaaataaataagtataaatataaaataaatttttattaattttcattttttaatataaaatcctaacaaaactttgagattttgcttcccattttaaagagatttagatgacctttcccaggtctcaatgaacctgagacaacctgggtctattacactttaattaatgttattaatgtaaagaaaaggagaaatggtatggctttgcattttcaagtcctgtagatatatttaacacagttatctggaaaacatggtaaataatgtagttgtgcatggagaagatagtcctgctgtgggatgttgctgattagagaaaacaaaaacactgctctgggctgtgactgttcctaagcagagagctatttgctgccatgtcctagagagttatggaagctgccagtgtagacgacaagttgataccagcctggggcttaaggagcaaaagctggttgccatccagaatttgcagggcagagacaggacaaagaaatgtcattccaaagtggtcatgtaaaagattcttgctctcctggagtcccgactctgaatctgaggctatagctgggcttcagggggccagggtcacttaagactacatttaaaaatctatgcattttacagagaatttttagggcagtgaattcattctatatgatattaccaatggtgggtacatgttattatacacttgtcaagacccatagaatacacaacaccaagattgagccctaatgtaaactatagtccttcgctgataaagatgtgtcagcataggttcatcgattgtaaaaaaatgtgccactctggtgctggttgttgaaagtaaaggaggctgtgcatgtgtgtggggggtgggggagaagacgtatatggaggctctccatacattttgttcaattttatagtgaacataaaatttctcctaaacatttattaatttagaaaaatatctgtattttgtgtatgtctttcctagagagaggtttataatttttgttgaagctcaaaaatgctgcacaatcctaaaattgttttaagaaaatgaagcaaacccttcttttctggagaatctaaatatacctgcttatagcatctgattatataattggcaaagttgaggacaggaaatgataccctaggagactgacatatcttaatgtagtcattgtgttaaaagtttcaacattatgaataagtctaaaatattttttgaccttcccctagccctattctcctctacttcactgtttcaatgttaatacatatcaaaacactttaatcttgtttaaccacttcctaatagttgatactatagagcacagttcatttagccattccactgttgatggttttttaggtggtttgccctctttctgcattagaggcaatgctacaatgaacatcctggtgcataccagcaaagatttctccaggaaagatacctaggaattaaaattgcactttattttaagatacactgctaaagagccctccaaaaagactaaaacctatgcccccactagcaatatgtgagaatgcatattttcatacactttgaatattatcaaagttaaaattttttgataatctcataggtgaaaatggtatttagttatagtaatatccattttcctaattattattagtttcagatattttctgtgtttactggccacttgtgtttccactttggtgaatttcctttttgtatcctttgccaatttctctcttgggttgtttatcctttctgtttttatttataggaatcgtttatatattgtttgtactaatatttttggtgttatttatgttgtaaatatttttatccatttttatatatttagctttgtttgtgatgccttaacctctgtcttacatttcaacgttctcaaatgtattcttttcctatttacttcttatttaataaagtccttctcaatccccaaatccataaagatcataaatatattttctcccaataattttataattttcagtctttaatccatctgagatgtattttccaagaatgattcataaagatgtctttatttttaccctcaaagcataggcaattttcttgccacaatttcttgaataggtcatccttcttccactgatttgagctgagtccactagctacagcatagacaactatttagggttgctcagaacacagcatgctattttcccttcctatagccatccctgttgcgtgtcattttcctagcctaatgcctattccttcaagactaagttcaagaatcaaccctccacgctcagaaagatttccctcattctcctcactatacccttgtttaaaactcatcaattacttccatttagaagaaaatccaaactccttaccatggccaacaggccatacaagagctgcctactctcagacctcatttcctatagcccctccttggctcactcatttccagcctcactgggcttgtgttgttcttccaacactccaagcccaggccctttgcttttgctgatcactctgcctgaacttattttccctttgtatgacttactcattcttgtccttcacatctcagttcgaatgtccacttttcagagagctcttctctgattgccctctccaaaactgtgttcaactacaacactctatacttctcttttactttcttattatcctcatcagaaatcctattatttgttgacttgtgtattattcacttatccctctagaatgtaagctctttgtcttaccactgtatttctaaaacctagaccgaaacttggtatgtagtagagaattaatgaatattggatgaatgaatgtccctgcttgtgctcctgatggcacctgtgcttagctctgttgtagcaatcctcacactactaccattgggtttttcttgcctgacttttccactaagctttctgaaaaatcattattttttactatgtctagtgtctgtcaataaatgtgcactgacaaaataaatgagtgaatgaatgggaaattgatgttgagatgccgtttttaaagagtaagtaccttatcacacatagctaaagagaccaactgacacatccaccgtactagtgggaaatcttagatctataagtttagaaacatttctatcttccaagttaccacaggagacagtgttactgattgtttcatgattataaacaggacccccatcttcccacctcctatgggaattttcttattgttcttccagtttccactaaccagtctcctcactgcccttctagcctcagatcatcccccaatcccaaagcccaggccatatatgttagcggtttttttagacagcatctcacttccaggtactgatttctataccagtcatttatgtctttgtaacaaccatcccaaagcttagtggcataaaacaggaatgatccattaattctcatagttctgtggggcggctgagcagcttctctgctggttatgcctgggttcactcatgttgctcattcagatgtgagttcaactggaatgaaaggactgagatggcctcactcatgtctggggtcttgatgtggccgtcagctgggatagttggaagagctggacttctttctccatgagatttttaaatctgagatatctgcaaacagtatggcaatctcagggcagcattctttcttagatatggaaaacagaagctacaaggtctcttaaagcctggcttagaagtccccaacctcacttccaccacattctgttggtcaacgaatttattagaccagctcaggtccaagggctagcgaaacagactttgtgcattgatgagaggtgtggcaaactcacattgtaagagcgtgtggaaaggaagcaattgtggtggccatctttgcaaacaatttccatgagtaagaggcataatatttcaaagatccaattaagtatttgaaaaaaaaaatgacaagttagtcacggagaaagcattcaacaaatagcttcttgaccattttgactaatgtacataatgcgaaaaaagaaaaaacaaactttcctgattatgaagagtgaacattaagaagaccaaacaaccacaacaacaaaactattcctggtagttctgatggaagagaattaacaacgggaaattcgcgagattaattaaaactatttccggcccagcatggtggctcactcctgtaatcccagcactttgggaggctgaggtgggcagattgcttgagctcaggagttctagaccagcctgggcaacatggtgaaatcctgtctctacaaaaaattaaaaaaattagctggggctgggcacggtggctcatgcctgaatcccagcactttgggaggccgaagctggcagatcatgaggtcaggagatcgagaccatcctggctaacacggtgaaaccccatctctactaaaaatacaaaaaattagctgggcatggtggcgggtgcctgtagtcccagctactcgggaggctgaggcaggagaatggtgtgaacccaggaggcggagcttgcagtgagccgagatggcaccactgcactccagcctgggtgacagagcgagactccatctcaaaaaaataaaaataaaaataaataaataaataaataaaattagctgggcaagtggtgcatgcctgtagtcccagctacttgggaggctgaggtgtgaggattgcttgagcctgggaggtcaagactgcagcgagctaagatcgcaccactgcattccagcccaggtgaaagagagagaccctgtctcaaaacaaacaaacaaacaacaaaaaccctgaaacaaaacaaaacaatttcctggggtggtcaactcatgtataaaatggttcccatggggagactggaaagcctatgcttaagagatttccaataaaaatggttaccattcactaattagtctacattgtggggaagcagacttagttgttagatttctttatgtgacaaaaaaaaaatccttcttcggctcttgtgtgtattgtgttgtatgcctctattcactaatttctgtcctatggcctaagcaagactgattctaaaggtggttatctagtaaggtatattattcattcactcatttatgtattagttactttatttattcatgcaaccatttgttcatttactcaattaacaagaatttattgtgcatctaagatgtacctggctggcattgtgcaaggcattggagatccaatgtaatctctcctagagctgctggtttaatgggagacacagaaaaccaaatccacaaaaacaaaggttgaattacaatggtaacaccactgcaaagaagaagtacccagggctatgaacgtctcctggagtttgtgctaatcaaggagttgagaagcagggctaggcctagagctaggcaagtgaggcactgagggtgcaaaatttaagaagacattcacttccaggttcctggtcctggaagcctcaactccaggtgcttcttctacatctagttggaaataaaggtcagctgttgtttaggcaccattgtgtaagctccagagagcagagacgctttgaaagctgtggatatctagttgatgcaggtattttattatttatttatttatttgagacagagtgtcactctgtcacaagactggagtgtagtggcgcaatctcggctcactgcaacctctgcttcctgggttcaagcaattcttctgcctcagcctcccaagtagctgggactacaggcgtgtgccaccgtgcccagctaatttttgtatttttagtagagatggagtttcaccatgttggccaggctggtctcaaatccctgacctcaggtgatccacccacctcagcctcccaaagtgctgggattacaggcatgagccactgtgcctggcctgtcatagttcttgacaaacaagtcatatttcttgctgctaatgggcacaaacaaaactgaggttgattagtttgaatatcagtataagttgatcatagatatgatccagagaatgctattattaaaaatttaattaaaatgttaatttaaatattaaattttattttaatctatcactaaaaatctatgtagtggttactaagatagtaataaaaattgtttggttcttatagagcactgtcttcagaatgatgtggtccaatggtcatattggctcgcagccatccttgttggccatatgttgtccttgacgtgtctctggattttcggaagtatctatttattctaaatctgtatttctgtcctggaaagaacttcagtttgagtgctgcttgaagaccaaatacttggaaaaataaaacgttttttcttttcctagagctcttttctctttttccttaagaatatatttccaggtcaggcgcggtggctcacgcctgtaatcccagcactttgggaggccaaggcgggtggatcacttgaggtcaggagtttgagaccagtctggccaacatggtgaaaccctgtctctactgaaaatacaaaaattagctgggtgtggtggtgcatgcctgtaatcccaactactcgggaggctgaggcaggagaatcacttgaacccgggagatgaagattgcagtgaactgaggtcgtgccactgcactccgacctgggcaacagagcaagactctgtctcagaaaaaaaaaaaaaaaaaaaagaatgtatttccagcctttgggcagaatctaaggcttcctctgagcataaaatgatgatggttagaaaaccttcatgttttttcctgccctttaaaaatggattacatagatatccaacaaagtgtatactttctatcaacaactgagttcatttgagacaatgtcaccaaggatgatgtcttgatatgtagagttcatagtgaactagtgcatgtaatcggtttttatcttcatcctccaagcactaagattcctctaaatcagagtcaaagttatttaattgcagcagtgtctttccaaggtctccgattgcaaatggtttatactaagtcagaggagctccatacgccatgaacttcccatgacacacggtatctaaataagtaaatattgataaccagaaagtgggagtccaagctaccagtaactatgtgtcttatcacaataaaaacaaacagtgcataccatttctgaaataattcctgggtccttaaatgaagacttaggttacagcattttagaaataagcaaaaagtaaaataaacattttgtccctcctttcaccaatacccaaggtttaaactttgtatcatggggctgctgcttctccttcctcctcctttttgtatgctgtacacaagttccttccttcccatctctactgacgccacgctgctatgcactctggtcaccacacaacaacttcctgaatgtttctccttcttttactgcttcccctccccagcccaccttctcactagagtaatcatatctactgattttattgtgccactcaaaatttccagtagttccccattgaccacagttaggttccccaaacattttatggggaggaattactttttcctcaaagctttaagaatggtgtgtagcaagggcaaggatgtgtgagaaagagagaagccctgtatgaacttgtgtatttttacataggaagctttccatatataatttcattcaatctttttcattgtgaaatattttcaacatgcaacaaaatagagtaatataatcaacttccttgtatttattgctcaacttagaaggagagcattacaggtattatagaaactccctatgtacctgcccagtcacattctgcagctctattctgaatatggggctcattactttcattcatgtctttacagttaaggcaaggatcacaagctttttctacaaaggatagactgaatattttagactttgcagaccatatggactgtattgcaaccacagtacttaactctgtactgtggctcagaaaggagccatagagagcaagtaaacaaaagggcaaatctggtccttggcaggctgggttgggtctgagagtcatagtttgctgatctctgcagtagagtaacagtaataatatgtagcactgctttgcatatctttatatcaaactgtatgtattattctgcaacctgattcttttgctcaatatgatgtttccccatttattcatatgaatacatctagttctagttcattttattttattttattttttaattttttttgagatggagtgctctgttgcacaggctggagtacagtggtgcgatctcggctcactgcaacctccacttcctgggttcaagtgattctcctgcctcagcctcccgagtagctgggattacaggcatgtgtcaccacccccggctaattttttgtatttgtagtagagaagggatttcaccatgttggccaggctggtctcgaactcctgacctcagctgatctgcccacctcggcctcccaaagtgctgggattacaggtgtgagccactatgcccagccgctagttcattttatagtcatttattttagttcagattataattattttaattgctgtatagtattcacctgtgaatgtgcaatttatttattgtatccattctctttttgatggacattatgctgtttccaatttcttaccattggaaacaatgtggtgaactttttttgtacatgtcactgtatacatatatttgaaaacctatgaaagattcactttttaagctttacggcaaccctattatttcgatttaaatccccaatcaggggagtgtctgggtggtagtgtcaggaggaggtgctgagtgagtagttccaggtcatgcgtgaagctacggaatgtcagaactggcactccacccttaatctcctcatgtctcatccccagtgatatttatactagaccaaagctattatttctgcatatgtaaaacattgccagctatgcaaagggaatatgaaataaatataagcaatgattcctctcttctagaagtttacgatctggtgatatagtaaagacaaaacagatgaaatcaaagcattaattactatacaaggaggagggagagaaaaatgacaaggaagcatcaatcaacaaactggaacatataggggaaaaatctataagactgagaggtgcaagagcacatttgagcaaatggagacatgctgtgcccttgaaaggcaaaattaaatatcagaaatgagcagattttctccctaaatatctacgtttggcaccgtctcaaactcccaaagaaacttttctttttaagagtgtgataaaagatatgataattttatcacagaaaacaagcaagggtatcttaggaaatgttgaaagagaatgatcgataataagaaaggatgatattgatacaagaagtaactgcacgatcaatggaaaactaaagtcttaaagaagcactatgaaccaatgggtgagggaaaatgtactcaagaagcaattctgaaaaaaaaaaatccaccttgtaccataaactaaaaataagaagcaataaaagtaacctttaaaaaatcagatatatttaactacatgcaatgcaaaactttttaggtaaaggtaatttaaaggcatgtagtaaatataatagaatgctaatacattcaacgtatgaagaactctgccaagtcaataaaaaaaggaacacttcagtagaaaaatggcaaaggaagtaaacccaaaatggaaactgtcacacatagccaatatagatgtaaagaaatgttttttaaattactgctaatcagagtaatttaatacaacaagataggatttgtcacctagtaaattagaaaaaattgttcaaagtgagagtgggtgatgctaataaaggtatgatgagaaaagcagtcttactgctggtgggagtataaatggaaaaaaatgatagaacacaatttgacattttttatgctttgctgtattgcctcaattttctgcaatgacccttttattttaaaaatactttagcttaaaaataaattttaataacttttcagaaaaacagtggatgaaggaatgcttaaagttggggttttattaagttaacaaactattaattgagactgattaggctaacagagggggcagctggctaatctatcctgcatccaccctatccctcttccaggacaggggtggggaatgggggagtcagggggaaggtagggaagtgatcatgttcaaatcagatctttttcttttctttacctgctctgattcttcttcttcttctttttttttttttttttttgagacgagtctcactctgttgcccaggctggagtgctggagtgctggagtgcagtggcgtgatctcgagttactgcaacctctgcctcccaggttcaaatgattctcctgcctcagcctcctgagtagcttggattacaggcacctgccaccacgcctggctaatttttatatttttagtaaagacggggtttcaccatgttgaccaggctggtctcaaactcctgacctcaagtgatccgcctgtctcagcctcccaaagtgttgggattacaggtgtgaaccactatgtctggcctttagctgcatttctaaggagatttgcttcctctacttcatgtgttctgccagctgttgaccatggctatcacctgacaatgttgttttcctttctttcttttctttttgagatggaatctcactctgtttcccaggttagtgcagtggtgcaattttgggtcactgcaacttctgcctcccgagttcaagtgattctcctgcctcagcctctcgagtagctgggattacaagcctgtgccaccatgcctggttaatttttgtatttttattagagatgagattcctcatgttggccaggctggtcttgaactcccgacctcaagtaatccgcccacctcagcctcccaaagtgctgggattacaggcgtgagccactgcatccggccataatgttgtttttctttctgatctggtgttctctcttccacaatagactgctttctctacttgtgccttttggcatggaaaatgagctgccccatttgtagagacagtctcatggacaaggcatagttttgagtaaatgggtactcataatagctagtcataaagtaaatcctgaaattttaaaaaaatgtttaaaatcttaaagtcattagaaattaaaaaaattcaaatttatatacatattttagtggcagaaaatatgataaaatgaccaataacagactctcacgtgtagacatatgctaccttaggataaaattctgccatgaagtggaatggaatgaaatgtaaacttgaggaagaacaggaatgattaaaaagtttccagctgttaaagaataacttcatctatttcttaaaaggataagggagggtaaaaagttgctgtgatatttagatttaatcgaattatttaaaagtaatgcaacaacatgtaaaaatgtcaatttttataatacatcagaaattatattacttgcaactattttattttttagtgaaagacattagatgtcaacccaaaaagtgtgttgaaggagcatattgtttttcaagggtctttcaaaggttaaaattctcaacctataacatgactccttttatggaagggaggatttgaaggaaaaaagactatagagctaaagtcaagggtctcctgggagttcttcttttgcagttccttccccaaaatgaaagtgaagagtattagagaaagaagagcaccaaagtaaccgtaattagacaaataatgtatatggaaactcttggcaaataggctaaagttgctaatcccagtaagaagctgttaagaggtaaagaaaatctgactattatgagatgtatttaattaagtgggtttatatccccaaggtaatctttacatttattcatagtttacctctaacactactttgattgtttgaatcccttctgttctttgtttcaggcagggattaacatactttttgtgtaaaaggctagatagtaaatatttttgggtttctgaaccgtgcagtcttgtgttgcaactactgtactcaactctgctactgcagggagaaaagagccatagatattccataaacaagtggctgtggctgagtaccattaaactatttataggcactgaatatgaatttcatataatttccatgtgtcataaaatattcttcttttgttttttttaaccatctgaaaatgtaaaaccattctaagctcacaggctacacaaaaacaggcagccgaccggatttggcctgcaggcaatagtttaccaactctgtttttagatacagtatttgaaggcccttttatactgaagagtgagaacaatattctggaaggatacacaaagaattagcaattgtaattgtatttaggtaaggaaaatgggtgtctaagctgggaagactttttttcagtatactgtttgaattgtttaccatgtgcttgtgttactatttcaaaaatttagtttctttttttttaaagcccattcgggaattgtaaacccaatgaatctgacttgagtggaccctgctaactatctggattctagagagttctgctgttagctaatcaggggcattcacatggtaggtctccaatcagggataataacttaaatgatgcagaattaggggaactggacttttcatttgggagagcaagtgataaattatgtcctaagcttttgtgccaatagggcttataacatttctccaggaagagcaagtcaaatgtcatagaatttggcagaactaagcaagaaaaacaataaatgcagataatttaatagagccaacatttcttgagggctgactgtatgccaggcccttaatttgaaggtgccaagtttatatgaatgtattgaagaaaatatatcacaggaatccaaaatgaagatgagtgtgcctggaaaatattaaaaaactgtaatgtgcagtggaagtacgggggagcttgctgaacatggctcaaggttaaaaaagacagatgtgagacaaggagagcacagagggaaacctgaagtcagagtcacagagctgtaatatcctatttttaaagaccagaggaaatgggccttaagttacagagtataagcttgggttgaatattaggaaaactttctgaccgttcacattgtgggttcctggaaaatattattatgggaaattgtggaatttcctattcccaagataggagaaactctagaacaataattgcctaaattttgatggggagtggggtatttaagcccatttattatacaatatacagacacatatacatatttagtatcatgattcatatatgtattcatatatacacattatatatatccttatacaattgatatgtacatgctgaaatttgaatttccctagtcctcaactagcttatgagtatgaatgaggtcctgttaataacaacaactcaacatttttcttttgagactttagctctgtcgtccaggctggaatgcagtggcatgatcagagttcactgcagcctcgacctcccaggctcaagtgatcctcctgcttcaacttcccaagtagcttggctgggactacaggtgtgcatcaccatgcccagctaatttttaaatttttattagaggtgagttttgtcatgttgcccaggctggtctcgaactcttgggcttgagtgattctcctgccttggccttccaaagtgatgggattacaggcagtagccactgtgcctagccagaaactcaacttttactggcttactcttcaggacctcccgctcctatcagagcctccctccccgacaacaccccagttatttcaggagtgccttggggtctcttcatgtttataactaagtctgctctggctgttccttccactccattttgtgtccatggggcagagcagtgcccaaccagtagtcatgattcctctgctgggcacctctgctgcccagccctcttgggttcggagttccactgtgatatatggcatagttgtttgaggatgagggtgaggttgaagtgagttctctctctcttctgcttgttgcattggacggatctgccttatacctcaatgtttccagacttcatttttatttacaacccttttcttctcacctctgggtggtaggaaggtctcctgaatctagtatgggttggtcaaacacagctacactgaaaattacatatgtctctaatggctaaggctttcctttggggtgaagttcatggtccctagctctctatgagtttagaatggattttctcccaccaagccgcttatattaatggatagtagagtttggcagtagggcttggtggaatttgatgggctatgccgtgggtttaccagatggacccagatatgcctggaacccacagtggacacagtttgtgtctcttctcagaagactctccctcattcttgcttcttcatgtggttcttctctgttgtcttcccatcaatgcagattgctctagtatcgcccatctttaaaaattgcccttgaaactacatcctccctccgctacttctctatctcttgactctctatctcttcacatccaaacctctctattacagcatcctgttatttgccttcataaacagctttcatgacaatatataattatctatgtatttgggtgattatttaatatttattcctaattaagcttgatatcatggatcatgaatgtttattttccttttgccattttatcttcaaatatctagcacagagtttagtgcagaatatgtgctcactgaatatttgttgcaagcattgaataaatgaataaatgaaggaaacaggtttctggtggacgactttcccagcagccaagtgcacctgaaactcacttctgtttgagctaggacatttggtgagtgagagagaaagagagatacgaataatggggaaatcctaatgaaatacatacttatccaaaaaacccactatatcctcttcctgggcagcaaatatagacagctatttatttgtaaataaagtcataccttggtggagacagaaaaaaaaggtttgaaaatcatcctcagaaaacagcttgggaaaagagattctgacagcacacattatcacttttcattatttaacctttcaaattacttctttagggaggtagaagacatcgtagaaggagtgaaagaagaaaagaagacttagaaacatagctcaaagtgaacactgcttctcttagtttcctggatttcttctggacatttcctcaagatgaaacttcagacactttggtgagatttaccattatttttcttcttactatatctttttaaaaagccccggatcaatacatgaccaaggtagatcatgacagtgaaaatgaaagcccctgaaatttcctctaaaaggcagatacaaggaatatctctgattttctgatctgctgacataatgcctaaatagtcaaaaaaaattccagtaggaagtggctttaaatcactattaatgtttataaaaacctattcaactttagaataaagtttaagataataaatcatggattcatctcattttaaatcaaggccttttatatttgtttttttttctaataaagacatagtcaaaatgtcatcatatcttgcccaaatctcccaagggctgaaatttgaatgaaaacatacggtgtttttttcagataaattagtatcttttatgcaagcacgtatcttgggcatttttaggtccaaatgaggtataaaaatgataaatattgagaaaagatacatacagaaaggctatagtaaaatgcattcaaagggagccatttgtactttcgtaaactatctcgctgtctccttccccagctctcctaaccaacccttcccgcattcccacagtcacaaactatttattttcctttcaggagttttttttgaagaccaccataaagaaagtgcatttcaattgaaaaatttggatgggatcaaaaatgaatctcattgaacattcccatttacctaccacagatgaattttctttttctgaaaatttatttggtaagttgtcaagttcatttgaatatcaataagaacaaactacgatttggaaatacatgaggaaatgcctagatgatgagtccagcccagggtcaagaacatgtttttgttccttccaagtactcaatcaatgttagctactctgcaaggttagaggtagatcggaccttggattcatgggacttaatggtcttcatttttatagatgaggactgcaaaagctttgtgaattgctcaaggccgcgaggctagataattaacagagcagggagtagaaagcgattcctcctctaaggctaattccaatattattatagcaggtactaaactatgaaatcatgattcttatggcttaatatgacacctattaaaggctgagtttacttaggttatagctgggcagatttccttttgcagttcctccggtgctgggggatctatggcacagtgtcaggattagtcatttaagcaggattgaggacaaattgtactaagcagttttcagtagatctgtaactagatgataccataaaatgatatattgctccactttatgcatttatgaaaaacatctcattataaagagtttcaactgcaaacattaacaaagatttaaccaaggcaatattttgggtgggacagggagcctttctgccagtgttaaaataattcccttctgcataatagccctgctggcagcctgggatgctcccagttttcaccctccgttaatatatgggccatgatataccataatagtgaaaatgcaaacactagaagttcctcaaagttcaatgtatgaaggcatgaccgcttatttggttgctgatattcctaggacctgttaattaataatttgttctgttacctattagtcattagcactttagtgtgtaatagttgattaggccatttccaaaaaggggtcattatttgtaataattatttacatgtgtacctgcctccatacagtacaaatgcatttaagggcagtgaccatatttcattaatattttattatccagtgcatatttagtaggcacttgataaataagagtccagtaataaataatagaagggaaaagaaaaagaggtttatggaaaaaacagatgttgatccgtaactcttagagagaccaaaggcggcagtaattatttattaaatgccagttctcccaagtacttgctgcatcttatttcttccagttggcttatcttcatcctgtagatgcagtcaagggcagtgggaggccctgcctccatgtctagccacttgaccatttgcttctggcctgcctgcccttccgtggttcctcagaacagagtcaatgtatagacatcttaatgattttttcttctagcaatcagaactcacagaataattaggactattggcacataccacagataaagaaaaattgcactcaagattttttttcaaacagaaacttccatttcctgctgtaaaattttatgattgtaggttgagatctctgagcttaggcttcatcattactaaaccaatctattcagctccaatttgcatacagagagaaaattgtagggttttccttacaagctagcccaattttcagccagcacagaagatttcagggtgatttcagcagccataaggtgaaaaagatgccagtaaattcagaaaaagccacgaagatgccgtcaggttagaagcatctaaagatgattgctaaggaagcactgtgccttctgcttttatggtgtggttctctcctctctctcttttgctggaccacattcttattccatttcctaacactgcatttaaggtttctgagaatatatagcacaagctgcatgagctgcaatgcagagctgtaattctttgctggagcagtttcctcaactctttatctggtcccctcttctggtaaactaatctgaccatgtgtgaccattaggactccttttccttttctccactaagctgtagagccacgtctaagcattattttcaaatctctttcccctaggccctcagtctcacttcacttaacacatctgagctaggctgggcatagtggctcacacctgtaattccagcactttgggaggctgagggaggtggatcacgaggtcaggagatcaagatcatcctggccaacatggttaaaccctgtctctactaaaaatacaaaaattagcttggtgtggtggtgcatgcctataatcccagctactcaagagaactgaggcaggagaatcgcttgaaccagggcagaggttgcagtgagtcgagatcgcgccactgcactccagcctggtgacagagtgaggctccaactcaagaaaaacaaacaaaaaaaaaacatacctgagctaaaggtatgccaaaggggaggacgaagaaaattttgattcctttattcctcttcctcatcttcttgtgtgtcatgatgacattgatggcttctatggccccttcatgtgcgtagggtggaaggcaccagggaaaagactggcccatgaatgagtagcccacaggcctaactcagtactcctgagtctaagctacgccaggggttcagaagggttaatccatgggttcaactgcccagaaagctggactcttttccagtggttaactgtgtattgaaaacagcagtcatgttgttataataaaggcaaacaaggttaatggaatagtctatggatagctgtcacttcttctcttcaaatatcggacactgacaatacgctgggccttggaataaagcagagaataggacaggcaagatcctagtagaaagcaaactcacaataaacttgtaagtaaatcaataaacaaaataatattatttttataccttatttggacctacagatgcccaaggtagtgatacatgctatgaaggcaacaaaatagggtgatgccctatagcctggagtgatgggctgctctaagtggtatagtcaggaaaggcccctgaggagtccacaattgagcacagcctgaaagacaagaagccagagagaacattccgggaggagacaataacaagtgcaacggcccaaagtctggaatggactcagaaggaccttgtcttctactcatttttatttaggggtggacaactgctttcccattaaccagctgtgcagccttgaacagctcactcaagttcagttggtaaaagtagattatcaggctgggaattctaggacatttactcaaattaaacatttgagtccacaaaaatgctactgttgtccacgtcaggaagtggtgacttaatggtactcacttggtacacggctcaacaagtccttttaaggtggtcctgggcatggtccccttcactgcaggttattataaaggtcataattcaatgacaactttaaggcatttagaaggtgacctgaagacaaatacagacaagcactcactactgggtcctggagacaataatgaccttttcagtgataacttgcagcttcttctagaggtgaccatgggccccttactcttcaaaggctttgcttaaggtgaaggggaaatttcttcacccctgtaatgtttattccaaaaagcagagcccaaatgaggacttgtgtgaaggcagtttatgtgagacatgatgagggagtggaggcgagggagtgggcgatgcaacagggaaggagggaaaaccaaagaggtcagttgtcaagatccctggtgtgggggaggccagcttgatgccactgggagcagcacagagaactgtcagcagaggggtcagggactggagcatatattaatattaactgcccctcggctcccgttggttgagcgtcaccccagggggcattaattccccgcacttctggactgtttttgagctcaggccaagctgtctcctgtgggattagagaagttctgggcagaaagcataggaacgtgcggcatgctcttgaaatgacaggtggtcagcctgcagtcatcatctgagctcgtgtatgatcagctgccacaggtatggccgagatcagagacgggctgaagggatgtgacagctccaccagaaaaagaagaaaagaaacttggacagaatggaatcagagagatgggggttggaatcacctccctgaagtcctttaatttattctgttgccagacatccctgacaaatccagacggaaatctagcccgtcggtaactgaatccacgtagaggcctgggggtggaaggacacagttaccacacagagattcgtctcctttcctctgggagatcctgcaagccaggaagcttggtcaaagattaatttagtggattaaaaaaggcgtctctgatgaatgaataaggcaaagttttatgcaattagtgcataataaaaagtaataatgacaaagtccacagctccccaccatctgacatagtgaataaaacaggagatggtatattaactaaagtctatatttacttttagcaaattatgtttttaaaactcaaaaattacaaaaatttagagactaaagagacaaagcattccaacaataagagaagaagcaagagaaaatacagtcttatcctcccacacccaatgttcctgggcacagtgattcctgattcacttagcacagtgacactgggaatggaaataaggaataaaatagcgggaaatgaaatctcagaggcaagtgagattctctgaacttcagtttttacccacataaaatgaggataataatgtcacacttcacaggttgttgggaggaaggaatgggctgtgtgggaaagcgctctgtaagctgcaaggcatcctaaaatgttacaattaatccagagtttgaaatgtagttgtcatattttaaattgttgaaatgataaacaccattccactcattaaaagaaggaagtactgtttatctcaacattgtggagtgcaaagaactttcaaggggccagagagaatcaacaatacgtaaataaggctgggcgcgggggctcatgcctgtaatcccagcacattggaaggccaaggcaggcggatcaccagaggtcaggagtttgagaccagactggctaacgtggtgaaacctcgtctctactaaatatacaaaattagctgggcgtggtggcacgtgcctgtaatcccagctactcgggaggctgaggcaggagaatcgcttgaacccaggaggcggaggttacaatgagatgggcgacagagtgagcctcagtctccaaaaaaaaaaccaaacaaacaaaacaagaaaaaaacaccaaaaaacaaaaacaaacaatatgtaaataaatttctggttacctcacctttgcattattacattgctaacaacagctttggaatccacgtcttgtattgcttttattattgtatctaacagtctttccggagccccattctgattgaggcctagcaagtgtcaggaggtagatcctatacaatcccattcacttatctttcatttcctttggctatttctcattgccttatgcttcacttagctgtgtatgcccattttcttagggtgcgctttatttctttatttttatttttatagagaaagggccttgctctgtcacccaggctggagtgcagtggcacaatcagagctcactgcagccttgaactactgggcccaagcaatcctccctcctcagcctcttcatgctttatttgtatcagaatacactcactttgaaatctgcttcttccctatgacttatgcttaaattgaacgaatcttccagatgttacagagtcagtcagatgttttaaaatgcaattaaaggttttgagatgcagtttgtagaatatttctgacatttgatttcaggtatttttccatctcactgagttcaactcaagtgaacgtagttctgacttcttgggtgaattaaagttcaaagtttccaaaagatagagagataccattgtctcagataaaatgaagctttgtttcagcatacttgaaatattttgtcactgctatttcttctccacagctcttccatagctgtaagcagtctctaaggcatttaatttactgttactttggttttttctttctcaaggaatctcagttctggttctcttgatagtggagtaaagaaatgggagaaggaaagaaatattgaatgagcctcttcttattacaaaatagattactgattctttcagcaggggcttgcagagtttggaaaaggtgtgcaatgagtcagagagttggccagctggtaggcgattccactgcagtctaggccttagctctcaaccctgcaggctaagaaacagattcttagggatgccaagttaaaaaagattgactataaaatcatattgcaaatatattaacttacaacaataaaaataattgtaatgataacagctagtatttcttgagtgctttatagaaattaatgtgtcagatatcaagctaagtacattttagatttgttaacagatttcctgggttggttccaatctctgccatctactaccctgtggtcttggacaaattccttaactttgcacaagttacttgccttatttaaataaggtgataagaagaatgcctggcacatcacaagtactctatttgccactaaaattcactctcacaacacacctataaggtaggtaccattactgttccccttttatggtgagaaaaggaatatttagtgatgttaaataatctgctaaacattccataattagtaagtaggcaactgaaatataatcaggacaaggaaacaaaatccaatgtttaagtctccaggcttagagaatacttctattaaccttgtcaactgggaaggtctttcaataagattatctacctttaaagtctgctgaccatgtctgttctgaaggatagttctcagaaaaaaaacattgccaacatttactctaggacctcccttttttcatgccttcatagctgatgccccactcagcgtgagaggtacaacattcacagtgctcccaaatactctgccgaacagtgccatcagatagaactttctgtgacgaaggaaatgttctagctctacttcgtccaatacagtagccactattcgcatgtggttattgaacacttaaaatgtgactggtgtgactgaggaactgactctaatttaatttaaatcaatttaatttaaatagcctgatatggttgggctctgtgtccccacccaaatctcatctcaaattataatccccacatgttgagggagagacttggtgacaggtgattggatcatgggggtggtttccccatgctgttctcatgatagtgagtgagttctcatgagatcttgttgtttgataagtatctggtgcttctcccttcctactctctctcctgctgccttttgaggacatgctttgctgccctttcaccttctaccacgattataagtttcctgagacttccccagccatgcagaactgtgagtcaattaaaccttttttcttcataaattgcccagtcttggatagttcttcatagcagtgtgaaaagagactaataaatagccatacatagctagtggctactgttttagacagcagagatattcaggaaaaaatatttttttagggaaaaaataatatgagacagttgatcatctctaagagaaattcaaagggatccaatcagtcttgttatgagaacattctgtgtgaatttcactcagcaacaagggtttcctgggtcagctaaataatcctgctcatttcttatctagtatagatgtttctgagggcaaccgacaggtccatttattttggccagtgaaaaacttagtggagaattcttgaaatggaaaattctgaatcattcgtctagcttcatatcctttgggtagctttttcacctatgaccctctcagggaaaggatagctctgggattgtgaggaagggagaacgaggtcagaagtaaactgaggactgaaaatggctttgcagatggtgaccccgatcaagcaattcaaactgaaatatacccatagaccaccactcttttcctctttcttggcaattagggcaagtgtaccttagtttttccaccacgggattttgagtcagaagacctgggttaaagtcccagcttcattccttactaatgggatgactatagacaaatcactgaaactcactgagtttaaaaataggcttaaagatagtggaagttagaaataatacctccctccaagggtgcaagtgaagatctgatgagataatgcatatggaaccgctttggaaacttgtgaaggctatagaaatgtcttagcaatgattattccacttgtatagctcacctttgcctttcaaaattgctttcatatttactatctcattttatcttcagaacaggcctaaatagggcatgaattattatctatgttttaccatctattgatgtggacaaatggggcccacagaagctgagagactcatctaaggttacacagtgcatctcgctacattatgcctgggctccaccctggatcaactgagtccccttctaaagccctcatttctaaaaaacaaccaatagacttaagcttgatgtacaaaagttatgctgaaggataaaatatagaattattcctattcaataagcaacccaaggtacaacatgagtccaaagctgagcaatcataacatcaatgtagtgatgatgggtagccacctgttgtgctaagcattttataaatactattttagttaataatcacgtataattctttgaggttgtatagttatcaaccccattttacaaccaaggaaataaaggcagaaaatggttcaggaatttgtccattgtccacagagctaataagtgccaagacagcctggatgtattagtttgctgggtctgctgtaacaaagtaacatagactgggtagcttaaaccacagaaattatcccatagttctggaggctggaagtccaaaatcaaggtgtcagcagggttagctcttcctgaaggctgtgggtggaggatgtgctccagggctctctccttggcccacagatggccatctccgtctcctctctgtgtgttcacatcaacttccctctctgtgtttctgtctctgtaaccaaatttccagtttttataaggatacaagtcatattggatcttcattttaatttgattttctctgtaatgaccctatcaacaattaaggtcacattctgaggtactggggtttaaggcttcaacatatatacatcctcatcttacaatggttcaacctactatgtttagactttacaatggtgtgaaatagacacttttagcatagttttcaataaattgcatgagatattcagttctttattacaaaaaaggctttgtgctagatgattttgtcttacatggtggtaggcatgtcttacatggtggtagggaagacagaatgagagccaagcaaaaggggaaaccccttataaaaccatcagatcttgtgagacttactcactaccacgagaacagtgtgggggaaaccaaccccatgattcaattatctcctacaggatccgtcccacaacacgtggggattatgggagctacaattcaagatgagatttgggttgggacacagccaaaccatatcaagcattatgctttaaattcttccattttaaatcataccattccattttaaatcataccattctgccaccttttgatggggacaaatgtcaggacccggagcatggcacttgacctccaagtccagttttagagccagtgaacagaaacccaccctctaaaagttcttaaactggaaaagtactcccccaaaatgtttatctaagagactggtttccagcttactaggcaatttggcattaagaactttcctcataaacatttacaaatattctgctccgtaatgaagttaatcagtaaaccacacaacctctgtcctctctcactccttacctagtctcattttcagtggctgtgaataagctaagaatggtaatgcagtttcaggggttagaaaatccaattcaaattagtcctcactgcagctgtacgccgtcaggatttttcatggaaatgatgagtatgaagcccgcgaaaggtaggacactgttcacaggtgctttcaggtcgagctcttgcaactggactgaggaaatctggggactttggttggagatgacagtaacagatgtctgtcaaagatagtggctcagtcagacccagaagactggaatgagagtttgggttggggtgatttttatagggttctaaacagacgaatatcttatggggatgaaatccaaggatgtttcccctaatattcttcatagactcttatgtcaaattatcactattcttccaaaccaaacattagacaattctaatattaatatcaatggacacttgaaaaaacattttaacagacattatttaatgcagtgctcctaaaatggcaagtctcagttcccaggggatcacaaaatttatttagtgtctcgtgaccagcattaaaaactggattagaatataatagaatagaaatattagtgtccctcaaggagtaaagacaagtggtatttcatgaaattttgtttcagttacatgtgtataagtatgtacgagggatatgagataaaatgtatctaaaaccgtaggttgtggtaaaaaaaaaaatgaaaagagtttgggaaacacgaattaatgaagtagtttcacagcaggtttctcccaatagtccatgaaaaatcagataagcacagagttgagctttaggcccaggctcttggttttctctgaattaaaacatcgattataattaaaacacagtataatgtaaatcatattttaatattttttaaaacagaaattcatcttttaaatttccagcaagaaaaaactcgagtcatttttataataatgataattgtgaacatgtttttggtcatagacttggtagcataccattttgtttaaatgcgatgtttaaaagtgaccgacactgtatttagaaatggaaatgagttggaaggccggggaagcaaattttctatttacttcaatttaaccaacatttaataaacatttactatgtgtcagccattgagttagatgccaggaatataaagaaaagaatatagtctaatattttccctcaaagagttcacagactaatcacaacaatcacaaaagtatacatgtgtatgtggtgtcaggcactatgcagtttccattctttgtcttagttcatctttattacagcctctcatgcaggcactacattctttcagctttgtaaaggaaggaacagaagcttaaagaagttccatgtctttcccaggttcatatacctaacaagttgtgggtgaaatgaatccagatttgtctgctcagagggcactcttaggtagtatctcataccatctcaagttcagcgtggaagataagcctgtaaacaaaagaaatgattgtatgtgcttccaataagtgccataatagaagtgtgtacagaggtaggagaggtgaattccacctgggggaactggggcagacctcccagagtaggtgaccagaagtaggtgatcagctgacaaggcagggagaggcactgacatcacaaaggcctgatgccaggaacagcaaacaactttgcagtaaagccctgccatttagtgaagaaaccatggattaagaaataaaggaaggcaaaaaaaaaaagtgacttttctaggcactgcaattcaacagacattcattaaacatttactatggtcagcattgtgccaggaatgaaaaactggatataaactggaccctttcttaggagcatcagaaactcactgtgagattatgggggagtgccattgtttttatgcaaacctgatttcccatttgggggtacagtggttctggtcccaaactccttagagctgcactggctaatatgccacatgtggctattcaactttaacttagaattaaataaaatttaacagtcagactctaagtatcactagccacattccaagggttcaatatccctatgtggttagtggctaccatattggtaggtacagaacccttctatcacctcagaaagctccctcagatggcactcctttagagaaggtgttgaaacctggagactgtctaaccagaagaattttactttcttttcagggcttctcagactcccctggagtccatccatgtgttctcatttaagaactcgtccctaaacttccatggagaaccgtcacaaaggaatcctaattctcatactctttgataggctaattccaaaataaagattcctaaatctaaattttaatatgtattttcccttttaaattgtatcaaaatagaaataaatttaccttttcagaaagcatactctaaattaaagtcgaactacctctactccctccacatcttattttctgccaatgttgtatttgtttacttgtttacttatttttgtcctaacccttgacatccccacttcccaaaacacacaaacaagagaaaggctgggccttcgtatgtgtcttttcactttcatatgttcagaccctaacacagtgactgctaaatagcaagtgtttataacacacacacacacacacacacacacacacacacacacacagagagagagagagaacatgagcatatgtttataaataataatttgtaatgaaagaactatcctaatacttatatcatcaagacagactgtgttaataattacttattaactatcaattaactatgattaaaatcaggattttgctaggttctttaggaaacatgtcttttaatgacactcaacttaccgaaactgcttctcagcaaccgtattttacactcagaactaccttctgagatagcaacagtcccatttttataggagagattgaaataggaaaagcttagccagttaagatctcatggtcagttaactgtggaagttgttctagtccaaccattttggaatatttggccatgctggttctttggttgtaaagttcctttgtaattacttctctatttgtggagatttaggagacacactatgaaatgctagaagtgaatgtgctttgagaatagaaggttttttttgttttttgagatggagtctcgctctgtcacccaggctggagtgcaatgacatgatcttggctcatcactgcaggctccacctcccaggttcaagtgattctcctgcctcagcctcccgagtggctgggttacacgcacctgccaccacgtccagctaatttttgtatctttagtagagacggggtttcaccatgttggtcaggctggtcttgaactccttacctcaggtgatccactcgcctttgcctcccaaagtgctgggattacaggcattagccactgcacttggccaagaatagaagtattatttaatattattgtgtacggttctcatatttttactgatgttctactgttttagcatgatattatctatatctttgtgaaagctttccattttgatctagattattccagagactgaaagacagggatattattatctgacttgacttgggactcctttgtatttcttgattatgaaaataattgttttgttgaaataatgcttaaagattttagaattgtcatatgaggagaaaaaaagtacacatctccttggatgctacagaatccagattctatcggtttttgatcttgggcaaattacttaaccttactagacctgtggcagagagaaattgggctaagggaggaaggggagttaagggaataagataggttagaggataaaatctaagtgtacgtgaaactaatgcttttaatactttttagtttttttcaattccattcactccagaaattttcatcgtatttggtgatgaaatagatcaggattttgcttctattttatcttttctttttgtgtaataattccatatttttctccttccattttgcggtcataagacaaggcaccatttctaaaatattttgtccatcagacatactcgtttttttgtttgtttattttattttgttttgtttttgtttttgttttttttgagacagagtcttgctctgtctccaggctggagtgcagtggcgcgatctcggctcactacaaccaccacatcccaggttcaagtgattctcctgcctcagcctcccaggtagctgggactacaggtgtgcaccaccaagcccagctaatttttttgtatttttagtagagacggggtttcaccatgttggctaggatggtctcaatcttttgaccttgtgaaccacctgcctcggcctcccaaagtgctgggattacaggcgtgagccactgcacctggcctatgctgtttttatatggataagtcacacagaaggaaaggaaattgatttttgtacagatactgtataccatgtgttctgtcaatcatttcctgggttaatgcagaaagcattattttcaacatgtaatatgtatattctgaaatttggcagtgtagaaaagccctaaattctaatgttcataaactattagtcatatacttatggagacttttagatataaagaagaactagaagattatctagggtggagtcttctctttacagatgaacagagggaggcccaggtagggtaagtaatggtttttaaatggcatgtaactagattcaggaacatgactgccagggacctagaaacctcttctgttgggaagacttcccaagagaagcaatacccacagggaatttagaggtaagtggacattagtgagatgaagccctggaaggggttggctgtgttgagaaccatttcaggctcaggaagcagcaggtgggagaagtcctgagtctggaagcggcaaggcacattcaagaaacagagatgtccgaacatgcaaaatggctggaaaagaaagcaagggtagagtcatgcagaagcttgcaggcccagttataggttatgtgcaagcggaggccgagaagggggtaacaaacacaagtaggaggatgcagagaggggctttgaagatcatgtttttaagtatcacacacctgaaattacccccagagagcagcaattcagtgcatgggctttgagattagactcctagagctcaagtctcatctacttaggtaggtaggagtaaagttgcttaactactatgtgcctcatggtactcatttgtaagtgggggttaataatgttacccacctcatagagttttgtgaggaataaatgagaacatacaagtgcctgctactacgaagaactctataaaagttttctgcaaaatgtggtaatagtaatcataataattatagtaatcgtttcaactatcttttgagcacagcaaagagcattgccaatttgaaatccccaaagccccaaaaaaccacgtttttctaaaagtttggcacacacttttttggtgacagaacctgacctgaatgaatgtgaaactatttatggtctttacttattgcacttgctgtgaatattcatacgtttccctgtggaaaatattgctgtatttgattctgggttctgttccagactgtgctgggagggatatataaatagcactgtattctgttctgaaatcctgaaaattctgacttctaaaacacatacgactgccagggtttcagataaggaactgtgaatctgtatcatctcactcaatcctcagactaactcttgatatcgatattatcatcccaaccttgctgccatgaaaaccaagatttatcaatagtttgaataatttgctcaaaatcccactgttcataagagatggaattggaattttggtctagaattgtctgacaacactttgaagagtcagacacatttgtaaactttcctatctcttatttatgtctattttttcagcatttgcataatttcaattttttattttctaaagagccatagttgatgtttccaggaaatagaagcattttcataacctgatgattttctattacctagaggttttctaaataagggactcctttaataatgatggtagtaagaataattgttattattcctattttaagtcagctataatttatcgagcacttctgtgtgccaaacatttagcaaagcacttggcacacattatctcatataatccttacatcaacccaatgaggtaggtgttattattctctgttttattagaagaagactgcaacttaaagacattaaggaattgccagctgcacacagattgtaagtaacagagcaggaatttgaatccagtagatagattgcaggcactgtattcttttttttaaagctcctcctttgttttataatgattaaaataacacatacatatacacatggcaaaaactacaaacagtaaaaaaaattatgcaatcttctatcccagaatataatgtaaaaatatcacctctcacagtcaccaccacctactttcttctgtatcatgcagaaatttgtctttgcacgtgggcacgtgcgcgcacacacacacacacacacacacacagagttggtgtttaataccgatgtgaatatacacattggtctatagcttacctttttcatatagcaccatattgtagaaaatttccataacagcacatagaaatctaaataattgttttacatctacttaatagtgtatggatgtaacaaatttattgaagcagactcctatggatgaatatttagatcgtttccaatttatggctcttgcgaatgtgctgcaagtgaatatttttacaaaatactttttcatagaggttcaagcatatttctaaaataaattttcaagcagtggaaaatttatgctgggtgaaaaggacattgaagtttaaaaaactggaaaatattgacaaatttccccccaaaaatatttgtttccccaacagtgtgtattattaaactttttaaaccctcacacatttgaagatgaaaactgtaatgttttagtttcaatttaaatttaattattggcaaaggtgagcacatttttctgtttacaaaacacggttatatttctaacattgactattcctttcctttatccctttttccatagcttctcaaatattttcttattggttttcaggagctctttatacattaatgagatgagtctgtcctctatgttgcagatatttttctgaatttttaatttgtcatttaattttatatatatatatatatatatatatatactctaaagaagttgtaaacttttatgtagttaaatgtttcaatcttttcttagagcccacactcctaaccattacgccaaactgcctctctaatttccagaatgatgacattcattccagttttgttgtcacttttgttcaggtgttttaacagaacaagtggcaggtcctctgggacagaacctggaagtggaaccatactcgcaatacagcaatgttcagtttccccaagttcaaccacagatttcctcgtcatcctattattccaacctgggtttctacccccagcagcctgaagagtggtactctcctggaatatatgaactcaggcgtatgccagctgagactctctaccagggagaaactgaggtagcagagatgcctgtaacaaagaagccccgcatgggcgcgtcagcagggaggatcaaaggggatgagctgtgtgttgtttgtggagacagagcctctggataccactataatgcactgacctgtgaggggtgtaaaggtaagcatctttgattggcagttttctccttcaggttttactatattggttgttgaaatcccttgaactaattgcttcccttttcccaggcaacttcccattttctcctcctgtgcgcctacctcctcctacatcctcacctttgttgtgtagtcaaagatctgtaggaaaagactgttagagtatttagcttaatgtttaagactgttagagtatctagcttagagtgtttagctttcttccttttcacaacctcacacgtagctaaagggaacttatgattaaattgaattttttgtaggttttgtttgtttttgttgtttttttaaaaaagaaagaagaaagtgatgaacacatctcttttaaaattaagatctagaagaatacaactttattcaataaatatttaaaaatatttttcatgtactttagttaattgagaaagagagaaagaaagagccaagtaataatagcttatattacaaaaaaatattttaacttggcatggtggctcatgcctgtaatcccagcactttgggaggccgaggcaggcagatcacctgagatcaggagttcaagaccagcctggccaacacggtgaaatctcgtctctactaaaaatacaaaaattagctgggtgtggtggcaggtgcctgtaattccagctactcaggaggctgaggcaggagaatcgcttgaacctgggaggtggaggttgcagtgagccaagatcgcaccattgcactccagcctgggcaacaagagcgaaaatccatctcaaaaaataattttttttttttttatttagcctaggcatggtggctcatgcctgtagttccagcactttgggaggctgaggtgggtggatcgcttgagtccaggagttcgagactagatagagcaacatgggaaaaccccatctctacaaaaaatacaaaaattagtcaggtgtggtggagcacgcatgttgtcccagctacttgggaggcagaggtgggaggatcacctgagcccgggaggttgaggctgcagtgagccgtgatcatgccactgcactccagactgaatgacagagagagaccctgcctcaaaaaatatatattttatttagcagtaatacagttctgttatggatgctatagagaaatcataacaaaattgcaatccatttaagatggataaaatataataaatgaaatataaaaatgacaatgtaggccgggcatggtggctcacgcctgtaatcccagcactttgggagaccaagacgggtggatcatgaggtcaggagaatgagaccatctgactaacacggtgaaaccccgtctctactaaaaatacaaaaaaattagctgggcttggtggtgcatgcctgtagtcccagctactcaggaggctgaggcaggagaatggcgtgaacccgagaggcagaggttgcagtgagccgagatcacgccactgcactccagcctgggcaactgagcgagactccgtctccaaaaaaaaaaaaagacaatgtaaaatcccatgtgattactgtctcaactaaggcacagataatcgtggtatttattcattaaacaaatattttgggaacacctaccatgggtcaggcactctgctaacatctagaacattgaatactgaataaaaaccatctcttgagcagaatctttcggatggtgtgacacactggggttccctgatgttggtggttgccacagaaataaacagaggacccagtcacataagatcggctcaaggacatttcaaacctttgaaagttcaaatgatcagattgtgtaaagccacattagtcacttcttaaaaactgggtatgatattgttagaattttttttaaataaagaagcatttgtacaccaactttacaaactaaagcagatctataaagaaaacttaaaagatcccacttatggccttcagaatgtccttaacctttttgtggagagtcacgtctgaataggtaaatgaacttatacattcgttggaagcatagattaagtcttctctacctatattgctactcatagcacctagcacagtgcctggtacatagtaaatatggaatgtcttttgaatgacacaatgaaaaaccatgttcatcactggtacgtaattaatcagcctctactttgcaaaaacacattaaaatttttttttacaatacttaattctttcccatctccgaatgataaaaagtaaatattaccctcgattcctatatgaagtggcagatctttttgagctggcagagctgtggagatcgagatctgcttatgttaaagattttaaaatggtgtggaataaagcaggaaaacatttctaattggttagaaaaataaaataggccggacgctgtggttcacttatgtaagtcccagcactatgggaggccgaggtggggggatcacctaaggtcaggagttcaagaccagcctggccaacatggtgaaaccccatctctactaaaagtacaaaaattagctgggcatagtggcacgcacctgtagtcccagctacttgggagtctgagacaggagaattcctcgaatccagaaggtggaggttgcagtgagctgagattgtgccattgcactccatcctggatgacagagcgagactccgtcaaagacagaaaggaaggaaggaaggaaggaaggaaggaaggaaggaaggaaggaaggaaggaaggaaggaaggaaggaaaaaataaagtagtttccaaatgacaagccttgaactggaattaaaataaacaaaaataaaacttctacagttaggtttgagaaaccaactgctgatctacaggaaagaaaaagaacaaactttatagtagctctagtcaaaaagtggctggggctcttacactggagggcaaattaggaccaaaagatgaagcttataggatggcatcttttgaggcctaattcaagaattaattttttagcactaacatgaattgtcccaacaatgagattggctttttgccttaggtggtaacgaacttctcattattacaggaattcaaaaagaggttagataaacaggtttgagtacaggagatttgtatgttaggtgggacactgtattagctggcttctgaagtccttccttaaattctgtgaatctgtagtaccatatttataatattctaatctgcctgtttcatcttctaagcaagtttataaatttcataagttaaaaagtgactataattcatgtactccctcctgttgctatgaactgatgaaagggaaagctagaccatggtttttaaaccttgacactattgacattttaggctgaaaaactctgttgtggggggatgtcttgtacatactgtgggatatttagtagtagccctggcttctatccactagatcccagtagcaaccccccacttgtgacaaccaaaagtgtctacagacattgctaaatgtcctctggggttacaatcaccccagttgagaatcactgagagagactattcagtgaaaagtataatatagagcttctcaaacttgagctacacctggagatttcttgagggaagctataatatttcttgggtgcctctaatgttgacttaaattgcttttaatgaattacttatgctatcaagcaattatagcataagctatattatattataatagctatattatattgtgtatcatcttttatacactgaaaaatttctatacacaaaggaacaaacacaaatttacaaaattacatacaaacaaaactacaaaaccaataaaataatgaagtatattagattgtatggttttgttgcccaaaatgttaccaaactcaggttcttttgagtttggtatcactagaccatgtgtcatatgaggcctcaattctccactgcttttctctcttcgaagaattgattcaaccaaacctttgttcatccagagctccatttggccatccctgagctgggtacatctcaggcatatgaagtttgcctttgccattttgtcaaagctttttttttttttttttttttttgagacagagtcttgctctgttgcccaggctggagggcaatggcatgatctccactcactgcaacctctgcctcctgggttcaagtgattctcctgcctcagcctccccgagtagctgggcttacaggcgccctccactatgcccagctaatttttgtatttttagtagagatggagtttcaccatgttggccaggctggtctcaaatccctgacctcaggtgatccacccacctcagcctcccaaagtgctgggattacaggcatgagccactgtgcctggcctgtcatagttcttgacaaacaagtcatatttcttgctgctaatgggcacaaacaaaactgagggtgattagtttgaatatcagtataagatgatcatagatatgatccagagaatgctattattagttttttaaagactggcataaaataaaaatgtaaaaaataaatttaatatgtgtaaaggccttagaaaaaagtgtggcacatagtcaaaactcaatagatgtctattgttattattgttatggtcctagaattgatttacatatcgtgtaatggcaatgtgagtgttttctgcttatattgataaatattgatgctcaaatcatcgtgagttgtttaacaagatttatttgacatagattcagattacctaaagccacttcaacttgtctgtgtagaccagtgctactcaaagcatagtacctggaccagcagtatcagtatcactagagaatttatagaatgtggggttttaccccagacttactgaatcagaatttctgggaaaggggcccaagaatctgtgatttaaccagcactacatgctaaagtttgagaatactggcgtaaaaatcatatccaaaatcttcctaaggccactcatctggccaagcatcttggttttgtgttgtgagtgtgaaacccacaggatgggaaaagagaataggaggaatgctactctccatgaggtcatcaaaagcacaattcagtagaataaaatgtagacttgaaacctggactggaaagacacaaagcctaatctaagtcatgtttcctgctgggagagaaagaagcagaaaagaacacgcataatttattcggaaaatctgattcaaaagaaaaattccaatatacatacttttgaacctacaaatttcagtgctgatgacatgctaattctttttttttttctgaaacggattcttgctctgtcacccaggctggagtgcagtggcgcgatctcagctcacaaactccgcctcccgggttcacgccattctcctgcctcagcctcccgagtagctgggactacaggcacctgccaccacgcccggctaattttttgtatttttagtagagacagggtttcaccatgttagccagaatgatctccatctcctgacctcgtgatccgcccgcctcggcctcccaaagttctgggattacaggcgtgagccaccgtgcccggccgatgacatgctaattcttatggtaggcattttggaaacattctctctgatctttacagcaactatggaaagtaggaattattgtgtctattttaaaatgaggaataagcatatcatttccaaaacaagctaagatatagagatgccagtgctaatagcttgtgtgatgtgtttactatactttagtaatacacttattaattctcatatcttatgtccattttattttattttcttaaatttatgattgacataataattgtacatgtttatggggtacaacatgttttcatacatgtataattgtgtaatgatcaaatcagggtaattagcacatctaacagcttaatttatcatttcttcattatgagaatattaaaaaacctctcttctagttattttgaaatacacagtacattattattaactctagtcatgctgctatgcaatagaacatcagacatattccttctatctaactgtattcttggacccgttgactaatttcactgtccccttctccccccatcctcctcatcctctcataactaccattctactctctatttccatgagaacaacgttttagattctacatataagtgagatcatatggtatttgtctttctgtgcttggcttatttcatttcatgtaatatcctccgggctcatccatgttatcacaaatggcaggatttcattcttttttatggctgaatagtattccattatgtatacataccacattttcttgatccagtcatccattgatgaacgcttaggttgatcccctatcttggccattgtgaataatgctgcaataaacataggagtgcagatatctctttgacatactgatttcatttcctgtggagatataccctgtggtgggattcctggattatatagtagttacatttttaattttgtgaggaaacatcatactgttttccattatgactacacaaatttacactcccaccagcagtaagggttgacttttctctacatccttgccaaaacttgttatcttttgatttattgatagtcattctaaatggagtgaggtgatatctcattgtagttttgcattttcctgatgattagtggtgttgagtgccttatgcccattttatggaagtggaagctgaagcataagttgttaatctatttacccaagttttcatagctaataagagcttcaaaactatagcttataatctaactccagagcctgtatgattgaccactaggctatgatgccttttattggttgtccactaagtgattgttctgctcttcagttgtttgctcaagggtaatattgactaattcaatggcgagaggaagaaaacgaagcagtccgtttagctgttaaagaatcagtagtgtctaagccaagggaatgaatccctaaagtcactaaccttggatagcttacctccttagaagagaatttttctttctgtcttgtgaactgtgcttatgaccaagtgaaacttggtccacctgcgaagagttctggggcatggcagggtaaatagagtgagaccagtgggccaaggacaaccctggaaaacacttaccttaaaggtggtcaggggaagagaagcccacaaaggatatagaatagaagtaatcaagatagaagtctacaaggaagtgcaggatcacagaaggcaaggagatggagaaagtagtcagaagagagccaacctttggggaggtttaggaaggagaagctggatttggacataaatatatttttaagagcagagaaagacaaaatttttccattgattttgatttgagacgttgcccccatggtgtcaggaaaaggacaagcatgcaagggagaggatgggttggaaccaggcagggcccatgttctatgccagggattggcacatttttttctgtaaacatccagacaataacaagttgaggcttcacaccacagcagcctctgttgcaactaatcaactctgctactggagtgcaaaggcagccacatagaaaatgagcatagctatatttcagtaagctatacttacaaaaataggcaggaaaaaaaatgacagtgggctggctgcagtttgctgaacactgttcttgaccaatgacttttttttttttttttttttttgagatggactctcgctctgtcacccaggctggagcgcagtggcaatcttggcccacagcaacctccacctgggttcaagtgattctcctgcctcagcctcccaagtagctgggattacaggcaccagccaccatgcccagctaatttttgtatttttagtagagacggggtttcaccatgttggctagggtggttttgaagtcctgacctcaagtgatccacccgtctcagccttccaaagtgctgcggttgcaggcatgagccaccgtgcctggccttgacccatgactcttaagggttggtgtacgaattaactggaagctgtgtagtgaatgagcacaagattcaactcacagcccctatgtgagagaaatgtaactttattttttaaaattggatttaattcagtctagagctcggtggaaactttatttcattttattcagtatcattccattcacccccgccaaaattcttctggcggtttatctaagtaccaggattaagggagggttgtggagggattgggcactggggagtggggctctggccccacagctgtggggctgggtggggcttggtgccacagctgttgacacagtctgagatctgttggagtgctgttgtatttggtcttcagtcaccagtgggaaaggtctctgtgacaccatcctggggtactgagcacactcttccatcacgtctggccctggctgtctccttcattcagctcaggtgggtgggttctgatgttgcatcagtgctgtgttgggatgcctggcttcccagagaaaccatgctgccatttcatctgctctatgccatgctgggtgcagagaaccctgggggtttctccagttctacccaggaaagggcataagaatcctcgtcttccaggatcccaaatgacgtggagtttctataatctctcaatccacctatcctaggattctgtctggggatagggagttgggagggacagagctcaggaccttctcaggtacctaacatgtcttagctctttgacttcccctttagttgtctgcttcctcccgacttgaataagttttatctggtcttcaggattgggggcttaagctctggcgtctgaaaagccaaaaacaggctcctttatcttccttatgtgttctcctgtgaaaacaaatgaaaattatcctaccttagtgaatggaggaatgaggaagggctgtgaggaaaaccagaggagaaggacagaatagagtggaatgcatatcagaggaccaatgcctcatgcctgcaggtcttgtgagagctgctcagccaacctggtttccccgctgaccccgcagcccacttcccccatgcacatctcttgatatctgcactcagcagatgcaaagcgaattatactctgtaactttccatcaaagggagcacgggctttgcgggctgacaagctcacattgaatctaggctctgcacttcttggctgaataaacaagttacttaatatttactggttagagttcagcaaaataaaacagaaaccaacaattcaagcagaaaagaattaatacagaagttggaagagtcagagtaacaggatctatgctaagtttctgggagatgctcagagccacactgcagaactggcccgccggttgcttttctgccaaaatcaagaagatggggactcaggaagccacctcaggactgttggctccaggaagacaccacctcagctgccatctagggatcaggaagttgccttcactggcaatcactaactccagagacggggcttgcctgccaaatctgcacctgcaaacaatgaataccctgtcccctgcctttcaataccctcaaagctagtgactggaagccagagtgctgccacagcaaaactccacaatcccgcttaccagtagaaacaacggaagaacagcttgcttctcctttccaaaagtcttacaagggcatctctatgggagagcttaaatcatatccaccatgttagctgcgaaggaagtctgggcaaggttatgttctactttcctgcctctctggtaataggatgtgcactagactagaagggaggtgcagaagatataaagctagcgaattcttaagaccgtgcaatatttattcctctgagcctcagatctgcaaaatagggatattatctattttgtgggacatttgtgtggattgtacaagatttatattacattatattatatattagaatttaccagctctcttgctttagtatttcactgaagatttgtcagtcctgtgatacttaaaacaaacaaagaaaacacaagagaatttaaaaaaaaaaagcaaccttagaaacaaaacaaagatcagggttaaatttcctcattacattggtctctttttctggttccactaaaaatattttaatttgtctcagtgttttatttgtcataagtatttatagcatcaatgagagaaatgatggttttcaatttttgtaagtaataacttgggaacacaagcatcacgcagaatgacaatgactgccactttctcaggactagattaaatcaagagctttcttttgccctcagttatcagtgcagcatatggaaatgtgctaatgtctgaatgaattttgattcaaacctcaaacctcaaccaacaaaactgatcagcatctaactgaaaatttcaaatggctgcatttccaaataggtcagtgtctgtcacatttgtttcaatgccaagagagtcttcacacatccgagaatggtagaattcctaaaagatgctgtctgagtaaatgagtgaccctactgcctttctgaatatatttttgtgtaggattgtgaaccagcattagacttaggtctgaagttttaaaaaagcttccaaaagtattgaaactattccagtatagaatagatgtagtgtttccaaaggatcctttgtttatggacatttgtgaaagctgaggagtgctgacctatatataaacttattgacatcctatttaagatcaagcaaggtctgattttatacaatttaataatgatcctaatgaattctagaggtcaaattatcttggagtatgatgcaagatggggttccaaactatttcactgcattggaacccttttgtagtaagtgttatgaaaatcgtgggaagagtaggaccctgaaggcaaacaacatgctttccaatcccagctgattctcttcccaggtgtcctaaattacttaacctttctgatctttagactccccacctgtaagataaggacaacaatgaagatgagataaagatgaggagatgatgatgatgatggtgatgatgataatggtgatggtgatggtgatggtggtggtgataatgatgatgatggtgatggtgatgatgatggtaattatggtaatgttggtgatgtgatgatgatgatagtaataatcatgttgatagataatctatatcaagtgattactatgtgcaggcactgttctgggaggctttatatgtactaatttgtttaatcttcaggacagtcttttgaagcaggtatctgtagattgtcatgaggattaaataaattgatacctgtaaagtacttaacagagttcttcccaatggaaaatcctcaatcattgcctgctattattactattatcattgggttgttgtgaatttaaaaaaatgggatattatttttaaaatatctagctctgtacctggcactctttttaaaaagtttttttttttttagatttcaatagcttttgggggtacagtcgtacaaatggttttttgttacatgaatgacttgtatagtgatgaattctgagattttgttgtacctgtcaccagagtgtatacattttatccaatatgtagttttttatcccacacttttctcccctcctcccttttgagtctctgaagtctattatacactctgtatacctttgcttactgatagcttaggtcccacttgtaagtgggaacacatggcatttggttttccattcctgagttacttcacttagaataatggccttctgctctacccaagttgctgcaaaagacattatttcattcctttttatggctgaatggtattccatggtgtatatataccacagtttctttatccactcattggttgatgggcacttagattggttctatatctttgcaattgtgaattgggttgcaataaacatacatatgcatgtgtctttttatctaattactttttttcctttgggtagacactcactagtgggattgctggatcgaatggtagatctactttcagttctttaagaaatctccataacgttttccatagaggttgtactaatttacattctcaccaacagtgaaaagcattcccctttcactacatccacaccaaaatctattattttttgactttttaaaaatgggcattcttgcaggagtaaggtagtatctcattgtcattttaatttgcatttccccaatgattagtgatactgaacatgttttcatgtgttttttggccatttgtatgtgttcttttgagaaatgtctattcatgtcatttgtccactttttgatgagattacttgatttttcccttgctgatttattgagtttcttatagattctggatactagtactttgtcagatgcatagtttgcaaatattttatcccattctgtgggttgtctgttcactctgatgattatttattttgctgtgtagaatctttttagtttaatcaggtcccatttatttatttgtttgtttttgttgcatttgtttttggggttttagtcttgatgtacctggcactcttacatgctcagtaatcattagatgtgattttgttggtgaattcttatttgttattcctctgttcattcaacctccccagtctgggtcatacactgttttcaaaactctccctcttcctattagttaacccaattctttattcagcaaatattattaagtaccagtttgtatgccggagtctattctaagcataggagatgccttggtgagcaaaccagaccaaattcttgccttcatagtcaccattctaaagcaaaagcagaaaaatagtctacataactcagctaaaatagacaaaaagagaaaacagtcaagcaaacaaaaagattaagaaatataaaatcagtaaaagagtatcgaaaagaatacgtagaaaaatgcaatggtaataaaatgatttccagggaatatgaactgacatttcacataaacatataggtgatgaggcaagacaaactaagatgataaaaactaaatttaaacaagaaaaaatgtttaaagcaaacatataagcaatatgtataagtagtggttaaaagaaacgtcttaaagcataaattactaaatgagaaaagttataaatctacactcaagaaaaaaatggaaataggcatttaagcagcagtttggaggtgaaaggtttaaccccacagagcaaacgaattcacttgggctcaggtagctacgagcagcatcaggcacctcccagtgctggaattcacctattagaaacccagaacacccctaggaacctcagggaagatgctggggaccaggtgccggtcactgtgggccactagcttctgggggtttgcctacctggcactttaaatggtcactgaaggtatccaaagccaaactccagcacagcttggctgtcctcatcataacccctgtcctcatcctctcagcagaaacccagtaggtctgatggtgtcagtgggtttttgctttctactcctttagcctccttcatcacttaataagcattttgtcaaagaaatgagtgcatgtgattccaaagtcaaatggtaagaagggcatatcattagaaaaaagccccactcctaccctcttcaactgctcctagaggcaacccctaagaaccacttcagttttctttgctttttgtattttattgtttctttctttgttgtgtggatagtctttatttatttctgtagtaccatcttccctcccaacaaacatggaagaaaaaaagaaggggctggtgggaagaaatgccctgggggacacacctctccaatctctgcagttttgaagagggagtgttgaggtggaagtcttggggatatggggaagatggccagcccctcctcttgtctcccaggtggctcttggcagccttttaaagcttaaactcatcagttattttggagacgatgcttttaaaagacttggaagtctgggatatatgcttaaatggaaacttcttgagatatctccaaagcaattttcacacctccatcttccactgtactgagttctcttggtcccactgtggctgcatgcacagcagcatgcagttcttgtacagtctctggagtctgaaggagttccattttgtcttatcaatgatctgcacagctacctctttcctagttagggtgtgtcaggccaactgcatggtgaccaagttaccctggttgatggtcgtgatgagccagtagttgccaatatgggtatcctcagcagagatgcctgagaggtcctgcagtacgttggagatagggcttggagtcaaggtgtcccgaggtaggcttaaatttgggaaaagctgattaaaagcttggtccaaatcatgtcaaaagaatataacttccaaaatccacctgatgacctaatctttataatgaaatcaaaacacaatgccagagaaaaataaaaataaacaaaaacaaatgctaacacactaaatttaaaaagaaaaatgagaaaaaattcttacaaagtctttgtatagttttggtattagggtaatgctggcctcataaaataagttagaaagtgttccctctgcttctattttctggaaaagattgtacagaattggtatcatttcttctttaaatgcttgacagaataaaccagtgagaccatctgggcctgttgctttctgttttaggttattcattattgattcaatttctttaatagtataggcctattttgatgaccaatttctccttgttgagttttggtagggtatgtctttccaggaatttcatctaagttagcaaattagcaggcttggagttgttcatatttctttatttttcttttaatgtccatgggattagtaacgatgggcctctccttcatttctgatattggtaatttgtgtcttctctctctcttttttcttggttagccttgctgggcttggttagcctagccttattaattttatagatctattttattgactctattaatttttattgatctatttaaagaaccagcttttggtttcactggtttttctctatcattttcttactttcaatttcattgatctctgctctaattttaagtattttttttttttgcttattttggatttaatttgttcttttctagtttcctaaagtggaagcttagattattgattttagatcttaatcaatatatgcattttaatgctataaatttctctgtaaacactgcttttgtcacatcccataaattttgataaattgtattttcatttccctttagttcattttcacttagttctttaagtagtcacctctatgtcttctatttgcattatgtgtaaccttttagaaacctttgtgatgtaagatatgttatattcctatatttctctaaatcaaagttaatctcttctaagctcacaactctcccggctgatgtgaaattcatctggtctatgtttgagaatactccttcctccaggatcgtgcgcaaacctcaggatcatgttcaactttgaattggtcccttcaaagtgaacaactcagccacagtccagcatggacatcttaccccagggttttcaaggccatggttcttagtatcttcctgtccttgtctcagagctacatcattagagatctgtcactcctctagaagctctttattagtgctggttcaatactcacagaacctcccagactcatcccattcccaattctacaagcattgcccttcacctccaacacctttgagatgatgcaatataaccgtttcaaagagaggtcgaaaacaaaaatcctatgtgagagttatctttatttagagacagaaaaattgcagcttttgtcccagcaagtgaacaagagtttccgccctcttgggatggaaaagaaaatgaaaaagcaatagaagcaagaaaaaagcacacataaataccttgatcagttatcctttcatcttaatgctcctacaattattgcaaaacaatcatttatgaactcaaactggggacggtaacaaatttgttatgggctgggcacttgccatgctgtgtaaaacctgggtagattcatgtctcaagataatttttaaaaatgtaaacttcctactaaaaggacagcataaggcagtggttaagagcacagagtcaggtgggcacagtggctcatgcctgtaatcccaacagtttgggaggttgaggcaggaggattgcttgagcccaggagtgagagacctgcctggacaacatagctagactcagtctctataaaaaattaaaaattattaatagctgggcatggtggggtacacccatagtcccagctactcaggaggctgaggtgagaggatcgcttgagcccaggagtttgaggttgcagtgagctatgattgcaccatgcaatccaccctgggcgacagagcaagaccttgtctaaaaaaataggaaataaaaagagtgtagggtgtgagcttatcaaggttcacatctaaactctaccatttgctctctgcaggaccttgagcaaattaacttctttgtaactcagtctcctctttggtaagaaagagataatagtatgtgatgttccccttcctgtgtgcatgtgttctcattgttcaattcccacctatgagtgagaacatatggtgtttggttttttgtccttgcgatcgtttgctgagaatgatggtttccagcttcatccatgtccctacaaaggacatgaactcatcattttttatggctgtatattatccctaaaacttaaagtataataataaaaaaaaagaaagagataatagtagtatctgcctcattggattgttatgaataggaaatgaattgccatttaccattttagaacagtgcctggcacaaaataagtgctgtataagcggagacagacctagaagctgtctctatttaggtcatcttgaatggaaggatctctagttactcacctctgtgtgtttgctgctattttaaaagcctgtagacccttaaagttttacaacatcaaccaatattttattgattgcaaagtaatgggtggcctactaccagtggctatcagtatcagtcactggagtctggcacgtgcatgtgtatgtacacatatatgtgtatgacttgagaatagggtgtggtatgtggcttctaccagtataaagaagcatgagaagtgcctgaactcaggaagcagaggttgcagtgagctgagatcacgccactgcacttcagcctgggcaacagagtgaggctccatctgggaaagaaaaaaaaaaaagaggcagaaaagcagtgtgcaatattctgcagaatcgaggaatccatgtaaaagtaccatcctatagctattttcttgctaccccagggatcccattggtgctacacattccccagatggcaatgccaaccctgtctacttatcctgtattaccagcaaggctctgttcctcagtgaatttcctttccattcattttcaaatgacttttctgatatgagcattgttgaatatgcacaagaaagaggcagaggtatgtgtatggatagatttgcataagtataaatacagtatatgtacccatatttaaatgatataatgataatattgtgttgctattcagagtgaaagctaattaattcagctattgagatgataatgatttctttttcagttaataccagagtcaaaaaaccctgcagaatggttctacgcactgttcctttgactcatcttggaagaaagacctttattctgttaactattaagctgtctatcagtatctatgacagttttaaaggaaatcattcctgggaggggtagaagattattagtaggaaggctgactcatgtaggctcaagtggacattgaggtcatgatttggtaccaggaaagaaaaagtcctctttttgcttttagtctcttaaaatgcatgctttggtatttgcactctcaatatcaacactgatctgcagcacaaagtctttttttagactttatttggttggatttgacatttagaaaaatgttaagatctttcctactgaaatttacaccagctgaaaaattcacaagcaagtccatgactttcttaaccttgacatctctaacttttccttcagcctctgttttcatatttcatgagttaccaaaacctgatgttctctctgtttcctcctttctcttctgtcccactttagttcaggcattggtagcctctcagttgtattatggcaatagtctcctctctctagtctccaatacgcgttccacctttaccttgctccgaggagcttcccaacatacaggttaggtcatactgtcccctgtcaaagcctttaatggcttccctctttcaacatggtaaagactcaactcctttgcttggcattcaaggacacttaatcacattctgttcctgttacaactgcttacccatctcccactaattctctccatactctacccaaccgccaccaagatggagtatctaccctttcttggaattttcataacaccctgtgtttgctcatttttccgaatgtctttcctccctcatggtccatgtttctaaaaccttacttattcttcaaagcccagatcaaattctatttccttcatggacccctccctgattctggctactcttaattaatcaggttcactcccagtctatacaatgccttttcttcggggcgcttgacttctagcagttgggaaatcctcatattatacttatcttgctagaacaatttttaagtgccttctgctggaaaattgtcataagaaatatgcagctctacatgggtgcagtgtaattgctgcctctcctccttaaatgtggcacaatctttacaagcatatggtgtggacctgcttctacatttcaataatttattccttgtttagctatctcatcactcatattttatattatgctgtaaatttacttctgtttattccaactaagtatgcaactctgaagacaaggaatgtcttattcatcttggtatttcccaggtcagagaatgcagctttcagatagttggtacttaacagtaaactattttactctcttgtaacccaagggtggcaattgcaagatagtaaagagtacaggctttagtgcatgactgcctgggtttgaaccttcctagccaactactaaccatgtgatcatggccaagatacttaaactctctgtacctttttttcttcatctataatatggggacaaataatactatcttcatcataaaattgatataagaattacatcagtaaatggaggtaaagtagctcaaacaatagctactaggtgcttaataaatgttagatattattccaacagtctgttaaaataggaaggactcctctcaattttgacagagacatgaagacactagatgctacattccaaggtgagcccatctggcagaaatttcacagtggatattcaagaaccagttaaacatctcacttattttgagggaatgaagagatcaggagttggaaattatagagaggtcttataaagattttggagcatgtgactagtgtgctgtgtgaatcttacatccctactgcaaaggagaatgttggaaatgggagtgtctgtccctcgggccaccactggaacgtgtagtaactttgtgagaattggaaaatggtgtcccctcatgcccccaaaatgtatactaaagaggtcctgttgccccaagcccaatgaaagagtcttcaagacgatcacttgagtaggttgacatgtatcccctgaagctgacagacatggggactttgtgtctcactttcacccgagaagttgaaaggcaggaagccgggtggctgactgctcatggataaatgggagagatttctctgctccacagagattgttagatcagagaaagccattatggggttatcttaggtccatgtgaagagaaccacatagagtgacctcagtgtaaaaattgtggagtgaatcgccagattcctagatgttgaaggagacacataccatgggctagaatagatatgtatttgccctcatcaaaaaagttcagatgaggctgggcgtggtggctcatgcctgtaatcccagcactttgggaggctgaggcgggcagatcacttaaggtcaggagtttgagaccagcctggccaacatggtgaaaccccatctctactaaaaatacaaaaattagtcggccgcggtgggcggcgcctgtcatcctagctgctccagagggtgaggcaggagaatccattgaacctgggaggcagagactgcatgagctgagattgtgccactgcactccagcctgggcgacagaacaagactctgtctcaaaaaaacaaaaaacaaagttcagatgaaagtatcccgaagatgagaggtctctaaacaacccaacccaatggagaaagagacaactttgaaaacttgctatgcacaaaccagcttacagaaatactaggcgagtaactgccttcctgtcatttcttctcttacctctcacaatcctctcctgaattcaacactgcctccttgactctgaaagtgtcaggaactgtggttagtcagatggaggagaaagcagaaagtggggaaatggagcagcagagttgaagtcggttacctcccttcttcactctaggcatcttacctgttaacaggctgcagctgtgctataccttctcgggggagatggttgcttttagctcaaggttggcatttttattattatgccaggctggcatataaagtactgaattgaaaccttgaatgcgattttctccctgaatgcctggttaacagcaactcactttccaaaacttagctcagtgctcactccctatcctgacctcttcatcccaaactgaggaatctgtgtgtctgctctgccgcagtgcagcttttagagcccaggcaacatgtaatttcacttgtttagttgtttgtgcgtctttgtcctcagccagcctttaaactcttggagcccaggggtgaattgtttgcctttgtaccctctgcacttagtgctcactggcatagaattgtcccccaataaagatctatgaaagtaatttgtcttagaaaacaaattcacatttttcctaagagaggctataattcaaatttgtctttatttctgagagataaattaaaaacaacaggcttctcaacaacacaatgtcacataaagtatttgtcactggtgtgctcaaggatggcctgggtgctctccagcagttggtgagaaaatgtcctggcatctctcaatccaaacctgtttttttcctgagaagctgtgagaggactttttacacttttcagtgtttctcccacaggtttcttcaggagaagcattaccaaaaacgctgtgtacaagtgtaaaaacgggggcaactgtgtgatggatatgtacatgcgaagaaagtgtcaagagtgtcgactaaggaaatgcaaagagatgggaatgttggctgaatgtatgtatacaggtattcacttcaagcaattacatttcactaaaaatctcttaaggaggcagatgtcaggtaactcatcacgagagtgctacttcacatattaaagaaggaacctactaagccatctaagttcttgaaaagggtaatgaaccactgaaattgtccaaactgtcaactaaagagcattttagtcacccgaaagaaatgggttttttttgttgtttttctttgtcgcagtgaactatacatggagcccagtggcattaacataccattcaaataatgtgctttaatgagctacgaatgacatctaaaagtttcctctaaatttgattttaatatacttattatttattgcttaattagcatacaaattcactattgtggaaaaaaatgagaatgctttataaggtataactgcctctgaattgtctaaatagagttctaaaccaagtcattttattaaggatctgtcttctcttagtgcagctttgaaccaatttgtataggtttacacaggaaattaactactcccagttttaatataattttgtctttctatctgataaagagacactgtattaactgctggctttgtgaggaactgtaatcttcatcaaaaattggaatgcatgctagtatataacataattaatttttcattctgcaaattctacagaccactcagattctgagatatgtcctgtttctcctcaaaacacaaatagacaaatgtcaccaaggggatgacagcattcaggcagggaatgccaaatgaaataaaagccttcagaaggtgactccagttctattgttaccaaactgtacgggcaactgggatggacccagggaaataatgcatgcaggttgggggaaaataggtctgtgtaaataatccagctctgggtggatgaaaattttatagtagctgatcacaatctcatcttagcatacatgaaatgagaacctgcaataggggctgctgctggaatccaatcttgcaatggaaacacttactctgacactgcacagctcatatagctcatcacttaaatatgaacttgttccagctggagcgctgaggacattttgcatgaagccacatatagcagtctataatatttatgaacacaaactcatccagtaacagatgcggatatttcatggttctataaaataaattccctgtacaaagaaattcctggaactttgttttattggcattgagaaaagagtaaggacgttaaatgggatgaagggaagattgttttacattatttttaatagctctcttttttttttttttgttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccactgcgcccggctaattttttgtatttttagtagagacggggtttcaccttgttagccaggatggtctcgatctcctgacctcatccacccgcctcggcctcccaaagtgctgggattacaggcgtgagccaccgcgcccggccttaatagctctctttaagtgtaaatcaatgaggttgattgtatgatcattcaaagacattttaaaagtcaccttgtattatttttatttttaactgtattctcaggaattggcactgttcttaaaattaacaggattttaaaaatttccctaaaggatgttaacatttgtttttctcaataagtttatatgtatttaatgtgaaattcaatatccttcttctggtacagtatgtaaacatggatgaaaataatattaatggcatgttttaaaacaccaattttcacagtcccctagagcaggaacagggagagtgtcattcaccttttcattgactgaatcccttgcatttgtacaatgctttcatatcacaagttctttatataaagctcatttaaaaatgattattgcttttattttgtgtagattattgcttttaatctacacaaaactctatgaggtagatattattcccattttacaaatgaggaaactgagactcacagaggttaaactacttgttcaaggttaagtctcaaaccttggccttccctttctaaaatgcataaaaggctagcgttagttctgtgccattgcataggggatcttctgggccaggtacatatcagtggttttatgaccacacacccaacagtactttctgtgattggtgaagtctctatgcttatttgttttaggcttgttaactgaaattcagtgtaaatctaagcgactgagaaaaaatgtgaagcagcatgcagatcagaccgtgaatgaagacagtgaaggtcgtgacttgcgacaagtgacctcgacaacaaagtcatgcagggtaataatatgcaatggtgtctgccaagactggcaggaactgagtttctaggtacatagtgagctggccaggaggctttcaaattaaagccacaggcacagctgaatttctagtccaattgttcattaaaatggattcctaatacatgctttgatgtaaacattcaaatagtagcaatgcataaactaaaaagtgaaagttttccttctctctgactccattccagtcctactacctagtgtttgccagcagaaatgatttggtgtataaaatggattttttccaactgagtattgatgaccattttttccctctttttgagaagacagtctcaaactgggaagaacatggtctcaatagaggctgtggattaatccttataaatgagtaaaacagggtgaatacacgtatgtggatgaatagagaaaagtcctacccactggggttacaaatttctcaagaaatccattgagcaacttaggacaaaataggggaacagcatccaaggtgtttagacacacacattgtgataatgcacaggacatttgatggaattttattttgccattagctgaaaaaccagtaagctatgattgtccaaaccacacccttctcaatatttattacattattgacaaagaaaactttatccacatttagttttacaaatacgtatttttgtatttatttaagaaaaagtattttatatgaaagcattattttgccatagtgcttcatcagtaacactttggtataagaaaacaaagagttgacataattattcacactcttcaaaagatgctgtagagggagaaagagatgtttggggtctgaattgtccagattgttgactctctattttaggggttgacaaactttttttctttaaagggctttggccacatggtatctacaacagctactcaactctgccattttagtgcaaaagtagcagagacaatacataaacaaatgagtgtgactgtgttccaataaaactttataaaatccaatggatttggtccatgggccacagtttgttgatccctcctccacatgaatactctcagatgacttcaccaggtggaattcatgtagaatagtatatgaatatagtattcatagtagtcatactatatgaaaacctttcattagttataattaaagcttgaactttcagtgaccttcaatatgaatgggctcaatagtcttcatatccagactaccatttattcctaagaaatacacaagtggaatattttgttattcatattttatagataggaaaattcagtgaaatgtgatatggcctgcctgaggacccagagaaagaaattatacactctcttagaactcatagttcctgctgtatttatgcctttttttttttatgatttctgctattaggtccctccagatgaatgcacatatagaaagaaggctttatacacatcttccctaacaccttttattttcttgccagtgtaggagaaaactgaactcaccccagatcaacagactcttctacattttattatggattcatataacaaacagaggatgcctcaggaaataacaaataaaattgtatgtataatatctgaaaatatgtgggtttaaagttaatattttctggagtttttattgccttggaggtataatttatatgtgaatatgttactttgaaatgattagagctgagaattcaagttagacttttaaactctcagcaacattaaacaattcaagagtatgaagtctcccacctatcttgataatggtaattgccctccaaagatctgagaaatagtaagatgggttttcaaattttatcatctaaacctagtttttctttagtctaatggttttatattatcattttcttatctactttttaatcattggtttttttcttaaaatttagttaaaagaagaattcagtgcagaagaaaattttctcattttgacggaaatggcaaccaatcatgtacaggttcttgtagaattcacaaaaaagctaccaggtattttttaaataatcaaagttaatatttattgagagtttaaatatgtgcccacagattagattacctattttacatacggtgttttaattttcaaaacattcctgtgagatcagctctattttcactattactttgccaagtattttcacatgtacttatttcactgctattctctacaatagtcttgtgacattgagaaaggcaggtctgttctttgtaaaatgaaaatcatttaatatctgatttaaagtaactgtcgaactactatagacataagatattagaactagaaaggatatttaaaataatgtataataattctttcaaatcaatagattaaaaattgaaactttgcaaagttgtcattcacccatttattccttcaataagcaattgttgatacctactctatactaagtgcctggctattaccttcagggagagtgatcaaaggtgataataataatgataaatacacatacatacacatacacacgaagtgctgtttgaacacagaggaactggttgctaattgtgtctaggaaagatggagagacttcagggaggatcatatttgagttgagtctaaaagaaaaagaagttttccagttggcatggagaagcagcagcattccaagttgagagatctgcttgtttttttgtttttgttttgttttgtttgagacggagtctcgctctgttgcccaggctggagtgcaatggcatgatcttggctcactgcaacctctgcttcccgagttcaagcaattctcctgcctcagtctcctgagtagctgggactacaggcacacaccaccatgcccagctaatttttgtatttttagtagagatggggtttcaccatattggacaggctgaattcaaactcctgacctcaagtgagctgcccgacttggccaaagtgctgggattacaggcgcaagccaccatgtctggccgagaaatctgcttgttataaggcactgaggcatgaacaagaataggattatttgagataggagagaaaattcagtgtggttatagtatagtgtctgtggtgggctcctaggttagacaataaggtaagttggtaccagactgatgaaggcctaactaaggaatttaatctgtgtaccctggacagtaaagagatttcggtggtttttgtagcagagggaaatgaagtttttgttatacagaaatgacttaatcaggttcatgtaagatgaatttgaatggaaagggtctgggggcagggaagatcaagtagtatgctactgcacaagtccaggcaacagggcttgaaataaagcaatagcagtggggaagagaagaagaaacaaaaagaagagagattcaaaaatcgatagggcttgaggaacagttgtatgtgtaaggtgagggagagggacttacttatccacactcattctgatggtgccagtatagaaactagaatgtgggagtcttcttatatcccagcctcaaattctttttgccacattattaatgctatctaagctaatgggttttagttgtttcagtgtttattaaaatattggtgtattgaaatcccgtagtctagaagagtataataaataccttgtatagcagcataatactataatattaaattatagaagataacttctgacataggattttagttaaacatgttaatttgccttctttttgccagcattatgctattattttattaaatgtgtcacagatagacataagcctacataaaactcataaagtgtgaggagaaatttctcactatcattgaaacactaatatgctctcatttctttattaacaatgaaagaggaacttaatttactatatgctaattaaactgaaggcaagctcaataaaaaactggattatataagagtaaaaactgtggaggaaagaactggaaaaaggagatatttttggttatttatgggaagagattttttaagttcaaatggtcagttggttttgaatcaagaaataattgaagacaaataaaaaccttattcataagaaggtagcttatctgaaagcaatagcaatatcttggcatctcttaattcccagtgcctagcctcgttcctgagggagcaagtacaattagtgtgtgttcaatgagtaaagcagaaggaaaaaatttaaaatatggaaagaaataaaaggcaaaaacccttgagaaggaaaaaaattgacaataatgacagagatagcattattacaagtagtaacaatagggatataataccagtactgaagggatattttgtgaaaaactgaattgaatcattccattcagtattcattgagcacaacctgtgccaggcactgtccaaggtgctggagtccctgagggcaataagacagggcccctttcctcaaagaagctcttagattctctcggatggtggctcaatttttagcgttgctctcttctctatactccctttgctatttagttcttcccaagccatttaggccctgatggtgttatctctattcatgtgagtgtatgtgccagcatgcacatgagcttgtgttttgtttcccattcattcattcaatctgtcaattatccaacaaataattcttaggtacctattatgtgccaggaactggggatacaaaagtaaagaaaaacaaggcctctgcccccaagaaatgtacactccagtagaggtggcagacaattaacaaataagcaaataaatctataatatcatgtcgggtggtgataagttctataaactaaaataaagcaggtagagactagtagtggtggggagtgtattttagattggggaatgctggagcagaggcttgattgcaggaaggagcagggcatggggcatggggttatctgggaagaacattaatctctgaggcaaaaagaggcttgtgtgttcacagcagggccaggtggtcagtgtggctggaacacaaagagtagagggaatgaggagtagaaaatgagttcagagaagctgttgggactgtactatttaagcctggataacaactttgaattttccagggagtgttatattccatcaggttggcaattcttaccatatttttctgattttcccccaccctgtgtgtcgcagtgctgagttcagagcagatacatcaacatgactttggttggctgtttttgggaaatactacccgttctttagcttgactaaagactcatgagttagccaaatattctgggtgcatataaagttttcttctggcttgtagatgcttccaatctgcagagttgaccctgtcacatcaggtgtgactaacataatggctcaaagaaaatctacctgtgtctagtttctgagggtttcttcatctgaatcagtgtatctatgccataatatatgtatctacttggacttgacatctccctttgcccagcttgtttaataaattctgctcaatgaagataaaagcctctattttattggcgagtacaaatggactcaactagactacccaattttaaacaactacagaatcacttgatgtaaatgttttatcaatggcaatgatggtgatcatgaaatattgttactccttgataccaatttgattatcatcattacctaggatttcagactttggaccatgaagaccagattgctttgctgaaagggtctgcggttgaagctatgttccttcgttcagctgagattttcaataagaaacttccgtctgggcattctgacctattggaagaaagaattcgaaatagtggtaagtgatttggctaatggtaaaagagtttgtttctaggagtaaaattggtgtgcttcatgagggtggggctcttgccaatcttatgcaatgttatatgcctgttgtgcctagcatgaagaatggctctaaaaagatatgtgttaaattgataagacttctagaggcttggttcaaatatctctgttgtaataacaaagtagcaaaactacccctttactgcactaagatgaagagccaaaggaagacttttttaaagattggaaaattcatctgattttgaacaactagcacaaaggagctaggattcttcagccaagaaaaagattatttaaaatcttctggtatgtaagactaagtatccagctattatatatctgtatcaaaataaaataagaagacattttaatagcaacatttatatgtcatttactaggtctcagacacttttctttcttttttcttcctttcttttttttttttagacacagtcttgctctttgcccaggctggagtgtagtggtgtgatctcggctcactgcagcctctgtttcccaggttccagcaattcttgtgcctcagcctcccgagtagccaggattataggcatgtactaccacacccagctaattttggtatttttagtagagacagagtttctccatgtttcccgagctggtctcaaactcttggtctcaagcgatcagcctgacttggccttccaaagtgctgagattacaggtgtgagccaccgtgcctgactaaagttaactttttttttcttttctttttttttttttgagacagaatcttgctctgttgcttaggctagagtgcagtggcatgctcttggctcaccagtttcccctgggttcaagtgatttttttgtgcttcagcttcccaagtagctgggactacaggcgcatgccatcacacccagctaatttttgtatttttagtagagacagggtttcaccatgttggccaggctggtcttggactcctggcctcgagtgatccacctacctcggcctcccaaagtgctaggattaaaggcatgagccaccacacccagccggtttcagacacttttctaaatatatgatttcatctaatcttctcaaatattctatgaataaatactattatcattcccatttttcaaatggaaaagctgagacagagaaaggttaaataactttcccaatgacagagaggaagtctgacttcagaagctttgtgtcagcccaatgcagtggctcacgcctataatcccagaactttgggaggcagaggggggtggatcacttgaaatcaggagttcaagaccagcctggccaacatagtgaaactccgtctctactaaaaatacaaaaaattagctgggcatggtagtacgtgcctgtaatcccagttactcaggaagctgaggcaggagaattgcttgaacttgggagatggaggttgcagtgagtcaagatcgtgccaccacactccagcctgggcaacagagtgagactcagtctgaaaaaaaaagaagctttgtgtcttaaccactatgctatagtacctctcaagagacgagataatagcacaagttactcagtgtttaacttattgtggaataacactgtgacagggaagctcaagagacattgagatgaattaccaggaattctgtgcaatttatcttaggagatccttaagataggatgagttcttattttcccgagagatttcatatatgggttgggagtggggaatgaatgagatgacttctcaggatgttttctttctaaagtcttatcattaacaaaagcaaatttaaagacttttaaaaccgatattttaagatagagattagagggaaagttttcaggtagttctgcatctgtgatataagtgaaataattttttaaatggaaaattatttttaaaggcagtttctccatagtcattatgtttttttcctagttaaaaacaaaaagcataattagcatcattggtagatttaaaaaccacacactttaaaaagatgcattattcttaatatattaatttactagtctaacaaatatttaagggcaaggtactatggtagcagtgaagagagaaatcaagcatgttctttcccctaagaagcttacagtctaatgggaagagattaactgtccatgattatgataaaatatggaagagaaaaacagagagatgatgactcctagttgagagagctccgaaaaagttttattggcatttgagctgggacttgaatgagatttgatttggatatccagggtgcaagagagaaggaccagcaggagcaaagagaaagaggcaagaaagctcagggaatgcacacaaagaagggtgagtagctgagctgactgaattgagggttacattaaagggaaatagaaaggaataaaagaatcagatgattgagggccttggatgctgggctaatgattttgttatttcccaagtaataggagagatggaagatttttgagcagaggagggaaaatgtcaaaattaagctttacaaattttctagcagtgttagggtaagccagaacagaagtcacctcttaggaggcaagaagtctcaaagatgtcacgcttgctgccaggagaaatggagagaagagaaaggatctgggagatatatcttcgtggcttatcaacttttgaaagacattatgttgtcaagaaatatggattttggttctggacagattgtgtgtgtgtgtgtgtgtgtgtgtgtgtccaggctaaggggaaaatgttgaatcaggtaacctccaaggcaccattcagttctacaagtcttactgcttttcctctcttaaataattcaattttcctgatgggtggtttagctagtcactaggccagctactgaagtatcctgattttaaagccataatcaataattgacagttcaacttaggaaagaattaaaggacaggctgaattttcacatgtatgggtataattgttgttttagactattgaacatacactggtggttctctctttatgcagaaaactacaatggcttcaacaggttcagcagcttagctttgtcatttatttgattctggcttccatggactgtggcggtgctccctttaagaaaatcccagttggccgggtgcggtggctcacgcctctaatcccagcactttgggaggccaaggcgggtggattacaaggtcaggagatcgagaccatcctggctaacatggtgaaaccccgtctctactaaaaatacaaacaattagtcaggcgtggtggcgggtgcctgtagtcccagctactcgggaggctgaggcaggagaatggcgtgaacccaggaggtggagcttacagtgagccgagatcacgccactgtactccagcctgggggacagagtgagactcggtctcacaaaaaaaaaaaaaaaaaaaaatccatcagtcaaatctaattcttacaaaactaataaaataaaaaggaatgatgactcatgacaaaacttattcattttactgacaggtctctactctagggaatgtgtgtttggtttattcatcaagagacagtggtgattaaggatactgactgtggaatctggattgaatatgggccccactacttattagctacatgtcccatttttttaaagctgttgaaatagacttcataaccaatttgatctctttgaaatcatgtttaactttaatatttattctgcagtcttgcctcaagtttgataataaaatcttgataagacagggttttcttctttttgagtcagtattttatcccaagcacctagcacatgcctggcttggactgggtgctccacaaaattctgtggaataacgaaaaaaatgaatgaaggtttgtccggagctataaaactggtctgtttatttacttttcagatggttgtttccctgaatatcagagttgttaatgtccaaagctaacaagtaaccaacaaaaagttggttaaacattcttctagacattgcctgtagtagttaatttggggaacagatatcttttttgcatttgagtgtaagaaaaggaaaaagacagtttggatatggaagttctgttgtgttctctctcctcctcctcctcaaagatgagtcatttaaagttgattcaggtgccagacaatgaaaaagaggggtgcaatgtctgccatatgaattgaaatgttttgatgagagggcatctgcaggagaattatctggtggttgttctatctttctttctctgtctctttttctctcctggatgctcagcttcctttaaaaaaaaatctttgcctggctccatcagatctcctgggtcctgagccaagtcagatgctgccatttccatgatgaccactgggttagtaccagattccttccccagcctggctgaggtggggaaaatcccttccactgtggttcagctaaaaggggaaaaatagtcttccaaaaaagtttacaaggctactaagaggagaattatgtttatagaaaggcatatataaggctgagcatgctgactcacacctacaatcccagcactttgggaggccaaggcaggaagattgcttgagcccaggaatttgagaccagcctgagccacagagcgagactccatctttacaaaaaagttaaaaaaattagctgggcatggtggcatgagtctgtaatctcagctagttgagaggctgaggtgggagggtctctagagcccaggaggtggaggttgcagtgagctgagattgtgccactgtactccagcctgggtgacagagtgagaccttgtctcaaaaaaaaaaaaaaaaaaaaaaaaaaaaccaaacggggggcatatatgcgtaatgtctggatctattaattacggcaccagaaagataattattcagcacctactgtgtgtcaggctgtattatcagtgtttgtgtgagctttgggtcctacaagaagcagatatcaacatgggactaaatatgtcagaagttaattgggggaaatgcctctgaagaataaagggggaggaagcaggtggagtccaggagactgtacactactatgctgatctgacacctgtgaaagtggagcaggaaggcatgattgggcatgaagagcatcagatcacagcacagtcctgagaaagtctcagctaggccattggagagggacctagtccgagctgcccactgaatggacaagcactaacacacccactatgctcattcaccagttgagacaagactggtgaaagtgtgtcctcagcactcacagggcggcagctggaggctatcagccagccagactccctactgtgggctgtctttaagggtgatctgagtgggtcatctccatggctaacattttgcttcacgaaaaatattgtttgctctttgtagcactttgaggtagatattatcaattctatgccagacctagaccctgttaatcccaataacaaaatatcagtcccaagtatctgttccctctgatattactctctaactttccagcttgccaccttccagtaccctgactctagggattctttgttccaaatcaacgtccattgccgggcgcggtggctcatgcttgtaatcccagcactttgggaggctgaggcaggtggatcacgaggtcaggagtttgagaccagcttggccaacatagtgaaaccttgtctctattaaaaatataaaaaattagcctggcgtggtggcaggcacctgtaatcctagctactcaggaggctgaggcaggagaattgcctgaacccaggaggtggaggcagcagtaagccaagatcgtgccactgcactccagcctgggtgacagagtgagactctgtctcaaaaaacaaacaaacaaacaaacaaacaaaatcaaaaatccatttgttgaccctccatccactaaccctccagccattgactctacttccttttgcctgaccacactttcctcagtacttggcttagagttcgtggttcatcaatatgatcatttccttagatcattcaccagatatcctcaactctttgtctttctttcacctaagaaaaccctctgcctgactgagtacgactcttaacctactctgtgcttgagcctgagaactgaaacagtatgactggcttacccaaagttagtgatcaaacacttcaggtggacctcagtactttccatgtatcccttttctctagccaattcactcttatacttatggaaaattgtcttgtaccttctctttcttcaaatttccaacatctcttcccactcattctcaactataactttgttgagaaaaggtgtctttcaagaacatgccataggagttggagctcaaggatatgtggtcaaaccccagcttcaaggaaatgtaatcaagcttagagaaagatgaactccccgagcttagtcaatatgtcaagacagagattgtcacaagaaacaaagctggagccaagttcctagaattagatgcacacagagctccccagggttttctgagagttgacttcatccacatgatccactatggctccctaccattttggtaacattccagcaagtggggagggcaaaggggaaaaagagtggcacaccttccctttaaaggaataatcctgaagtggtatgcacaacttcacagagttccccagagttttctgagtctgggtcagaattgaaacctgttgaggcaagtggtgtggttctagccgtgaagacacaaaagcttccaaaaccaaagtcaggcagttacaccttggggctcccatgatttctggctgccacatattgctggagcctctctgtcacaaatcagctacctccaacagaagcaattgtcttattcctttgttttatttatttatttatttatttatttattttgagacagagtctcactctgtcgcccaggctggagtgcagtgaccgtgatctcggctcactgcaacctccgcctcctgggttcaagcgattctcctgcctcagcctcccaagtagctgggactaccggggcgtgcccccatgcttggctaattttttgtatttttagtagagacggggttttaccatgttagccaggatggtctcgatctcctgacctcatgattcgcccgccttggcctcccaaagtgctgggattacaggcttgagccaccgcacccggccctgttcctctttttattatattaagcactttataaacacttgttttttgcctgaagaatacttatgagctgagtgcggtggctcacacctgtaatcccagccctttgggaggccgaggcgggtggatcatgaggtcaggagattgagaccatcctggctaacatggtgaaaccccgtctctactaaaaatataaaaaattagccgggcatggtggcacgcacctgtagtcccagctagtcaggaggctgaggctggagaattgcttgaacccggaaggcggaggtttcagtgagccaagattgcaccactgcactccagcctgggcaacagagcaagactccatctcaattaaaaaaaaaaaaaaaagaatacctctgatgatcagttgtagggtagagatgatttgcatcccctaaaccttcagaacaggcaaggctttctgactcatgtcatctctcatcagaatatctcctcatatttctcagggtggtggctcattagcctccctcctctcacttgatgagacacttagcttcgaatcttatcattttcatttgactctgcctgtagggcaactatccggtagcaatggaagatcatttccattaggacctgtatttgtttatttgtttacttttttttaacaagcttttattgagtacttctatgggataggtacactggcggtacaaagatgaataagataaagtcataatcctcaaggacttcatcttctaggggaaatatatttgaaaagaattaatcacaatagatttcatgcataatttaagttagaggtttggctgctgtaacagagacaaaaaataaagagtgcttaaacaagatggaaatgtatttctatcttatactagtctgggcatgaggagaatgggactgatagggaatcttcatagtgtccctctgtgtcatagttctatccatacagatggatgtcatgctcatccatccacagagagttgacttcatcttcttggtccagtatggctccccaccattttggtaaaaacacattccaggccgggcacagtggctcacacctgtaatcccagcacttcgggaggccaacgtgggcagatcacgaggtcacaagattgagaccatcctggctaacacagtgaaaccccatccctactaaaaatacaaaaaattagccgggcatggtggcatgtgccggtagtcccagctactctgaaggctgaggcaggagaatccctggaacctgggaggcagaggttgtaatgagcacagatagtgccactgcactccagcctgggcaacagagtgagactccatctcaaaaacaagcaaacaaacaaaaacacattccagcaagtagggagggcaaaggggaaaaagaatggcacaccttccctgtaagtgaataatcctgaagtgttacacataacttctactggcattccattggcaagaacttaacttcttcatcacaccttgagacaagagacctgtaaagagaactactaatgcaataactgggtgagaaatgatgagggtcttgctggttagaatgcatataatcaaaaagaaaaaaatcttccatgtaatttcataagtttcagaacttgtgatacctcaagtttcagaaaagctaaagaatgaagttttccagaatatgatctgtataaataaatatgcatgtttctagtttataataagatactttctccaaatatcaaccatatattgtgacaataaaaaccatccaaactcacatgctgctgcatattttatctataatgttttcatttattaatatttatgaatttccttctcccagtgggttttcagaacattgcctcttccacacaacacataaaaacctgatctcgcaagatgacctttcagactaactttttattcttatgctaatacaatcattcttatttctattatacatttaattccagagtaacataatgctcaaagttactctgtttatgcctatgcaactctttaaagaatatgatgtgaaatctcttttcttgttcttcaaattcatactcttttgtttgctgttattaaatcccaatcacatacacaaagataactgtctctgagatgcttttaatgagaattagagtatttatgttaattgaggctttagaacgtatatctgatataatttgtgcttgagttgtttctatacaattctagtgcatcattgattttattcctaatgtaccattacttacaaactaggggtttaagttggaattgttaataaaaataggaataatcatagtatataaaatattatagactgaaataggtttgctaacactgaatgagtttatattttgttttgttttgattttttttgagacaaagtttcattcttatcgtccaggctagagtgcaatggcacgatctgggcttactgcaacctccgcctcctgggttcaggcaattctccagcctcagcctcctgagaagctggggttacaggcgacaggcaacatgtccggttaattttttgtatttttagtagagatggagtttcaccatgttggccaggctggtcttaaactcctaagctcaggtgatctttccgcctcagcctcccaaagtgctgggattacaggtgtgagccaccgcgcctggcccaagtttacattttaacattaaggaaattagcaataacctctcagagatcaaagcaacttgttctgtccatttcaaatataaataatccctgacatttatagtagttttgggcctttttccatccccacaagggacataaataaaatattcaattcagtaagaatttaccagtatgacaatatatctcatgttttgcaatgttttgttttcacatgcattatcctgttagtgctgctcccaatggccctcactaggtgagtgttatttataaaatatcctattttatagatgtagaaatgggcttagagaggcaagatgacctgctcaagttcatacagctaatcaaaagagtgcgaggaaattaaggtgggtattctaactcagagcccagcactctttctatatgtggcatctgtcactcaccaatttctaatatttgcccaactatctgctagcagggaatataaagtaaaacatggtttctgcccttcagttgagagataaagtataagcagttgttagcaatttcaaattgctttaagtcagtgatcaaatgaatagacaatgaagtcagagaaaggagataatcttgttagggtgatgaagttgtagcccttaatagtaccatactaaaatatactgtgcttatttttgttatatgatttcactgctttagccttttcagcttgcacaaaatgaaaacagttaccagaactatgttttccaaagatgcaaatctaagctgattatcagttcagatactgtctttgagaggggttagaaatgtaaagaaacaaatgatagactatttataagaagggtaaatgctttagttaaatttagaaatcttaacacctctacttttgcttttgaaagtggtcacatgctaacttttgcatgggcaaatttaggactcaaattataggaagaaaccttccttggattaagaggaaacattaaagaaatacaagtgaggttatttccattgcccctaggcagaatccattgttcctcagctgtatttcccaagctttttgtacttgctcggttttagatattatgtatttatttatgtcaagtcgccccttggtatccacagaggattggttctaagatctctcttggataccagttaatggctgctcaagtccctgatataaaatacaacctttgtatataacctatgtacatcctgttgtatactctaaatcacctccagatgacttataatacctaatacaatgtaagtggtatgtaaataattgcttcactgtattgtttagggaataatgacaagaaaaaagtctgtacacgttcattacagttgcaatacttttcccaaatatttttgatctgtggttggttgaatccatggatacagaacccacagagagttaactgtatctgcttcttccattaacctgttaattgcctgaggacttcatattcccagattcccagcactaatatagtgcctgacacatagcaggaatacaaatattggtgaattttgttgagttgaatctggaacttgacagtccaaactctggtaactcctaagccctggtgagacctaattaggccggatagtttttagccactaggactaatgggaagcatatcatgtattatatattttaaattaaatattttatacttaaagtagttcttttttgaattgctagtttgatggcagctgtttacttaggaccaagagtatggcacaaatgactccctggggaaagtttagcagttgaaatagaggacatagtccaatctcttagcaccacaagaatatgtccattgccttaatggcatcccttgtccccatcacatctcacaactatgtcaccttcatcataaagaactacgaaaacatactactgcctgatttaacatgcatttattaatctcctattatgtcttcagaaggatgctagttattagagatgcagaggtgaataagaaatatctggccagtcacagtggctcactcccataatcccaacatttaaggaggccaaggtggaaggattgcttaagaccaggagttcgagaccggcctagaatacatagcaagtccctgtctctacaaaaaataaaatgtctggatgtggtggtgcatacctgtagtcctagccactcaagagactgaggcaggagaactgcttgagcccccaggaggccaaggctgcagtgggttatgattgtgccactgcactccagcctgggtgacatagccagattctgtcataaaaaaaaaaaaatctatggagcaccctttatgggtcaggcagcatggcagccactggagataacagtaactgattcccactcttcttttttttttgagacggagtctcgctctgtcacccaggctagagtgcagtgcagcgatcttagctcgctgcaacctccgtctctcgggttcaagcaattctcctgcctcagcctcctgagtagctgggactacaggcgcgtgccaccacacctagctaatttgttgtatttttagtagagatggggtttcaccgtgttagccaggatggtcttgatctcttgaccttgtgatccgcccgccttggcctcccaaagtgctgggattacaggtgtgagtcactgcgcccggccgattcccactcttataaaatgtatatggtatttcacactccagtgagaaggagagatatgaattgtgataagttgcaatagaactgaacctagaaaaggaagtaactaattctgcttctctgtgacagggaaagctccatagaggaagcaaaatttgaacttggccttgaaccatggatggggtgccttagtctaacagggatcctgccttgtatttcaggaaaaagcatgaagacataaaaagtgtatcccacttgttaggggagctgtcagaatgctcttggccgatagctacagaaaataaactcattatggcctaaaaaagtaagaaaatgtatgagctcaaacaagaaacccagaggaagggtgacagcagaattggttaatttaggggcagaacccaccatcggaaacacagatccatctcatctttctgctttgctatccttggcgtattgaccttccccacaggctggttctcctcctggtcatctaatggccacagcagtgctaggcactatgtctgggcacaacactggtcaaaggaaaaagaaatgctgtcttcctcagtatggaaatctttcttaggaacttcccagtagactcccctttagtctcatgggcccaaatttcactgctgtccctaactacaccaacctctgatgtgggaaatgagaccaacagtggctggaccttgggctggagctgggatttgcctctaccatagtgtatggccatggggcagggagggggaagggagcctgtgcaggcaacaagctgaatcagctttaggagccttagatgaatcggtgttattagttcctagggaaactattgggctgctgagagattagtttgaaaggaaagcagaaggcagatgtggctttgtgtgccgtgtcagggatttataccttgacctctgtgctatggagtgatgtcatttctagaaaagtttcaagttacatggttttaaggaaatagtatcatttttaaccagatgctcagtccatcttgaggacgtcatcagaataagtcatatagaggtatttaagatactaggatatatgtctagtgtaatatgcatacttgtaaataacacacacacacacacacacacacacacacacctgcttcatttttgttcccaattacgactagaaagctaattaggaaataaaaacttttaacatttaaaacacctaaagcagtatagtgttaattctatcaaatggttattctctcaaagaatatttctgatcattgaacataatttattaatcacagacctctttttaaaaaagggaaaacaaataggaaacaggagcagaaacataacattatttttgcattttcagacttttccatggcaaagtctttggtagttaagttagaaaatagcccccccttgtgaccaaaaatcaggtaattggtcattcaagcgaaaatgaagcaaattttaagcaattctccaggaagaaggaagcaggaaaacaggaaaaggctgtccccttcaggatgatgttagtgttacatctccagtgttagaaattgctggttcacaagccctttgtttatgttggcatggttaactctgattgttgactctaattccaaaagtagatttatatttatctatcttgtaggaaaattattttttaactctcccattatttcttttttacattttctctatattcactcttggcttttacaacatgcacaagatgaaataatcattttaaaaactttaaccttattttccccaaatgttatcaattgtaattagatagctaatggaggcaacatctctggagggtgtgtggggatttagaaaggcaaatgaaataggaaatttggtaatcaaagaaatttctaaaaattttaatattttcaaatcagctgtcttgaatatccctaaatcttcatgtactatttaatttaatggcatagccataaattattattttaggtaaccacaactgaggagtgtagtctctgaatgctgaagaaagcataaagattgacatttttttgaagatgaaaaagaacagccttaccaagaaaatagagaacttagtttagctttaatacctggaaaaatactgaagcaaatcactgatcagccagtttgtatttatccccagtaatttgcagaatttgttggttttttaaaacctacatggctttgtaaagacaaaagttcacacgtttaatctaagacttaagatgaactgaaattaagatggactaatgtgttgattcagttctcctgaataatgataataatagctactattataattatctactctgacatttattgaggatttactatgaacctggaattgtgctaagcactctctatatatctcatataacactactgttatatggagtacacattatattacacgtgacaacatttcacagatgagaaaatgaagtcttaaaaaatttaagtaatgtcccaagaccaagtcgtggagtttggtttcaaactcagagctagcttatgacctcttaaccactaggtttgctggaagccaggactggtattctccaggctcacattctccaatcctctgcactttaagttgtatctagttgggtcatgggtatttagttcattctgtaacagctggataaagggcaatcttccacatgatgtaatccccaaattgctcaacaaagacattgttgttaatagagtccactggggtcaattaaaaaatcaaagtcaaaggggagcagagggtggtattttgaccagagaggaaaacggcaaggatttaatttgggaagactgttttttaaaaaatatttaaacatttattgtgctcaaaatttaaatccaaaaaaattaaataaatcgtataattctctttataggctgggtgcggtggctcatgtctgtaatcccagcactttgagaggctgaggcgggtggatcacctgaggtcgggagttcgagaccagcctgaccaacatggagaaaccccgtatctactaaaaatataaaattagctgggcatggtggtgcatgcctgtaatcccagctactcgggagactgaggcaaaagaattgcttgaacctgggaggcggagtttgcggtgagcctagaccgtgccattgctctccagcctgggcaacaagagtgaaactccgtctcaaagaaaaaaaaaacaaaaaacaaaaaacaactctcttttaaagtacaaaataattcatcaccttcctttattatttacccattatttcatctaaatgtttgtagctaagattttcttaaagcaggttacccatgattacagctgcctgagaggcctgtctcgtggcatgtatatatgtttcaccaaaggcaatttgggaatgtgtgttggatcaagattcagataatgtagacttgggttttccatttattatgccagtaaacttagtcaactcagattacccattctgagccttactttctcaagtctgaaatggggatagtaatactggcttatcagtacttcctgcacaggattgttgtacagaatcaaattcgtttatatatttgaaaaatatctacggaagggatgggtgtaattattgaaaagaagaaatcctagcatacttcgggatcttttactaccatttgcatcactgtaagatagagaaaaatgagagctgtgtccatgcatgttagaagtaatttttttcctttttgtattcattttattttaattttttttacattttattttagattcaggaggtacatgtgcaggtttgttacatggtgcgttagtctgttttgcattgctataaaggaatacctgagactgggtaatttataaaggaaagaggtttatttggttcatggttctgcaggctgtgcaagcatgacaccagcatctgctcagcttctggggaagccccagggagcttttactcatggtggaaggtgaagggggagcaggcatgtcacatggtgagacagggagaaagagagatgctaggctcttttaaacattcatatttcacagtaactaataaagtaagaactcattcattaccatggggagggcaccaagccattcatgaggggtctaccccaatgacccaaacaccttccaccaggccccatctccaacactgaggattacatttcaacatgagatttagaggcaaaaaacatccaaactatttcacatggatatattgtgtaatgatgtgatttggacttctggtgaacgcatccctcatccaaatagtgaacattgtacccaataggtaatctttcaaccctcaccttcatcccaccctcctgccttttggagttgccagtgtctattatttccatttgtatgtccatgtgtatccattgttcagtgaggacatgcggtatttgattttctgcttctgagttatttcacttatgatactcttctaacagtgagaatttaggctttctggtaagtataccttagatgataattgtactctttagcgtctggaatcaaagtttattctggtttgctcagccaaagctctttaactctggatctggtttggaagaaatggagcagtctattctcatctggaccaatcccaggaaacatcctcatctcaattaatccataagtcacatcacaggtttttgtgttggttttgttttgtttttctgtcaccacgattctccatccaatggctcttgtggaataaagcaatgcacagaagtggcactaagaagtctgttttttttgtttttgtttttgtttttagagatagcatcttggcccgggcgtggtggctcacgcctataatcccagcactttgggaggctgaggtgggtggatcacaaggtcagggtttcgagatcagcttggccaatatagtgaaaccctgtctctactaaaaatacaaaaaaaaaaaaaaaaaaatcagccaggtgtggtggcacacacctgtagtcccagctacttgggaggccaagggacggaggttgcagtgagccaagatcacgccactgcactccagcctgggcaacaagagtgagattccatctcaaaaaaaaaaaaaaaaaaaaaaaaaaagagacagcatctcactttgtcacacagactggagtgcagtagcacaatcacagcttactgcagcctcaacctccaggcttaagcgatcctcccacctcagcctcctgagtagctgggaccacaggcatgtgcccactgcacccagctaacttttgtagtttttgtagagatggggttttgccatgttgcccaggctagtctcaaactcctgagctcaagcaatcttccagccttggcctccttaagtgttgggattataggcgtaagccactgcacctggttagaagtcttaaatgacaaagaggagtgagctagataaaagagaaaagggatatttcaagtagagagcacaacatgtacaaaaactgggcaatgtgaattgtttagggaactacaagtggccgaggtggctagaggaaaggcagtgtgatagagtgatagagtgcagcttagccgtagccactgtcaggactttggagcctgccagctttggtttgaaacctagttccacctctctcagccgagtgcctttgggctagttatataacctctctgtatctacctcacggggtttagaactattaaatgaattatggtatattaaatgcttaaaatattgcataatacataatgagtactcctactattactattgttattgtgaatagttagataggcaggggacaggtcctagaggctcctacgttaaaaggaagaaaattaaaactatatgcctaaagccatggggaggtttagaaggtttttgtaagaagtagagagaaagtatgtgatgtgatctgatttttagaaaggtcattccaatgagaggtgacagcgtgctggcagtcctcagagccctcgcttgctctcggcacctcctctgcctgggctcccactttggcagcacttgaggagcccttcagcccaccactgcactgtgggagcccctttcagggctggccaaggctggagcccactcccttagcttgcagggaggtgtggagggagagacgcgagcgggaaccggggctgcgtgcagcgcttgcaggccagctggaattccgggtgggcgtgggcttggcgggcccctcactcggagcagccggccagccctgctggccccgggtaataagggacttagcacccgggccagtggctgcggagggtgtactgggtcccccagcagtgccagcccaccggcgctgcgctggatttctcaccgagccttagctgccttcccgaggggcagggctcgggacctgcagcccgccatgcctgagcctcccacccactccatgggctcctgtgcggcccaagcctccccaacgagcaccaccccctgctccacggcgcccagtcccatcgaccacccaagggctgaggaatgcgagcgcagggcgcatgactggcagacagctccacctgcagccctggtgccggatccactaggtgaagccagctgggctcctgagtctggtggggacgtggagagtctttatatctagctcagggattataaacacaccaatcagcaccctgtgtctagctcaaggtttgtgagtgcaccaatcgacactgtatctagctgctctggtggggccttggagaacctttatgcctagctcagggattgtaaatacaccaatcagcaccctgtgtttagctcaaggtttgtgaatgcaccaatcgacactctgtatctagctgctctggtggggccttggagaacctgtgtgtggaaactctgtatctaactaatctgatggggacgtggagaacctttgtatctagctcagggattgtaaatgtaccaatcagcgccctgacaaaacaggccactgggctctaccaatcagcaggatgtgggtggggccagataagagaataaaagcaggctgcccgagcccgcattggcaacccactcgggtccccttccacactgtggaggctttgttctttcgctctttgcaataactcttgctactgctcactctttgggtccacgctgcttttatgagttgtaacactcactgcgaagatctgcagcttcactcctgaacccagcgagaccacgagcccaccaggaggaataaacaactccagacgtgctgccttaagagctgtaacactcaccgcaaaggtctgcagcttcactcctgagccagcgagaccatgaacccaccagaaggaagaaactccgaacacatctgaacatcagaagggacagactccagatgtgccaccttaagagctgtaacaccgcgagggtccgcggcttcattcttgaagtcagtgagaccaaggacccaccaattccggacacaccaatacgtggatagggatagatcaaagggaatcaaactaaagataggaaggccagtaaagaggcaactgcagtaatccagaggaagagagatggaagcttaaattaagtaaatgccaggtgcaataaagaggagagggagcaccaggtgagagtgaggaggagaagccacaggcctgggtgcctgaatctcagttgtcaggcctgggcagttgagtggtgtggataccactcaccgagaatgggaacgccaggaaagaagtggatttggagaaacgtgggggagcttagttctgtggtgtctttgattttggacatactgggtttgaagagaacagccaattactgatgcttagtaggtaatggcttggtgcttcaggaagagatcagaaccctttgataagaaccctggcctggctgggcgcggtggctcacgcctgtaatcccagcactttgagaggccgaggcgggcggatcacgaggtcaggagatcaagaccatcctggctaacacggtgaaacccagtctctactaaaaaataccaaaaaattagccgggcgcggtggcgggagcctgtagtcccagctactggggaagctgaggcaggagaatggcgggaacccgggaggcggagcttgctgtaagccgagatcacgccactgcactccagcctgggtgacagagcgagactccatctcaaaaaaaataaaataaataaataaataaagaaccctggcccatttagaaatgaagctgtctatacttccagactgaataacaaccactttttgttagttgtttaagatgtgatctctgccttaattatcgatagtcatattcaaaagattcactaaatcccatctggaaaatggagacgtttttgagattcttttggcaattcaagagcattatcattgattattagtagtgactgaaacaaagacactgacaaaattagacatacactcattacactcattgttttggctatattttgagaattttgtcaactgattgtcttcacaatgtccttcctttggacatataataaaaataatatagtcattatttgaatgtgtgcatatagttgcaaaattaccatgtgtttatatgtataatgtgtttctagttttacactgtttagtcactcaaaaattgtattatgattgcaactttcccccacaggtatctctgatgaatatataacacctatgtttagtttttataaaagtattggggaactgaaaatgactcaagaggagtatgctctgcttacagcaattgttatcctgtctccaggtaattccaatgttacattttaatttttatgccatttttttcagtatactagtaataacgtttattgaaaaaaatctggaaaacatagaaatataaagaaaaagtaaagtagcctataattctgctatccaaatagaaccattattaacctttcagtgcacttcttttcagtctttttaaaaaatatcacacttattcatttaataaatgtatattgaacacctactatgtactaaccatgatgctaagcaccggggatgcaacaagacacagctcccatgcagcttgcattctggtaggatgagaaagataataaatgaagaaacaatattttttcagaaggtggtaaatgctacaaaaaatataatgagaatataaagaaagagagtggcacaaaaatggtattttaatttgtggtcacaggaggctttttttaagtgggtggcattggagcagggatctaaatgaaattacatactttttaacataataaggaacttttttctgagtttatatttcttctaaaagtcatttcccaagtcattaaaaaattacattggtaaagttgtaatatgtgctacatattccattgtatgaatatacaatcatttacttaatctttaccacatgtttgtatattcaggatatttccagtttttttgatgttgaaaatgtttcttcaacagttttttttggttgttgaaatgatacctctttccatatttttttctatattttttggttactttaataatttgggtgtcgaatgatgccatgctcatgatttgtagagcataataacaatgttagccttaggccatttttatacattatcttgaggcagaagctagttgttactttgctttaccataaaaattatgacttgtgactaaaaaactattcagcagaaccttctaaagttatgtatggatatgtcctatgacccagtgatttcacttctgagaatatactcaacagaaaggatgctcacgtccaccctacaggttatctttaggggttttgattggaaggggaattgggaggcttctgggaagcattacatgtgttgtatcttgatctcgttataattacgtgtgtgtgcataaaaattcatcaggttgaacacttaattttcacattttgtgtacaacatttaacttacacttcaaaatagttaacgttgctataattatgctgaattaatgcttttccactttttaattttgtcattttattttaaacttcaaaacagatagacaatacataaaggatagagaggcagtagagaagcttcaggagccacttcttgatgtgctacaaaagttgtgtaagattcaccagcctgaaaatcctcaacactttgcctgtctcctgggtcgcctgactgaattacggacattcaatcatcaccacgctgagatgctgatgtcatggagagtaaacgaccacaagtttaccccacttctctgtgaaatctgggacgtgcagtgatggggattacaggggaggggtctagctcctttttctctctcatattaatctgatgtataactttcctttatttcacttgtacccagtttcactcaagaaatcttgatgaatatttatgttgtaattacatgtgtaacttccacaactgtaaatattgggctagatagaacaactttctctacattgtgttttaaaaggctccagggaatcctgcattctaattggcaagccctgtttgcctaattaaattgattgttacttcaattctatctgttgaactagggaaaatctcattttgctcatcttaccatattgcatatattttattaaagagttgtattcaatcttggcaataaagcaaacataatggcaacaggattttctttgggaacaaaatttgataaatatacaaactcatttctttaaatgttgaaagacatcctattgaatctgagggggtaatttacagaaagatactgtctctcgcacttttgtcatctctggaaaagtcctggtgaatagtcattcatttgtaatagccctctgatcatttccttttctttgaagttcaaagagaatagcaaacagaaaagttaacaattttcacataaaatattccctcaagcaatcctttcccccatagttagtcttgaggcaggattcacaaattcagagtatgcagctaactgcagtgatgggaccttcgctttcctctcttaaaagtgaggaaatgattggcttcattgtatccaatcatctttctgttttgttttgcttttgaaaacattcctacagctgggagcacagctgctgtatacttcccccaaagcaggaattagttcatttccttccttcattgttacactgttgcattcttctccctattatcctttggtgaatacaataaaacaccttctataagta

SEQ ID NO: 208 - DNA, 50878 bp, Homo sapiens
  source 1..50878: mol_type = genomic DNA
ggcaacagcaaagcatcacgctgagcgccgggaccttctgagtgcaggcggtgggcgaagccccgagtcacacacacccacgacgccggccctgctcccacagcggccctctggggtagcgactggtattacctgcatttcacgagggaggaaactgaggcacgaactgttcagaagctgccctgaggtcaccaagtgagctaggaagaggcgtgggctcgatctctgccacatccacctcgggaaaccacaaggtctcgatgggtgattttgcctaaagtgggggcagtttgcccaggccggggtgggtccagccatctcagcaggcaggaatctgccaagttgggggatgcttagggaattagtcagatgcggggatttccagggaatcacagggggtggctccggaaagcagcagggacacagtactggggctcatggcccagcctggagtacagtgctgtgaatctgctgtgtgacccaaggagagttacttaacctctctgtgccccggttttcccacctataaaatggggagggtgataataatagcaactagtggccgggcacggtggcttatacctgtaatcccagcactttgggaggctgagacgggaagatcacgaggtcaagagattgagaccatcctggataacatggtgaaaccctgtctctactaaaaatacaaaaataagccggacatgatggtacgtacctgtggtcccaaccactccggaggctgaggcaggagaatcgcttgaacccgggaggcggaggttgcaatgagctgagatcgcaccactgcactccagcctgggcaacagagcaagactctgtctcaaaaaaaataataataatgataataataataatagcaactagctgctaggttgttcagacaactcaatggacagacagtgcctaatagaatttaaccactacgaatatttccaaatgaaattctttttttttttttttttgagacgaagtctggccctttcacccaggctggagtgcaggggcatgagctcaacttagtgcaacccctgcctcttgggtccaagtgattatcttgcctcagcctcccaagtagctgggattacaggcacgtgccaccatgcccggctaatttttgtattttcagtagaggcagggtttcaccatgttgaccaggatggtctcgagctcttgacctcgtgatccgcctgccttggcctcccatattgctgggattccaggcttgagccaccctagggaaattcttgattttcctcggcccagtccatggcgtcactgaagtggatgttcaatgagaaaataataaggatgaatgctgcagttggagttcaagagaggaggcatttttgacgccacagatgggcagagatggggtgagggccctggccggcaccagctctcctggctcagactttggaagccgccccccaggggagacgctcaactggtcagaggtgtggatagccccgtcccccagtagtcccaccccgcagagagctctcaggcttccagctctggcccaggcccaggtcctcggtgccatgtgaagggtggagagctctcctgggggacagagttgtacatttgtggaggttttctggtggggctgtgtttgacgtcaacactctcctccctaaaccctccctcttccccatcccatacaggtcctcctaaatgtcttcccagccccttcgagagaattgtggaagtggggttgccagatcaaacacaagacacccagttaaaattcaactgtaggtacgtgacgagtactttttgttgctgctgctgttgttgttcttgttgtttttgagacggagtctcgctccgttgacaagaaggctggagtgcagtggcgcgatcttggctcactgcaacctccacctcccgggttcaagtaattctctgcctcagcctcccgagtagctgggactacaggcacccgccgccacacccggctaattttttgtatttttagtagagacggggttccaccatcctggccaggctggtcttgaactcctgacctcgtgatccacctgcctcagcctcccaaagtgccaggattacaggcgtgagccactgcgcccaggctttgttgttgtttgagactgggaatcaccctgtcgcccaggctggagtgcagtggtatagtcacagcccactgcagcctctgcctgctgcgctcaagcaatcctccccagtcagcctcctaagtagctgggactacaggtatgcaccaccatgcctggccaatttttttactttttatagagacggggtttcaccattttacccagattagtcttgaactcctgagctcaagcagtcctcccaccttggcctcccaaagtgctgggattacaggcatgagccatcacacctggcccatttctttctttctttctttctttctttctttctttctttctttctttctttctttctttctttctctctttctttctctctctctctctatttccttctttctttctttctctctctctctctttctttctctctctctttctttcttttttttgtagagatggggtcttactgtgtcgcccagcctggtctcaaactcctggcctcaagcaatccacctgcctcggcctcccaaaatgctaggattacaggcatgagccactctgtccagcctgtcttaattatttcaaattgcagaaaacttcagacaaacatgaaggttgtttgtaaggaccttcttgggctgtgcctcagtttccccatctgggagatgccagcctggattcccctcccggcctcagtgtctctcctgggcggcaagaaggaccctgggactgtgcccactctgccgtccagggggccgagggaggtgcccagggagggggaggtgcgtggtggtgacgggcggctcccgcacagagcctcagacctgggcaggtgaggcaggcaggtgggtctggcccggcgcggcccgatgcgggggcagggatgggatggagccacttcctgtttctccacattctggaaagtccctgtgttcccaggcagagggggcacctcctccctgccagccctcctgggcgccgggctcctcaccacttctccttcctccacccacttccccagcggacgggcctgggacccgccccttcccctcctgcctctctcctcttttctttcccaatcaggcccttcctggtgtgcagaagggaaagctgattccacagcagctgggcctgcccgacccaggaggctacatctgtcacccctctgtctgtctctgtctctgtctctatctgtctctctgtctctctctgtctctttctctgtctccttgtctgtctgtctctctgtctccatgtctctctgtctctctgtcttcgtctctctgtttctggctctctttgtctctctgtgtctcagtttatttctgtctctttctgtgtctctttgtctgtgtctctgtgtccctctgtctctgtttctctggctctggctctgtgtccctgtctgtttcttttttttttttttttttttttttttgagagagtctcgctctgtcccccaggctggggtgcaatggcgcgatctcggctcactgcaagctccgcctcccgggttcacgccattctcctgcctcagcctcccaagtagctgggagtacaggtgcccgccaccacgcccggctaatttttttttttgcattttttagtagggacggggtttcaccgtgttagccaggatggtctcgatctcctgacctcgtgatccgcccgcctcagcctcccaaagtgctgggattacaggcgtgagccaccgctcccggcctgtctctctgtttctctgtctctctctttgtctctgtctctctgtctctgtctctgtgtccctctgtctctctgtttgtctctctctgtgtctgtctctgtctccgtgtctctctgtctctgtctttgtctccctgtctctgtctctggatccctctgtctgtttctctagctctctctttgtctctgtctctgtttctctatctctgtctatctctgtctcagtcccttcttttgccaccatccccctcccgtggccgccctcacgtgtcagcaccataccctccctgtggtcagggccacctgctccagggtgtcctcaggtcggtgctggccggcgtgttcccgggccctgcagccacctgcttgaccagggccaggcccagagtgagatcctaccaggccaggtcggggcagcctctgtgccaagacaactttagggaacaacaaacctgtctgacgggtttgagattccacatgggacaggctttctcacctccgcactgacgctaggacagctgggttgaaggggcccagtgacacccctgacatagcacctcaggctgggtacaggctgcagcagcctagtctgggtcagggctgtgtcctgaggttggggcacccagggcaggctgggtgaaggaagatcagcaatctgccggtcgccctgtgcagggaggataaacagggagaaggcactgcacatgcaaagtctcagcggggacaaagactcaggggagagtgtgcggggcctggggtgtgaggatagatggactgggagagagagaggggaccctggagggcctggaagctagacgtggcctgtattctgggggcactagggaaccattgagggttctggagcaacggagtggtacagtcatggtggggctagcggtgtactggatggggtgaggcacagggaccgaatttcagatcagaaggctcatctggtagtcagactgaggccggaggaggctcaactgccccgaggatgaagaaaggagccaaacttggccgggtgcagtggctcacgcctgtcatcccagcactttgggaggccaaggcaggtggactgcctgaggtcaggagtttgagaccaacctgccaacacggtgaaaccccgtctctactgaatatacaaaaaaattagctgggggtggtggcgggcgcctataatcccagctactcggcaggctgaggcaagggaattgcttgaagcagggaggcggaggttgcagtgagccgagatcgcaccactgcactccaccctgggtgacagagagagcaagattctgtctcaaaaaaaaaagagccaaactttgaacttcttttttctttctttcttttttttttctattttgagacagggttttgctctgtcgcccaggctggagtgcagtggtgtgatctcggctcacagaacccttgaactccttgcctggagcaatcctccctcctcagcctccagagtagctgggatgacaggcgcaccactatgcctggttaattttaaattttgttggccaggcgcgatggctcatgcctgtaatcccagcactttgggagaccaaggcgggtgagtcacctgagatcaggagttcgagaccagcctcaccaacgtggtgaaaccctttctctactaaaaaaaaaaaacaaaaacaaaattagccaggcatggtggcacgcacccataatcccagctactcgggaggctgatgcaggagaatcgcttgaacccaggaggcggaggttgcggtgagccgggatcgcaccactgcactccagtctgggcgaaagagcgagactccgtctcgacaaacaaacaaacaaacaaacaataaataaataaataaaccttgtttgtagtgaagaggtctcactgggttacccaggctaatcttgaactcctggcttcaagtgagcttcccacctcggtctcccaaagtgctgagatgacaggtgtgagccgctgcacccggcctgaacttcctatcaggtgctcattatgagccaggattgagctacagaaaatgcgagggaggggagacggcccccaggatgcccccaaaccggtactctgcaccccctgggcccacatctaaggacgacaaggcagaggcctcaaatgccaggtcctgtggctttgtccccggggcggtggggagccacgggcagaagtagggcaccagaggagattgctctgccagggctggggccagagcaaagggccgggggcagggcaggggcgttggatcgttggatggggctgcaaggtggggagggcaggttggggccatgtattcatccgagatgaatttctcagtgccacccagggccaggccccacttgcaggtgccagggccactacagagaacagacacaccctgagggggtccccaggccacgaagaagccggatgctggagcagcctaggacacagacaccttggcccttcccaggcaggcccctgccacgtgagtgcagggcaagggtcccaggagggggaacgggctccaggccccaccatggctgccctgagtgtacgcagtggtcagcccagtgctgatgtcacctgtgtggggacttcctggaccttcacctcggatccgctgcccggccccgagggaaattccagagaagccagggccgctcctggctgactcattctaggtgccagtagcacgggaggggctgggcaatggagggcctgggggcatttggagaactgtgaggagtctgaccacctcctctgagggccagtttctgctgcgtcccacggggacttggggaaaacttggactccccagccccagccctggcatcattttttttttttttttgagacagagtttcactcttgttgcccaggcatgggtgcagtggtgcgatttcggctcactgcaacctcagcttcccgggttcaagtgattctgtcgcctcagcctccccagtagctgggattacaggcgcctgccaccgcgcccggctaaattttgtatttttagtacagacagggtttcgccatgttggccaggctggtcttgaactcctgacctcaggtgatccacccgcctcagcctcccaaagtgctgggatgacaggcgtgagccacagtgctcagcccaggccagcatctacagggcacaagtgggaatctgggttctaggaggtgagaactggggggtggggggttgcaatgggtggagagtgctttcccttccctgcaggccttctcacgtccacagggttgcaagcgggactggcagagttgaaacaaaagtcagggagcagggctgggcgcagtggctcaagcctataatcccagcactttgggaagccgagggaggctgatcacctgaggtcaggagttcgagaccagcctggccaacatggagaaaccccgtctctacaaaaaatacaaaaattagccgggcttggtggcgggtgcctgtaatcccagctactcgggaggctgaggctggagaattgcttgaacctgggaggcggaggttgcagcgagccgaggtcgcaccactgcactccagcctgggtgacagagcaagactccatctcaaaaaaacaaaagaggagtgtgggaacaagtagtgaagatttccaccgttcaaatcccgccactcccccccggggctctgtgacctcaggaaggcacatgacctcccacacttcagtttgcccatctataaaatgaggataatcgtggtacctcctttggaagccttttgtgagaatttggtaagttctggtatgtgttaagtgtttggagtggggcttggggtatggtgaagagtttatattaaaaaaaagaaaaaaaaccttcaagttgggcatagtggtgcacgcctgtaatcccagcactttgggaggccgaggcgagcaaatcacttgaggtcaggagtttgagatccacctggccaacatggtgaagccctgtctctagtataaatacaaaaattagccgggggtggtggtgcacacctatagtcccagctactgaagaggctgaggcaggagaatctattgaatctgggaggcagaggttgcagtgagctgagatcgcgccattgcactccagcctgggcgacagagccagactccacctcaaaaaaaaaaaaaaaaacaaacaagaatcgtttggttgcagctgacagaaattgaaactacaactggctcctttttaaaaaacaggaattttttgctcatggaactgaaagatttagggatagagctaactcaaggccacccctctcagcaccgttgatgttctggaaaggaccattcactagggtgggggccgtcctgggcacacagggtgctcagcaatgaccctggcctccacccagtcaacgtctgtagcgtccccacccggtcatggtgaccaaaaacatctccagacattgctgagtgtcccctgggggtgtaatcacccttggttgagccctactggtctggcgggtttcagacacagctggatccaggaccctcggtcagtgtcacaaggatgtgtccaattctccatctcttagcattgccatcccctctcttggcttttttcttttcttttcctttctttttttttttttttttttttttttgagacagggtctcgctctgtcacctctgctggagcccaataatgtgacctgagctcactgcaacctctgcctcccgggttcaagtgattctcctgcctcagcctcccgagtagctgggactacgggcgtgcgacaccatgtctggctaatttacgtatttttagtagagatgggcttttgccatgttggccagtctggtcttgaactcctgacctcaggtgatccacccgccatgacctcccaaagtgctgggattacaggcgtgagccaccgtgcccggtctctcttattttttttttcttcaacagactttgcctttatggggaaaagatgatgccataagccccaaatctcatctgcccatcatcttaacagccctggcaggagtcaacacctcttcccaaggtgggggcaccaaagtgccagggaggttctcattcgcccagcctgggtcacatgtcctggtgggctgtggcctggtaaggggatgcccagattggccaggcagggatcacatggttgtatggagtgagccaattgggtgaaaactcgtggtcgggatgggcacggcggctcacgcctgtcatcccagcactttgggaggccgaggcgggcagatcatgaggtcaagagttcgagaccatcctgggcaacatggtgaaactttgtctctactaaaaatacaaaaattagctgggagtggtgttgcatgcctgtaattccagctactcgggaggctgaggcaggagaatcgcttgaacccgggaggcggagcttgcagcgagccgagatcgtgccactgcactcccagcctgggcaacagagtaagactctgtctcaaaaaaaaaaaaaagtacaaaacatgagccgggcatggtgacgcacacctgtggtcccagcaactcaagaggctgaggagggagaatctcttgaaccaaggaggtggaggttgcagtgagctgagattacatcactgccctccggcctgggtgacggggtaagactctgtctcaaaaaaaaaaaaaaagggccgagtgcggtggctcacgcctgtaatcccagcactttgggaggctgaggcgggtggatcacgaagtcaggagttcaagaccagcctggccaagatggtgaaaccctgtctctactaaaaatacgaaaattagctgggcatggtggcggatgcctgtaatcccagctactcgggaggctgaggcagagaattgcttgatcccgggaggcagaggttgcagtgagctgagattgcgccactgcactccagcctgggcaacacagtgagactctccttctcaaaaaaaaaaaaaaataggccaggcatggttgctcacgcctgtaatcccagcactttgggaggctgaggcaggtggatcacgaggtcaggagatccagaccatcctggctaacacggtgaaaccccgtctctactaaaaatacaaaaaattagccaggcgtggtggtgggcgcctatagtcccagctactcaggaggctgaggcaggagaatggtgtgaacccgggaggcagaggttgcagtgagccgagatcgcgccaccacactccagcctgggcgacagagctagactctgtctcaaaaaaaaaggaaataataataataacaaaaaacaaaaacaaaaaaaccctcctctatggacagaggcatgattggcaggggtgggatagctgttggcaaagaaggcccagctgtgctaagcaggccacccatcccatggaagggctggcatggaggcagcaccagtagacatcagaggatgaatgagtgggatccagtgctgctcaatgaatacatgcgggttgttttgtttttgtttttttgtttttttgagacagagtcttgctctgtcgcccaggctggagtgcagtggcacgatctcggctcactgcaacctccgcctcccgggttcaagcaattgtccagcctcagcctcccgagtagctgggactacaggcgcccaccaccacacccggctaattttttgtattttcatttgtttgtttatttgtttgtttgttttgagatggagtctcactctgtcgcccaggctggagtgcagtggcatgatctcagctcactgcaacctccgcttcccaagttcaagtgattctcctgcctcagtctcccaagtacctggaactacaggcgcccaccatcacacccagctagttttttttttgttttgttttttgttttttttgagacggagtctcactctgtcgcccaggctggagtacagcggctccatcttggctcactgcaacctctgcctcttgtcttcacgccattctcctgcctcagcctcccgagtagctgggactacaggtgcccgccaccaagcctggctaatttttttttttttttgtatttttagtagagacagggtttcaccgtatttgccaggctggtcttgaactcctgacctcgtgatccacccacctcagcctcccaaagtgctgggattacaggcgtgagtcaccgcgcctggccaattttttgtatttttagtagagatggggtttcaccatgttgggccaggctggtcttgaactcctgaccttgtgatctgcccgcctcggcctcccaaagtgctgggattacaggcgtgagccaccacagccagcctttttgttttgttttgctttgttttgtttctcttttttaattgagacacagtcccgctctgtcacccaggctggagtgcagtggtgcgatcttggcccactgcaacctccacctcccaagttcaagcgattctcctgcctcagcctcccgagtagttgagattacaggtgcgcaccaccacacctggctaattttgtatttttagtagagacgggttttctcatgttggccaggctggtctcaaactcctgacctcaagtgatctgctcacctaagcctcccaaagtgcagggattacaggtgtgagccactacacccagcctcttttttttctttttctttttgagacagggtttcgctttgccatgcaggctggagggcagtggtgcaaacagggctcacaggcagaggctgctctgcctcctaggatcaagggatcctcccaccgcagcctcctgagtaactgggattacaggcacaagccatcatgcccaggtaatagttttaaggttttttttagtagagatggggatctcactatgttgctcagcctggtctcgaactcctggcctcaagtgatcttcccgcctcagcctcccaaagccttgggattactgggtgagcccccgtgcccagccagtggctgcttgcactggctggcctccaaagctgaaagtatttgctccctggcccttaacagaataggtgggctgacccctgctctatgtggttctttgtccccaggcaaggattcagggacatctcagagccgctggggtctcgtcggtaaagtggtggtggacggcatggaggaactttagccctggaccagaaactttaggtcagtctatgtcagccattgttgctatcagccttcaggtcgtctgggctgggaggtctcctccctcttcctccaggcaccagtgggagcaggcagtcacaccttcctgtgagtgagaaccatagcagaaccttcaaagcacctctcaagtcgggtgagtcagcagaggcctgcagacagggttgacgggggcagggtgtggggatgtgggagacccagactgggggccagcaaaggctgttcggaggaggtgaccactgagctatgacctgaatgagtgaacgaggcagttattttatttttttgagatggagtttcgctcttgtcgcccaggctggagtgcagtggcacaatctgggctcactgcgacctccacctcccgggttcaagcgattctcctgcctcagcctcctgagtagctgggattacaggcggccgccaccacgcacagctagttttgtatttttagtagagatggggtttctccatgttggccaggctggtctcgaactcccgacctcaggtgatctgcctgcctcggcctccaaaagtgctgggattacaggcgtgagccaccgcgcccgggaacttcaagtgattcttgaaggagacaattatgtgggtccatggggaggagcctttgaggtggcaggagggaaccagtcctgatgagggaagattaaaggacagtggggctggggatggtggcccacacctgtgtttgcagcactttgggaggctgaggcaggaggatcactagagcccaagagttcaagatcagcctggcctacaaaaaaatatttaaaaatttgctgggtgtgggaggctgaagtcagaggatcacctgagcccagggagttggaggctgcagtgagcggtaatcatgccactgcacttcagcctgggggacagagtgagaccctgtctgaaaaaaaaaaaaattgggccaggtgcggtggctcatgcctgtaatcccagcactttgagaggccgaggcgggcggatcccgaggtcaggagatcgagaccatcctggctaacacagtgaaaccccgtctctactaaaaatacaaaaaattagccgggcgtggtggcaggcgtctgtagtcccagctactcgggaggctgaggcaagagaatggcctgaacccaggaggcggagcttgcagtaagctgagattgtgccactgcactccagcttgggcgacagagcgagactctgtctcaaaaaaaaaaaaaaaaattagccgggcatgggggcacatgcctgtaatcccagctattgaggaggctgaggcaggagaattgcttgaacccgggaggtggaggttgcagtgagccgaggtcgcaccattgcactccagcctgggcaacaagagcaaaactccatctcaaataaataaataaataataaaaaaataaaaaataaagagggtgggcatgatggctcaagcctgtaatcccagcattttgggaggctgaagcaggtggatcacttgaggtcaggagttcgagaccagcctggccaacatggagaaaccctgtctctactaaaaatacaaaaaataaaataaaataaaataaaataagccaggtgtggtggcgggtgcctgtcatcccagctaactgggaggctgaggcaggagaatcacttgaactggggagaaggaggttgcagtgagccaagacagctgcactgccctttaacccaggcaatagagtgagactatgtgtcaaaaaaaaaaaaaaaaaaggacattattagagttggaaggaaatgaccataggcccagggttccacggtccagaccaccacacacaactgatgcaggatataaccgagtcattccatcccaggtaatacccaagtacccacgggaggatcaacatccacggaaaagcctgtgtacaaatttcatagtagcaaatgcttctcctatgcgtcttttttttttcttttttcttttttttttttttgagacagagtcttgctctgtcacccaggctggagtgcagtggcacgatctcggctcactgcaagctctgcctcctgggttcaagcaattctcctgcctcagcctcctgagtagccgggactacaggcgcgcgccactgcgaggctaattttttgtacttttagtagagacggggtttcaccgtgttagccaggatggtctcgatctcctgacctcatgatccgcccgccttggcctcccaaagttgtgggactacaggcgtgagccaccgctcccggacacgtctggctaatttttttgtatttttactagagacgaggttttgccgtgttccccatgctggtctcaaactcctgggatccagtgatccacccaccttagcctcccaacatgctgggattacaggtgtgagctactgtgtccggcccaaattgtctaatttttaaaaatagtttctgggttatggatctgaataaagcgtgcaattagtgaacagtttataaacctcttgtgtgcttttaatttattttattttatttatttatatatattttttgagacagagtctcgctctgtcacccaggctggagtgcagtggtgcgatctcagctcactgcaacctctgcctccagggttcaagcgattctcctgcctcagcctcacgagtagctgggattacaggtacctgccagtatgcccggctaatttttgtatttttagtagagatggggttttgccatgttggccaggctggtctcgaactgctggcctcaagtgatcctccctcctggccctgcacagtgctgggatgacaggctgagccacctcaccggcctcttatgtgccttttaatctgcaggttcgccctccctctctctttctgtggtttgtttttgtttttttttttctttttttcttttgtatgaaacccagttgtttttcctgttaagtttcccacagtctagaatttgctgatttttttctgtgataatttaagtttttgaatagtgatgcattcccgtgtcgtaaaactgaagagtcaaaagcatacccagactgcagccgctggggaagagtgtggtagctccacaagaagttaaacggaggcggggtacgggggctgggcgtggaggccgggcgcaggggcggatgcctgcaaccccagcacgctgggaggccaaggcgggcggatcacttgaggtcaggagtttgagaccagcctgactaacatagcaagaccccatctctacaaaaaatacaaaaaaattagctaggcatggttaactgctgtttttgtcaagatgggttattactatgttgcccaggctggtttcaaactcctgtcctcaactgactcagaaggatcaacttagcccaggagttcaacatagcgagaccctgtctctacaaaagaaatgttaaaaaaattaaccaggcctggtggcatgcacctgtactcccagctacttgtgaggctgaggtgggaggactgtttgagccatggagtctgaggctgcagtgagctacgattgcacctggaacccaggcctctcccgtctggaacccaggccctcacctacactgtcagcccctccacctggaacttgtagaacttacctgtaagcccaggcttcacctgaaaccccagtcccccacctggaacccaggccctcacctacactgtcagcccctccacctggaactttagaacttacctgtagccccagccttcacctgaaaccccagtcccccacctggaacccagtcccccacctggaacctgggcctccccaacctgtaacccaggcccccacctagaacctgggcctctgtgatctgtaacccaggccctcatctggaacctagggctctgtggaaactgtggcactcacatgtaaacctggcttccacctgaaaccccagtcccccacctgtaatccagcttgggtgagacagcaagaccctgtctcaaaaaaaaaaaaaaaaaaaaggccgagcacggtggctcacgcctgtaatcccagcactttgggaggccgaggcaggtggatcacaaggtcaggagttcaagactagcctggccaatacggtgaaaacacgtctctaataaaaatataaaaattagctgggcatggtgatgggcgcctgtagtcccagctactcgggaggctgaggcaggagaatcccttgaaccgggagacagaggttgcagtgagccgagatcgtgccactgctctctagcctgggcaacagagcaagactccgtttcaaaaaaaaaaaagggaataaatgtcatgttacatatattttatgagaattctaaaatatattttatggcagggcacagtggctcacgcctgtattcccagcactttgggagtctcgctctgtccccaggctggagagcagtggtgcgatctcggctcactgcaacctctacctcccgggttcaagcgattctcctgcctcagcctcccgagtagcttggactacaggcgcccgccaccacgcccggctaattttttgtatttttaatagagacagggtttcaccgtgttagccaggatggtctcgatctcctgaccccgtgatctgcccccctcccaaagtgctgtgattacagacgtgagccaccgcgcccggcctattattttttactttttttttttttttttgaggcggagtcttgctctgttgcccaggctggagtgcagtagcatgatctcggctcactgcaaccaccgccttccaggttcaagcgattctcccgcctcagcctcccaactagctgggattacaggtgcccgccaccacgcccggctaatttttgtatttttagtagagatggggtttcaccatgttggccaggccggtcccgaactcctgacctcaggtgatccacccgcctcagcttcccaaagttctgggattacatgcgtgagccaccgcgcccggcctatttttcacttttttttttttagccgaatgtggcgaggacagttatcggattatttgcagcggatcctacacgtcccctcctcctgcctcttgccctgcgctcccgaaggggcctccggacccggaggatctcaccgcggggcggggtccacggcgagggggctcggccaagcgggcagcctcgcgcacgcgcactcaacccggacgcgggcctctccgccgcagcccgcgcccgccacctggcggccacagcggtccgcgcagaccgccggccccttttctatccgcgaccggatacctggcaggggtctaggaaagacccctctggctgctgcggggccagtgcgtgcgaggctcgaccccactccattgcgtgggggggctgagctaggtccgtgaagcggggcggttgcgatcaaggccccgactttttttttttttttttttttttttttttttttttgagacggagtctcgctctgtcgcccaggccggactgcggactgcagtggcgccatctcggcgcactgcaacctctacctcccgggttcaagcgattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaaggccccgacttttagaccactagtggaggaggtctgggacacgggtctgcggccagagagaggccaggagggaggactggcgggcatttctccgcagggtgggggtgaacgggggcctgggcatcggagccggggggaacgtggggtcagcgaggggttctaggggaggaaatggtaggagagctcctgccctgcaggctggagggcaggatctgtgtgtttggggggagtcatgggtgggtaggagagatgacaggtgacagcctggaggaagagatggagggaggcttgagccctgggcggggctggcagaagcccccacctataacttgggacctctgaacctggaacccagcccccacctgggacctgggcctctcccatctgtaacccaggccctcacctagaacctctgaacctggaacccagcccccacctgggacctgggcctctcccatctgtaacccaggccctcacctagaacctgggacctctgaacctggaacccagcccccacctggggcctggaacctccaccaggaacttgtgcccccctctttggaacccttgccttcacctgaaaacccagttaccggctgggcgcggtggctcacgcctgtaatcccagcactttgggaggccaaggcgggcagatcacgaggtcaggagatcgagaccatcctggctaacacggtgaaaccccgtctctactaaaaatacaaaaaattagccaggcgttgtggcgggcgcctgtagtcccagctactcgggaggctgaggcaggagaatggcgtgaacccgggaggtggagcttgcagtgagccgagattgcgccactgcactccagcctgggcaacaaagcaagataccgtctcaaagaaaaaaaaaaggaaaacccagttccccacctagaacccaggccccgacctgaaacctgggcccctccacttgtaaccagggacccccacctagtatctgagcctctcccatctgtaacccaggccttcacctagaacctgggcctctgcaagtgtaacctggggttcctaccaggaacctgaggccctcatgtgtaacctgcggcccccgacctggagcctgggcctctctcatctataacccagaccctcacctagaacctgggcccctgcaactgtaacctgtggcactcactgtaagcccggacttcacctgaaaccccagtcccgcacctgtaaacctacaccccgccaggaacctgggcctctccaacctataattgaggccctcacctgtaacttaagcccacacttgtaacctggggctctctgctataacttggggcccccacccataagccagttcccttaacagaacctgcagtttggtgaggatgagagaatgcaaagaaagcattttccccaggactaccataaatagtcataagcatcactttttcctattaccatagcattaccatttgtcacggtttacccacccgaggtcactctgcctctttttcactttattttttttttatttttatttttttgagatggagtctctctctgtcgcccaggctggagtgcggtggcgcgatctcggctcactgcaagctccgcctcccaggttcacgccattctcctgcctcagcatcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaaggccccgacttttagaccactagtggaggaggtctgggacacgggtctgcggccagagagaggccaggagggaggactggcgggcatttctccgcagggtgggggtgaacgggggcctgggcatcggagccggggggaacgtggggtcagcgaggggttctaggggaggaaatggtaggagagctcctgccctgcaggctggagggcaggatctgtgtgtttggggggagtcatgggtgggtaggagagatgacaggtgacagcctggaggaagagatggagggaggcttgagccctgggcggggctggcagaagcccccacctataacttgggacctctgaacctggaacccagcccccacctgggacctgggcctctcccatctgtaacccaggccctcacctagaacctctgaacctggaacccagcccccacctgggacctgggcctctcccatctgtaacccaggccctcacctagaacctgggacctctgaacctggaacccagcccccacctggggcctggaacctccaccaggaacttgtgcccccctctttggaacccttgccttcacctgaaaacccagttaccggctgggcgcggtggctcacgcctgtaatcccagcactttgggaggccaaggcgggcagatcacgaggtcaggagatcgagaccatcctggctaacacggtgaaaccccgtctctactaaaaatacaaaaaattagccaggcgttgtggcgggcgcctgtagtcccagctactcgggaggctgaggcaggagaatggcgtgaacccgggaggtggagcttgcagtgagccgagattgcgccactgcactccagcctgggcaacaaagcaagataccgtctcaaagaaaaaaaaaaggaaaacccagttccccacctagaacccaggccccgacctgaaacctgggcccctccacttgtaaccagggacccccacctagtatctgagcctctcccatctgtaacccaggccttcacctagaacctgggcctctgcaagtgtaacctggggttcctaccaggaacctgaggccctcatgtgtaacctgcggcccccgacctggagcctgggcctctctcatctataacccagaccctcacctagaacctgggcccctgcaactgtaacctgtggcactcactgtaagcccggacttcacctgaaaccccagtcccgcacctgtaaacctacaccccgccaggaacctgggcctctccaacctataattgaggccctcacctgtaacttaagcccacacttgtaacctggggctctctgctataacttggggcccccacccataagccagttcccttaacagaacctgcagtttggtgaggatgagagaatgcaaagaaagcattttccccaggactaccataaatagtcataagcatcactttttcctattaccatagcattaccatttgtcacggtttacccacccgaggtcactctgcctctttttcactttattttttttttatttttatttttttgagatggagtctctctctgtcgcccaggctggagtgcggtggcgcgatctcggctcactgcaagctccgcctcccaggttcacgccattctcctgcctcagcatcccgagtagctgggactacaggcgcccaccaccacgcccagctaaattttgcattttttagtagagacggggtttcaccatgttagccaggatggtctcaatctcctgacctcgtgatccaccctcctcggcctcccaaagtgctgggattacaggcatgagccaccgtgcccggctcactctgcctctttatatccagagtgtcatcaaatttatgaattcaaggccaggcttagtggctcatgcctataatcccagctttttcggaggccaaggtaggtggattacttgatgtcaggagttcgagaccagcctgggcaacatggtgaaactccgtctttactaaaaatacaaaaattagctgggcatggtggtgggcacctgtaatcccagctactcgagaggctgagacaggagaatcgcttgaacccaggaggcagaggttgcagtgaaccaagactgcgtcactgcactccagcctgggcgacagagcaagactctgtctcaaaaaaagaaaaacacaggccaggaacggtggctcacacctgtaatcccagcactttgggaggccgaggcgggcggatcacaaggtcaggagttcaagaccagcctggccaatatggtgaaaccccgtctccactaaaaataaaaaaaaaaaacctagccaggtgtggtggcgcacgcttgtaatcccagctactcgggaggctgaggcaggagaatcgcttgaacccaagaggtggaggttgcagtgagctgagattgtgccactgcactccagcctggacaatagagggagactccatctaaaataaatacataaatgaaaatgtgtagatatctacgagttcggtggggattcatacaacagtgcatctcattcccgaccgtgtcttatctttgatgacagggtcatcgttaatcctccatccagagaaatgggaagttagaggccaggacctcccagctgaagatttctgtgggacacagggctgggccagagaaaagggccctgcaggagacccttagaatagccgccgggcgactggccccacggtgccgggaaggaccctttgatctgattccgccatatgatccggttccgtgctggcccagcctggcctgggttggatgcctggtccgatgcccaaagccccatcaccctgaagcagatggagctggcatcctgaatgagactcctgggggctccagggctctcaggtgggagtcccagagccaccagggacctggagtgtagacctgggcagggagcttgctctctgccagctgcagtgggctcacctgtgagggaggatgttagaatagttcttttttaaaaaaaaaaattttttttttgagacaggatctggctctgttgccaggcaggaatgcagtggcgtgatcatggctcactgcaacctccacctcccgggctcaggtgatcctcccacctcagcctcccaagtagctgggaccacaggcgcccgccaccatgactggtgagtttttgttttttgttttgttttgttttgtttttgagacaagagtctcactctgttgcccaggctggagggcaatggcgcgatctcggctcactgcaacctccgcctcctaggttcaggcaattctcctgcttcagcctcccgagtagctgggattacaggcgccagccaccacgcccggataattttgtatttttagtagatactgggtttcaccatgttggccacgctggtctccaattcctgacttcaggtgatccgcccgcctcggcctcccaaagtgctgggattacaggctgcgagctaccgcgcctggcccctagtttttgtactttttgtagagattggttttcaccatgttgcccaggctggtcttggactcctgaactcaagcaatcctcccgcctcggcctcccaaagtgctgggattataggggtgagccactgcgcccggccttgttttcttcttttcagtagagacagggtcttgttctattgcccacactggagtgtagtgacataatcccagctcactgcagcctcaaactcccagcctctgttgatcctactgcctcagcctcccgagtagctgggactacaagcgtgggccactgctcctggtctattttcagttttttttttttgtttgtttttgagatggagtctcactctgtcgcccaggctggagtgcagaggcatgatctcagctcaccacaacctcctcttcccaggttcaagcaattctcctgcctcagccttccaagtagctgggactacaggcatgcaccactacgcctggctaatttttgtattttttaagtagagacaggctttcaccatgttgcccaggctggtctggaactcttggcctcaagggatccgcccacctcggcctcccaaagtgatgggattacaggcatgagctgccatgcctggccctattttcactttttgactcttgtgaataacgctgttttgaaaattcatgcgtgtttgtgtgaacaggtttctagttctctcgggcatatatcttggggtggaattgccagtacatatagcaactctatgtttaaacttttgactcttttccaaaggggttgccccgcttatgagaattctggtttctccacatcctcaccaatacttgttatggtccatctttttttgttatttatatattttatctatttttatttttttgagacggagtcttgctctgtcgccaggttggagtgcagtggcgtgatctccgctcactgcaacctctgtctcccgggttcaagtgattctcctgcctcagcctcccgagtacctgggattagaagggtgcgccaccacgcccaactaatttttgtatttttagtagagacggggtttcgccatgttggccaggatggtcttgatctcctgacctcatgatccgcccgcctcggcctcccaaagtgctgggattacaggcgtgagccactgcacctggcctgttatttatgtatttatttttttttgagacaagttcttgctatgttgcccaggctggcctcaaactcctaggctcaagagatcctcccaaagttctgggattacaggtgtgagccactgtgcataaccctgaagtggttaattttaataatacatttactttagcctaacatatccaaaattacatcatttcaacatgcaatcattattaaaattattaatgagatattttattttatttttatttatttatttttttgagacggagtctcgctctgtctcccaggctggagtgcggtggcgcgatcttggttcactgcaagctccgcctcctgggttcacgcctttctcctgtctcagcctcccgagtagctgggattacaggtgcccgccaccacgcccagctaatttttgtatttttagtagagaccaggtttcaccacgttggccaggatggtctcgaactcctgacctcgtgatcagcccaccttggcctcctaaagtgctgggattacaggcgtgagccactgtgtctggccagtgagatattttatttgtgccctttttttttttttttgagaccgagtctcactgtgttgcccaggctgcagtgcagtggcacaatcttggctcactgcaacctctgcctcccaggttcaagcgattctcttacctcagcctcctgagtagctgggattacaggcgggcgccacgacacctggctagtttttgtatttttagtagagacgggggttttaccatgttgcccaggctggtcttgaactcttgacctcaggtgatcacctgccttggccccccaaagtgctgggattacaggcaaaagccgccataccaggcccatttttttttctttcgagacggagtctcattgttgcccaaggtggagtgcaatggcaagatctcagctccctgcaacctctgcctcctgggttcaagcgatcctcctgcctcagcctcccaagtagctgagattacgggcgcccgccaccacgcctggctaatttttgtatttttagtagagacagggttttaccacgttggccagactggtctcaaactcctgacctcgggtgatccatccgcctcggcctcccaaagtgctgggattacaggtgtgaactaccgtgcctggcaggcccatttttaatttttctaactttggaaattcagtgtgtagggcaggcatggtgcctcatgcctgtaatcccagaactttgggaggccgaggcaggtggatcacctgaggttaggagttcgggaccagcctgaacaatatggtgaaaccctgtctctattgaaaatccaaaaattatccagccatggtggtgtatgcctgtagtcccagctactccagaggctgagacaggagaattgcttgaatctgggaagcagaggttgcagtgaaccaagatcatgccattgcactccagcccgggcaacagagcgagactccgtctcaaaaaaaaaaaaagagagtcagtgtggagggaagtgtctctgttgggtccgggtgctctgtgggactctgaggaaaagctcgcaccaggtagatgctgttctgtccccatgggtaaaggacaccccaacaaaccgaggagcaaaatgtcctcgtatgccctcttcgcgcagacctgccaggaagagcacaagaagaaacacccggactcttctgtcaatttcgtggaattctccaagaagtgtttggagagatggaagaccacgtctgcaaaggagaagtgaagtttgaagagaaggcaaaaagtgacaaagctcgctgtgacagggagattaaaaattacattcctccgaaatgtaagaaagggtaagaaaggaaagaaaaaggatcgcaatgctcctagaaggccaccatctgccttcttcctgttttgctctgaacatcgcccaaagatcaaaagtggacacccaggcctatttgtcgtggaaactgcaaagaaactgggtgaaatgtggtctgggcagtcagccaaagataaacaaccatatgagcagaaagcagttaagctacaggagagatatgaaaagggtattgctgcatatcgtgctaagggcaaaagtgaagcaggaaagaagggctcaaagaagaacaaaccagaagatgaggaggaggaggaggagaaagaagatgaagatgaggaggaagagggtgaagatgaagaataaatggctatcctttaatgatgcctgtgcagtgggcttgttttgctaagaatgtgaattctagtacagctcagtattagcttcagtataaaactgtacaaattttcgtatagctcataagattctctgtacagaaaatacttttcttttcttttcttttttttgagacagagtttcgctcttgttgcctaggctggagtgcaatggcgtgatctcggctcaccgcaacctccgcctcccgggtcctggttcaagcagttctcctgcctcagcctcctgagtagctgggattacaggcacatgccaccacgctcagctaatttttgtatttttagtagagatggggtttcaccatgttggccaggctgctttcaaactcctgacctcgtgatccgcctgcttcggcctcccaaaatactgggattacaggtgtgagccaccgcaccctgcctaatgtccctaaatatttaatggtttttaaaaaatttattgtgtatggcagcacagcacacttgtaggaattagtatcaacagtacatcttgcgttttttaagatgctgcattttttaacattttgtaataaaattatgcgtatcaaaaaaacaaagaaattccgtgtgtagttcacactcacagcacatctccgtccaggcacttgagagaatgactaggaggggttcttggaggaggtggtctttgaacggagaatccatcttcaaggattctgtctgtaatggtcaccaagtatttcctgagtcacttccatgtgtcctgcagttctctgaaggggcgtgggacctaccgatgccaattatccagcattatctccagattccaagaagttggggtgtgagccagcaatcagtacagaaaagagataccaaaataagtttgagttggggagtgttccttcaacttcagttttctggaagagatcttttttttttttttgagacagagtttcgctcttattgcccaagctggagtgcagtggcacgatctcggctcaccgcaacctcctcctcccgggttcaagcgattctcctccctcagccttctgagtagctgggattacagacatgcacctgtaatttctactaaaaatacaaaaattagccgggcgtggtggcgcacgcctgtaatctcagctactggggaggctgaggcaggagaatcgcttgaaaccaggaggcggagattgtaccaagatagtttgttccagctaaacaacctggcgctagtgcaggaaaaggtggaaggcacggggctagcacaggagggttcaatattttcaaccttatcaagccatattttggcaactcttgtttttcacgagaagcccccgctgggcttgtcccagcgctgtcctgaggcttcccccatgagttccgatagggcagaggccgccctgagcgtttctctttcccctggtccaagagtggctcaaaagaaggatttttgactggaattggccactttgtgttactttttgacccttgacctcgccccaaagggggatgcgggggaggggctctggtaggggtggccccgctccttccaggtccgcaagcccaggttcccgcccaccgggctcagcccaccctgcggccgttcagggaggccgttggcacccgtgacctacgacccccttcccgagccccaccgaggtcacagccgtggcctcgtctccccatgcctgcttcccgccccctgcccgtgacgggcgtctccgaggaccaatgagcgcgctgtatccacccctcgggcggggccaagcgccgaccaatcgccgctcgggcgcccggccgggtccaaacgctccaatcgtcagcggcggcggggcgggcagagggccggggatggcaggttcaaccaacgggtgggcacgtcgtcctcgcgaggaggcgtgccctgcggccgggcgtgcggtgtccgcggcggcgcagggagggggagggaggtaaacaagatggcggcggcgtgtcgggcgcggaagggggaggcggcccggggcgcccgcgagtgaggcgcggggcggcgaagggagcgcgggtggcggcacttgctgccgcggccttggatgggctgggcccccctcgccgctccgcctcctccacacgcgcggcggccgcggcgagggggacgcgccgcccggggcccggcaccttcgggaaccccccggcccggagcctgcggcctgcgccgcctcggccgccgggagccccgtggagcccccgccgccgcgccgccccgcggaccggacgctgagggcactcggggcggggcgcgcgctcgggcagacgtttgcggggaggggggcgcctgccgggccccggcgaccaccttgggggtcgcgggccggctcggggggcgcccagtgcgggccctcgcgggcgccgggcagcgaccagccctgagcggagctgttggccgcggcgggaggcctcccggacgcccccagccccccgaacgctcgcccgggccggcgggagtcggcgccccccgggaggtccgctcggtcgtccgcggcggagcgtttgctcctgggacaggcggtgggaccggggcgtcgccggagacgcccccagcgaagttgggctctccaggtgtgggggtcccggggggtagcgacgtcgcggacccggcctgtgggatgggcggcccggagaagactgcgctcggccgtgttcatacttgtccgtgggcctgaggtccccggaggatgacctagcactgaaaagccccggccggcctccccagggtccccgaggacgaagttgaccctgaccgggccgtctcccagttctgaggcccgggtcccactggaactcgcgtctgagccgccgtcccggacccccggtgcccgccggtccgcagaccctgcaccgggcttggactcgcagccgggactgacgtgtagaacaatcgtttctgttggaagaagggtttttcccttccttttggggtttttgttgccttttttttttcttttttctttgtaaaattttggagaagggaagtcggaacacaaggaaggaccgctcacccgcggactcagggctggcggcgggactccaggaccctgggtccagcatggaggtggtggacccgcagcagctgggcatgttcacggagggcgagctgatgtcggtgggtatggacacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcggagacgctgtgcaggagggccgtcaagatcctcaagaagaagaagttgcgaaggatccccaacggggaggccaacgtgaagaagtaagtatggcttgctggggtcggggccgggccgggccagtcacggtgctgatggttctgtcttccttccttctctcctccctccctcccttacttcctcttaacaccctgagctggacccgtctggcgcctgtgtcctccgtgccagggagagcgtggttgggggcctgcgttacggactttcactcaggcaaggccagttgtcgcagcggggcgtgcgtttgcatgggctcttggactccagttaaaatgccctggtagcgaaaccctcctgagaagggagcggcccccaatcccctaagactagccccttggctcccccagctgtccaaggagcagaggcgcccagtggaatcagcctgtgtttgtttgggccccgagagtttgtgtgcggccgccaacacgttttctgcgcagtgtgtggccgttaccggggccaggcgaaatgtgatttgtttatcctgtcagaggggaaccctgggctgccaaaaataactgtttgcaccggcttatcagtcagcaggagggaaacgtagcctttcctcatttgccagggatgtgacgctggaagcatccctggcccccggggctggaagccctgcccgagggggactgtgcctccctcccgaattgcatccggaagaccttacttttccaactgacttcttcaggcacggggctgccgctgggcatcccggacgcctctgcatctgtgcgcggagaagctcctacctagggcagcactggccggcctgagcctctcccagctggtgggggtggccgggggtgtccctgccttatcgcagccagacacgctgcacctgccgccgcctggcgggccctgcccaggccctgctcctttcccagccttcttaactttcaaaactttgcctcctgtttccaagaaaggaccttatctgctgggctaggcctcgagggactggcaaggacaccctgcgcagggcaccatgaccttggaaggaggtccggggaggggctgctgcggtgtctgctctcaccttcctcctgctcaggggccctggggctcctgccgtgtctgctctcacctctctcctgctcaggggccctggggctcacgtacatttttttttttttttttttgagacggagtctcgctctgttccccaggctggagtgcagtggcgcgaactgggctcactgcaagctccgcctcccgggttcatgccattctcctgcctcagcctcccgagtagctgggactacaggcacccgccaccacgcccggccaattttttgtatttttcagtagagacggggtttcaccgtgttagccaggatggtctcaatctcctgacctcgtgatccgcccgcctcggcctcccaaagtgctggtactacaggcgtgagtcaacgcgtgcggcctttttttttttttttttttttttttttgagacggagtttcactcttgttgctcaggctggagtgcagtggagtggtcttggctcactgcaatctccgccccctgggttcaagtgattctcgtgcctcagcctcccgagtagctgggattacaggtgcctgccacagtgcccagctaattttttttttttttttttagtagagacggggtttcaccatcttggccaggttggtcttgaacttctgacctcgtgatccacctgcctcagcctcccaaagtgctgggattaaaggcgtgagccaccgcgcccggccagcacgcttcttaatcagcatgcaggctgtgacatgcggaaaccaggggcacaggctctgaagtttgtactctggagctggagcagtcagggttaaatgggagcggctgggaagggtgtgtttccacgaggcctttctgatgtctcagtgcccagtctggacccgggtagaaggtgtggccagtgccttgagtcagtggagcagttgcctgtgcctggtctctgtgagatgggttggtcaggggctaggcagagcctgtgcctggtctctgtgagatgggttggtcaggggctaggcagagcctgtgctgggggtagcaggtgccctctaaaggggccagtgacagtctctctcccagcagtgagaaacccacgcttaggggccgggcgcggtggctcacgcctgtaatcccagcactttgggaggctgaggtgggtggatcgcctgaggtcaggagttcgagaccagcctggccaacatggtgaaaccccatctctactaaaaatacaaaagttagccgagtgtggtggcgtgtgcctgtaatcccagctactcgggaggctgaggcagaacattgctggagcctgggaggcggagcttgcggtgacccgagatcgcaccattgcgctccagcctgggcgacacagcgagactctgtctcaaaaataaataaataaataaataaataaataaataaataaataaatctggcttgagttttgacaaatgtatatgcagggtcaatgggaagacagacgctggagggtggaagcctgactgtgagagtgagccccctgctttcctgaacagtcagtggaggaggtcctgggagctcaggtgagcacctgaacggtagggcagagcctgagggtcttggtggagacaggcaagaaggttgcaggaacctagtctggcccagtgcctgggagaacgggagggaacacggaggcagggaggcagaggggttggcaggacctggactggactgtgcgtcgcagctacccacagcttgaccccactgccttgaagtgagtgatgcaccctcactagtgttcagcgtccaatttcatcctggccctgagtgtgtaacggctttgcccttgcggggccccctgggatgaggggtgagccctgtcccttcctggtcactgtctgccatcaggagctgccccgcttacagctgtgattcaggagccactgcatttcctccagccccctgggtgctgccagggggtcctcctattctgggagctggtgtgttctgactggaggctgccatgtgcagagtgctgtcaaggagaaggggtgtccactgcccagccctgaggcccaaggccttggccagccttgctgccagcgctgcagggaaaaagcctcctttgtgtgtgggaagtttaataaactccgctcagattgtgtctcgcagcgagtgtctggaaccttccagacaagcctcaggcgtccggtcctccagttggtgtggaaagcgtgggcgatcaccaaggggggtgggttggggcagatggagccggcgtgagtcccgtctcttcccttccttcccagaaaggcagccctggagtccatgccttgtcccgctctcaccggcaaaaagtataatcttattagaaataggaaagttccaaaaagcatcaatgagttaaaaagagggctgggcatgttcggtcatgcctgtaatcccagcactttgggaggccaaggcgggtggatcacccgaggttgggagttagcctgaccaacatggtgaaaccctgtctctactaaaaatacaaaattagctgagtgtggtggcgcacgcctgtaatcccagctactctggaggctgaggcaggagaatcacttgaacccgggaagcagaggttgcggtgagccaagaccatgccattgcactccagcctgggtaacaagagtgaaactccgtctcgaaaaaaaaaagggctggggccgggcgtggtggctcacgcctgtaatcccagcactttgggaggccgaggcggtttgatcacaaggtcagaagtttgagaccagcgtggccaacatggtgaaaccctctctctactaaaaatagaaaaactagccaggtgtggtggcacatgccaataatcccagctacttcatctgaggtcaggagttcaagaccagcctggccaatatggcgaaactccgtctctactacaaatacaaaaattagccaggcgtggtggcgcgcgcctgtagtccagctactggggaagctgaagcaaggagaatcgcttgaacctgggaggcggaggttgcggtgagccgagatcgcatcattgcattccaggctgggcaagcctaggagagaagagcgaaattgtgtctcaaaaaaacaattaattaaaataaaatcagtgccataggctgtttctggtaggcagtgggttcctagggtggagcagggaagggctggaaagggtcgcctgtgcccagcccgactccccgtgcttctcgggggacagcacggctagctgctgctgcggagcccacagtggggttctgggggggggggtgcaggcagaaggccgccatgcctccctccccctttccaccccagtgagagtgggctcgaaggcagggagtctgcccgccttgtggagcctccgcagaggcacccagggctgccgtgagcgcacagcctggcggtgtcccacggccctgccctttcctgtcacttccacctgttgcaaaacactgtgctttcgtatcttttctttctacctgtttggaaatgtgaaaatcactgctgccgtaggaaacgggcccagatccgggctgtggctctcccatccgcaccgcccccgcggtgtccagccaggaggtgggaggtgggcggcactcagtgtgcctggttgcggcgatgattggcagatgcttggacctatggtaaagaggattttcgcgagctgggagtcagtcctggactttgtaggtctttacatcccaggcggcctttatggggttccagcatctgctgaggcccctgcgccagccatgtgaggcctgggtgtcctcgaggcctctgtttgtgcccctctctgggcagcgggagggagagctctgagacccagagggagctcaggggctgggcagccgcagaacagcgggggtaatgggtccactgggggttctgggctgtgcacacagtgggcttccggtgcccagccagctggggcaggcctggaatgttggttcctctctcaggatctggggcgctgctgtagctgtcggggaatcagtgaggcggctggacggcccgtatatcccacaaacgccaccgtattgctcaaactggactcaattttcttaacacctttttttttttttttttttttttttttggagacagggtctcactgtatcgccgaggctggagtgcagtggcgcaatcatagctctgggctcaggtgaccctcctgcccccaaggtagctgggactgcagatgtgcaccaccacacccgactagttttttgtagagatggggtttcgccatgttgtccaggctggtctcaaactcctagactcaagctatccgcctgcctgggcctcccagagtgctgggattacaggtatgagccactgcttcgccacgttcacctttatttacttatttatttatttttgagacggagtctcgctctgtcccccaggctggagtgctgtggcacgatcttggctcactgcaagctccgcttcagcctcccaagtaagctggaactacaggtgcctgccaccaagcctggctaattttgtttttgtatttttagtagagacggggtttcaccgtgttagccagtatggtctcgatctcctgaccttgtgatccgcccgcctcggcctcccaaagtcctgggattacaggcttgagtcactgtgcccggcccacctttttattttttattttatagagacaagggcttgctgtgttgcccaggctggtcttgaacccctgaccttaagtaatcctctctggcctcccaaagtgctgggattacaggtgtaagccatagtactgggcctaaagttcaccttttttttttttttttttttttttgagatggagtctcgctctgtcacccaggctggagtgcagtggcgtgatcttggctcactgcaagctctgcctcccgggttcacaccattctcctgcctcagcctcccgaatagctgggactacaggcgcctgccaccatgcccggctaatttttttgtatttttagtagagatggggtttcactgtgttagccaggatggtctcgatctcctgacctcgtgatctgcctgcctcggcctcccaaagtgctggggttacaggtgtgagccaccgcacccggcaaagttcacctttttaaagtgtgtaattcagtggcatatagtacattgacagagttgcacaactatcacctctatcagcttccagaacattcttgttaccccagaaggaaaccccgtctctgtcagccatcactccccattccctccccagtcccggcacccacgcattcccttcctgcctctggattggcctgtcctgaacatttcacacgagtggtgtcacacaccgcgtggccttttgcgtccggcttgtctcacggagtgtgctgtcctcaaggggcatccgcgccgtggcctgggtccgaacctctctgctgttcacggctgcgtcactttccagtgtgtggagggccacgctgcgtttgactgctcatctgtggctggacacttgggctgctcccgcctctgcctgtgaattgtggctgctttggtgcacgtgtgctcagccggcgtccctctagaatccttgagggccttgtttcagccacatcaggagggattcagggaccagggcacgcgggtctggagctgggtgttcctgggtctccatgtgcctcccagtcctgctctgagccgtgggaggccggggcgagggccaggcccatctcttccctgtatgatctgtttctaggcagacggaggctcctagccccacctctctgtgagcttgagtggcgtttatgactctccttcctatttcctgtcctgctaatcaacaagtcagctaaacagtccatgctgcctgggcaagcccagtaggcccctaacgtggcacctcggagcggctggcgatgccccaagagccgggcttccccctcctggaggctcttcctgttcctcgccaagctcttaggtttcgctgggcctcctcttctgctctttttctggctggagacgtcagaggaagcctggcgatctagagaagctgatgtgcacccatcatcccggaggtgactgccaccaggcgggggtggctccacccccactcctcccctggcataaatcgggggacgcacgtgcctgcgcagaatgccttggtcccttttaattaaacagacaacccagtgtcccttggtctatgctgacctgctcaggagtgcctgggctcttccacgtttcagctgctgtgtgtcctgctgctgtgaagtgtccccgttgaggtggaggcagggcagggcgccttcggtgagggcgagtcctcctgtgcccgtttccccatctgtagaatgatggctcatggaggagacatggtgtcggcaggtggtggccggcgcagggaggtttccaggagggagtcctccaccctcatttgcttttagggccgtgcagcctcccgagcggcccccacgaggctctgaggctgcatgcaggttgagctcctggcctcactgcccctcctcagggttaggactgtgctggagcctgggtgggtgtggggtggtccctgcacaggcagcaggaggtgggccagagcggtgctggacctgaaggcccgtggctccctcagctccactgaggaggctggaatagtgtcctgggccaccttccctgccggtagccggctcctgctgagggagggggtgctttcgcctcctggtggagcatcaggctcttggggcctgtgcgtccgagcatctggcctctgctgtctgaaaacagcaccttccccgccccccggccaccgcatctcctctgaatagaaggcaagtcttgcctcccaggaatggcctgtgaccttcatcagcgggggaggttaggggcacacagagccctggggaacaaggggatctggggctgagccgggcctctcgggcccaccccgagctctcctgagcagcctggcaggcaggaaggcgctgggccccggggcctttgccgagcccagcctcaccctcagcgtccccctcaatgccctgggtgcctgccaggctgtggacacaggccctggccagttctataaataaccttgccgggccctgctgggaattggtgccaccaccacatagcccagagagaacggaaacacagggcttctcagcgagcagaccaggcctgcggtgaccagtggaagtgggggacgctttcagggctgggcagcccgacagggcaccgggcacagccaggggccggaaccagttgctcactggctccgcttctgggggactgtgtccctctgtgccccgtccccatcacaccttgctttcccttcatcctgctctcctagcccctccccagactggcggccccttgtccaggcccagccccagcacagcctgcagccctggcagagctcaggccttggccttctgaggttgccctgagggcagtgagcaatgagccctgggactggtgcactgggagggaaaggtgagccaaggcttcctgcaagaggcagccctgagctgggggtggggaaggctgggtcgtgggatacccctgacaccccaagttttttttttgagatggagtcttgctctgtcacccaggctggagtgcagtggtgagatctcgactctctgcaacctccgcctcccaggttcaagcgattctcctgcctcagcctcctgagtagctgggattacaggcgcccatcaccacgcccggctaatttttgtatttttagtagagacaaggtttcaccatgttggccaggctggtttcgaactcctgacctcaggtgatccacctcggcctcccatagtgtcgggattacaggcgtgagtcaccgcgcctggccccccagctgttttttatgctccatgcttgggcttcctgttaagaattaaaaaagaaaaaaaaaactatggagatggaatttacatactgtacaactcattcgttcacagtgtacaattcagtggcattaagtacattcacacggctgtgcaaccactacttctaattccagaacgttcggtcaccccaaaagcaagccccattcccattgtgtcactctccatcccctccaccagctcctggccactctgaatccacttcctggctctggattggcttgtcctggatattgcatagaaatgggatcctgtcggccgggcgcggtgactcacgagagcaagagatccagaccatcctggccaacatggtgaaaccccatctctactaaaaatacaaaaattagctgggcgtggttgcgggcacctgtagtcccagcgactcaggggctgagtcaggagaaatcgcttgaacccgggaggcagaggttgcagtgagctgagatcatgccattgcactctggcctggcgacagagtgagactccgtctccaaaaaaaaaaaaacaagaaatgggatcctgtcatcccagcgttttccgaggccgaggtgggcagatgacttgagcctagtagttcaaacgagaccagcctgggcagcacggtgaaactgtctctactaaaatacaaaaattagctgggcatggtagcacacgtctgtagtcccagctacttgcggggctgagatgggaggatcgcttgagcctgggaggtgcactccagcctgggcgacagggaaaccctgtctcaaaaaaaaaaaaaaaagtgcatcacacactgtgtgtcctttagtgtctcactgtgacatcctcaaggtgcagctaggctgtggctcgagtcagagcctcactggtttttgtggctgagtcttgttgagtgcgtggatgggctgtgctgatcctcgtctgtggaagggcccctgggtggttccacatctcggctgctgtgcgtcctgctgctgtgagcatctcgtgctccgtttctgcgtggcgtgtactgttcctcagggtgtgtacctgggagtggagctgctggctcacagggtaacagacctttggagaagctgcagacgcttccacgcccacccactgggtgtgaggaccttgctcctcgtcatttttgtttttgtttaattttttcttttatgagacagggtcttattctgttgtccaggctggagtgcagtagcacgatcacaggtaactacaggctcaagtgatcctcccacctgagcctcccgagtagctaggacttgaggcacgtacctccacacctggctaatttttgtatttttagtagagacagggtttcgccgtgttgctcaggctggtctcgaactcctgagctcaggtgatccacccgcctcggcctcctatagtgctgggagaaatgaagtgtctgcgacagggcggcagctgcagagggggctgtgctctctggcctgttgtgccccacccttgtgacaggcaggtgggcgtggccaactgggcggcagctgcagagggggcagtgacaggcgggtgggtgtggcaggaccccacaatgtctctttctgtggcgtctccttcttcgcctgccccttcctatgggccatccttccagctcacctgcggcccaccctccaaggagtgggaccctcggagttgggagcccttggctgcgtgggactgtactgtgtgacggagccatcaccagggctccaactcaccctggctcctgccacagtctgggctccatctgtgctaccattgcagtagtctggtttctaggaagcaaaactgttactgagttacaaagctcaattaagagtgtcctttgggaggccgaggcgggcggatcacaaggtcaggagatcgagaccatcctggccaacatggtgaaaccctgtctgtactaaaatacaaaaaaattagccggctgtggtgacacgtgcctgtagtcccagctactcgggaggctgaggcagggaaatcacttgaacctgggaggcagaggttgcagtgagctgagatcgggccaccgtgctccagcctagggacagagcaagactctgtctcagaaaaaaaaaaaagtgtcctaactgtgtcctccaaagccctcgccggccgatgacagactagagggcgctgtgctcccaccccctaccgccctgagcctggacgcgtggcccctgcagggccctttcccacagcactgtgaactcacagcttctctctagggaagggaggaggtacgccacttccacagggagatggggaggccgactccagggatccaggccatcatcctgacgttgggtcggctgatacacccctgtcctctctgtcccagggaaattcaactactgaggaggttacggcacaaaaatgtcatccagctggtggatgtgttatacaacgaagagaagcagaaaatatatcctttccggtgttgggaccgcggggcctccgtgggaggggctggggccctgggtccgcctgcctcgaggcctgctcctcttcccgtctccttgaaggagactggcacacgagggccgtggccttccctggttccccggaagtcagccattgtggcaatggctgcgcagcttgctgaaaggggccctgagccctggcccctgtgtcttgggcccgtggggtgtcaagtcccttttttctcagagtctcctcccaggctaaccaggggtgtagccacggtctgcctgagacaggccacgcgggctgaccgttgtgggccattttggtcgtggctgggcgtgtcctcgtgtcatctgtggacacccccatgggtcttacgggcacagcctccctacggggactttgcttcctaaggccctgtgcccagagcaagagccagaagtggtcctgaggctggggctgtgttccctgagccacgcggtcaggggccctgggaccgtcctgcatgggcccgagcctgcttgggggggcgtccaggaggcaccatcccccgcccatgggcagggtgggggacgtgagccccgcaggaacgctgccccaagagtcagccctgtcctccccttccccgtaggctccttcctcctgggacgctggggcccctgggccttttcagaggggtggctgagggcagggtgggccctggtcccgaggaggggcaaggtgggtgcagagggtccctccagagccccttttctggcccccgtgctccctgggcctgtgagtggggccgccccctgagctgtgtgtccttagcgccccacgtatatggtgatggagtactgcgtgtgtggcatgcaggaaatgctggacagcgtgccggagaagcgtttcccagtgtgccaggcccacgggtgcgtgcgcggggcaggggccagggtggggcgggggccgggggccaggcagggcaggctcctttccgtgaggccacactgcttgtcctgatattcattgacatgaaggcccaagtttttttgtttttttgtttttttgtgttttttttcgagatggagtctcactctgtcgcccaggctggagtgcaatggtgcgatctcggctcactgcaagctccgcctccgaggttcacgccattcttctgcctcagcttcccgagtagctgggattacaggcgcccgccaccacgcccggctaattttttgtatttttagtagagacggggtttcaccgtgttagccaggatggtctcaaactcctgacctcgtgatccgcctgcctcagcctcccaaagtgctgggattacaggcatgagctaccacgcccggccttgtaaaggcccaagtttttaaaaacagttttggggtcccccatgtgtggcatccacaggcagggctgctgccaacctcccgcctccatctttgctgggcctgctgcctgaggccagtggcctgcttccagcccatcgctggcagccgcctgccctgaccagatctcctggatgcaggtctgtggcctcagagtcagggccccttgctgctgcaggaccacaggggcagggaggggcctgctgttccagcaagactttggggtgcagccggcctgtggcccacaggaaaatgagacctgtggacatccggggccctgccagacgtggctcggccggacgagggtggccactgcaggcgcaggtgtggctccctgctggacctagcctttcctctgtcctgtgtgcctggacttctgtgacttcccagctgggcctgtggtgtttgggaggctcccaggcagctgcaaaggggacccctgtgaggggcagggaggcctcggccccaggacgggtgtgtgctgcccgcaggtacttctgtcagctgattgacggcctggagtacctgcatagccagggcattgtgcacaaggacatcaagccggggaacctgctgctcaccaccggtggcaccctcaaaatctccgacctgggcgtggccgaggtaggcacgtgctagggggggccctggggcgccccctcccgggcactccctgagggctgcacggcaccgccacaggcactgcacccgttcgcggcggacgacacctgccggaccagccagggctccccggctttccagccgcccgagattgccaacggcctggacaccttctccggcttcaaggtggacatctggtcggctggggtcaccctgtaagtgccccgcccccccgggcactcaccacacgcacactccgaggggcctctgcgtcttgggcagctgccggcctgtgggcgcagggcgtggccaccggcccagaccctctctggccacagccgctagggggtgcttactttatggaaatgtaactcatacggcagatggtggttcacccgtgtgaagtgcagcctggcccgtcagggatcttcacagagtggcacggccgaccctcctcccagagccccacagggaagctgggcgggtgacagcagctccaggccccttccccgggtgggtccagaggacactcccctcctaccccgtagcctccactagtggaaggtggtgaagacagaggtgtccttgagtccacagggcctctggtccagcagccacgggacgcctctgtccctggggtagagctggggctcctagggcgtcaaccaccttgactgaccacgcctttcttccctcccctcgaaatgaagctacaacatcaccacgggtctgtaccccttcgaaggggacaacatctacaagttgtttgagaacatcgggaaggggagctacgccatcccgggcgactgtggccccccgctctctgacctgctgaaaggtgggagcctcatccctctgcccgcagccccagggaggcggggcttttgtgcagaaatgtagggttgggggtgtcaggtggggggctattggccccgagaccccagcaggcattgagaggactgagtggagaggccgacctccccgcagggcctggtttgccaggtccctcagctccaccctgcttctgggccctgttcaccctccgaactcccaccccagagggcagtgctgccctgcgcctcccccagccccaccctcgggggctccctggcttgcagggtctgtcagggttgtcctgctgcacttcctacgcatggcagcaggtggcactggccgtccgtccatctgcccagtggccttgggagaacggaaccgccctggccgtccagcccagccctgtctccctgccagccgcgcacaggctgtccccggcatgtcccaggagtggagtggcctctgtcagggagaccgcctgtgcgcggggtcccccttaggagcgtccaggtatcacccagggcctgacaacagaggctgggcaggcggggacggttggtggggtctcaggcctgtgcccagctgacaggctcctcgccggcttctcctcagggatgcttgagtacgaaccggccaagaggttctccatccggcagatccggcagcacaggtgagcggcccctgggggcagtggggccgaggctgcagggaggccggccatgtgggcagctggttgagcgggcgctagagcagggcgtggtgggggtgccaggctgggctggggccagaccccgtgcagcgcccgcagttctcggggcccgagtggggtctctgggcagtgtcctgttaccggccagacccaggcgccttgtccgaactggggtctgagtgaggacatgcgtccgtccctgccctaggcatggagatgcgccaggaagggcacagctggtcccaaacactggcgagagcctctctttttcccctcctcctggggctcccagcagcagggtgtggctgggatccagcccagggcccccagctccatgacagggaagacagagcagcggacggggtcagcaggccccacagtgccgcctccctcacttcgtgggctctgctcctctgcaccagcccctggaggcccttgagccgtctgctggagcccctccgagccccgaggccacccactgagaccggctctgggagtgggagtgtccggacccctgaggcgctggtgctgattgtgccttgggggtctctgcacagctcgggtcatctgggcgcctggcggggactggggctgccccccgatagcctcctgggctgggatgtgctcagggccccccagacccccttctggcctttgctggctttgcagccagcatccatctggtgggtgctggcttctgagtgccacctgggacacaggcctcagggtggaggggacatctgtcaggcttggagtcaggtcagcctgcctgctcctagaggacatggctgagcttctgtggtcacagccaccccttgcacggcctggtcccagctcctgagtgtgtggcaggtaccctgggcccagaggagctgggtcggaaaactggaccgccctggtgccagcctgacaggcgccactgcttctgggcgtttgcagctggttccggaagaaacatcctccggctgaagcaccagtgcccatcccaccgagcccagacaccaaggaccggtggcgcagcatgactgtggtgccgtacttggaggacctgcacggcgcggacgaggacgaggacctcttcgacatcgaggatgacatcatctacactcaggacttcacggtgcccggtgagtctggcgggggcccctgcccggctctgctgactcggccaggatgtcccacgggagcagggtgcctgcctgtctgcaacaaggacagcttctgccctctggtggccaatcccacgtccccaaagcctccagcccacctgcaggctgcctccgccctgcgggccgctgggacatggctgaaaggtgtggggtcagcgggggcaccagcccaggcctgtctggccaggagggttcctcaggcgtctctccgggtgctgcccagccaggcaccacccaccggccttggcctgagtcccagcaggagcaggcgggggagccccagggtcgggggagggtaggtgagagtcagggtgcagggtggcccctcagacagctggcatgagagagggtccagtggccctccctcccgtcgtccctgaggcctgcccgctggccctgatgccggccgcccttcttccctaggtggcgaggaggcgtctgaggcagggcttagagcggagcgcggcttgcagaagagcgagggctcagacctttcaggagaggaagcctctcggccggcgccgcagtagtgcctgaggaggagctcagggccttagcgtaggggcggcccacattggcagccagcccctccccgccatgctcccggcttggctgtgttcggcccagggctgggccgtgtcataaagagttttgcagtgtatctgcagggtggatgcttgctgcgctcgggctggagcctgagggggctttctgctttactgtttcagcgggaagtggtgggcaggggccggcctgagaaggggggtacgccaggcaggttgggatgtgaggacccagtgcacagggtccacccccgggcccgagggtcccagaatagtgggggccctgcagagagccccccattaggtccctcagcactcctgggcccctcatcaaacccctaggctcagctcagtagctggtccccaggagagtacagtgtgggggcccccgagagcacagtgtatgggggtccccggggggtacagtgtctgggggccccccaggaggatgcagcatgtgggggccccccaggagggtacagcgtgtgtggggcccccaggatcacagggtctcagctcctgggctcttggatttgcagcaccacgaccatcgcgtctggtctgttggaacgggaggtgctgctgggtaccctggtcactagggtgtgctgggaggtgggggcccctcatggtgcccatccttggggcctggctgcaatttgaccccaggcccagggtcttctgcctttcagagccctggtgccctgagacgggcagccaggcaaatcccaggcaggagggccagttagggcagggccagcccaggcaggttgcgagagtccctactgggacgtggaccacacgctgacccccacggccgcccctgcaggccaggatccctgagccaggacccggcactggcttccctcctggggaccctcaggcctgtgtgagacctgggctgccctggggtgaggtgcctgggaggagagcaggggctgggccacctttttcatgaccctgctaagcccactgtgggtggtgaggaggagtacccagcagggggaagggccgccagaccactcggcatggctgaggcctcagtactcagtactgggtactcaggtggacgcccctcccactgctcagatgctggggacaggctcaacttcaggcttcagcgtgagccccgtccctgacctgcagagcccccttgcgttggggcaggacagcccggcgccctcgggtcaggccatcctctgcgctctgccggggctgctgcatcggcctctgcgtgcctccactttggcctcacgtgtccctacccaggatgcgggtcctgctgccaacacccagatcccagggaaggggcttgggctagatcctgggcaccagtgcagacaggagtgtggggtggggcaagggcccagtggcggctgtgcccgctgatgcagagctggggcaccttgtccacagggtctgccccaccagagacgggctgggcccaagctcagacctatgggtgcaattggtgcctcctcaccaaggtcttttttatctttttttttttttggagacagagtcttgctctgtcgcccaggctggagtgctgtggtgcgatctcggctcactgcaacctccacctcccggattcaagcaattctgcctcagcctcctgagtagctgggattacaagtgcgcgccagcatgcccggctaatttttgtatgtttagtagagacgggggtttcaccatgttggtcaggctggtctcaaactcctaacctcatgatctgcccacctcggcctcccaaagtgctgggattacaagcgtgagccaccgcgaccggcccaaggtgcttttttaaagctagtgacttcctgtgcacatggggtgggtgtgtggcaagttctggaagctgctgagtcagccactggtccattctcggagctggggctctgcactgggcacatgagctctggggcagcccggggcggcctcccactgacttcgcccgggaggggcctcggggatggctcggcagccagtgtgttcgcggagtcctcgccaaccaccacggctcctcgcagggacagtacgtgggcagcttcctgcactttcccctgccattgtgagaacagtgtccacctgggcagggtgggcagccccaggcctgtgggtttcaccagggtgctggtgatggttggtggctagcagggactgggggcagctgggggccctggcaggctgagctctgctccccgcgtggttctgtgctggcatttcgcgtgcctggcctgagcctggcccgagcctggccctcctgtgtcctcacagatgagcatgtggcggctcctgggcctctagaaccaaccatgggccagggtgccccaggggagcacgggagggtcctgccttgtcagcttgcctcctactcgtgaggttcctgcagtcagtacctgggtggggtcccacctgcggccatggcaggtgcaacagacgtggtggaggggacactcctgcccaggccatctgcgggaggctcagccccggggggtgcctcccagagctgctggggggcagcatttcaggctggatacacctgggcctgacccgggggcgggcatggcctgggcagcagctgtaagtgcgtccccgtggtgggggccagccaggtccctgtggctctggggttgcgcccctcagctcaggccacacttgccgtctccctcccaggacaggtcccagaagaggaggccagtcacaatggacagcgccggggcctccccaaggccgtgtgtatgaacggcacagaggcggcgcagctgagcaccaaatccagggcggagggccgggcccccaaccctgcccgcaaggcctgctccgccagcagcaagatccgccggctgtcggcctgcaagcagcagtgaggctggccgcctgcaggtggggcgcggcggggcccgggtggggcatgtggggacaacgcctggatgccacagccagccgtgagcatagcccgcgctagtcagtcatggtgaccgtcacgtggctgcgcgtggttgccatgtggcctttgggtggcttggccacgtagcgatccccgtggagggtgccgtctcggggcctggtgtctggccagcgtgctggtcatggaggcctacgtgtggcggggctctgggggggcgtgccgtcctcacagccacctctcagagtgggtgcattccgaggaccctgccctgggcctggcgccccctccccatgcccgcgccgcttccaggaaaggcttatgctgggctcagcccagaggcttttgagcaccagtgggtggtgggtggtggggaggggccgcggcctccatggctctgccggggtgccgcaggctctgagccagctgccaagtatggctgaggctgagtcgtgccggacgctgccctgtctctccctgtgtgcctgcctcctctcccagccccagccccagccccgggtgggagacggagtcccagaggtgtcagagacccttaagtcacctgccgaggatgcggggtggatgggggcccgaggctgaagcccctgccttgccacagcccctctcccaggttttgggggccaccgcctgagttacatgtctgtcccccaaatgggtgcccacagcccatccaccagcgtcagagcccgccaggccccactgcaaaaggccacacaatgtaccccgggagtgactcaagggtggccttccctggcctcccctgctgccccccaggagtccggtagccccatgactgtacctcagcttctccatcctcccaggggcccgcgggaggcggagaaccggtgcccaggctgacctcttccgtcttccttccaccctgcagcccgtgtccaggagccccgccaggtgcccgcgccaggccctcagtcttcctgccggttccgcccgccctcccggagaggtggccgccatgcttctgtgccgaccacgccccaggacctccggagcgccctgcagggccgggcagggggacagcagggaccgggcgcagccctcccccctcggccgcccggcagtgcacgcggcttgttgacttcgcagccccgggcggagccttcccgggcgggcgtgggaggagggaggcggcctccatgcactttatgtggagactactggccccgcccgtggcctcgtgctccgcagggcgcccagcgccgtccggcggccccgccgcagaccagctggcgggtgtggagaccaggctcctgaccccgccatgcatgcagcgccacctggaagccgcgcggccgctttggttttttgtttggttggttccattttctttttttctttttttttttaagaaaaaataaaaggtggatttgagctgtggctgtgaggggtgtttgggagctgctgggtggcaggggggctgtggggtcgggctcacgtcgcggccgcctttgcgctctcgggtcaccctgctttggcggcccggccggagggcaggaccctcacctctcccccaaggccactgcgctcttgggaccccagagaaaacccggagcaagcaggagtgtgcggtcaatatttatatcatccagaaaagaaaaacacgagaaacgccatcgcgggatggtgcagacgcggcggggactcggagggtgccgtgcgggcgaggccgcccaaatttggcaataaataaagcttgggaagcttggacctg

SEQ ID NO: 209 - DNA, 93236 bp, Homo sapiens
  source 1..93236: mol_type = genomic DNA
gggccgtggacgcggcggccccgcggcgggggcagcgggcggcgggggcggaggcggccgctagcgccctgcccggcgccgcctccttcggcgttcgccccacggaccggcaggcggcggaccgcggcccaggtgcccgggggcgggcgggcgggcgggcgggaacgcgcgcgggggtccgcggtccgggcttcccaggtcccgggacccggagggcggcggacgggggaggggcaggggctgggcggcgcatgcgcggggcccggggtctcggggtctccgggtcccggggacccgggggcccggggtgcgcggctggggacctgagggcgaggagcgaggacacacaccgaggactcttgcgagggatctcggggcccagctcggcctccctcctagcgctgggggcctgcccggaacccgagtccgcggctgtccctggggtttggcgctgcgcggaggtcgggtctggggaccgcagcgactctgggtcttcgggttgtcccctcggagggagggcccacgggcggggacatcgggacttgccctttcctcggcgcagcggagctggggcgtcgccgactcagaaggtgctttccgagacctccagggatctccgaggcgaggaaacccgggccccggacagaccgaccctgggtgggtgcgcccggcttctgccgtcggacggagacgcgcgtgtttgttcctccagctgcgaccacctttgaggaacggttcccactttgtgccccaacgcggcggggcgaccccggacaggctgcgctgggccgggtggcttctctgcggaagccgcgccacgtcgctcccggtcggggccgctgagggtcgggcgcccaggtctttccggagtcccgggctgcgcggcccgcgtggtgcgggtgaagctggaggggcgcggggtggtgccagtggaagtcaggagggtcggccctgccccctcacgcaccccaaccgggcacaactgcacgcctgtgcttttctgaagtcttttttaaaagttaaaagagaggaagtgtgctccaagtgtcaggattctttccaagaaaaacccacagttgtccaatggcctgggcttcgtgggacctccggggctgcacgcccacgtcagcctcagccgacccctgccaggaaaccagggaggcccctcctctcccagcctccttgggataagggtgccttggggaactgggtcagggcaaggacacgggattttcctgggaaggaccctgcgacacccgtgtcgttgcggggcagggtcagcatgactttcctcttccaaggtgaagagttggggggcatccagagaacaaccgtaatcacttcctccttcaccttcttactgccaggctgaagctcagggccctgtctgctctgtggactcaacagtttgtggcaagacaagctcagaactgagaagctgtcaccacaggtaaatagaaggtttaatttactgtttccagatggaaatatttaagtgttttcagtgtttacttctgttgcactacagaccagcaatctgggggttattactttgtgatgcaaggttagatacgttttcagactgaaagtaaaatacatgtgcatggattcattttttttttttttttttttttttgagacggagtctcgctctgccgcccaggctggagtgcagtggcctaatctcagatcacagcaacctctgccactggggttcaagcgattctcttgcctcagcctcccgagtagctgggattacaggcgcctgccaccatgcccagctaatttttgtagttttagtagaggcggggtttcaccatcttggccaggctgatcttgaactcctgacctcatgatccacctgttcctcccaaagtgctgggattacagacgtgagccaccgtgcctggcctaggattcactttgaagttctgagttattgtgtgacttttgctaggaacttcattgcttcgtggcaggcatgttttgtataatttaaaacttgatgacattaactttgagaaacgtgagtgcttactagacccttgggatgtccacactgactggtaccgagtagtgtactgtctctgagctgttttcattttgatttgaatattaagcagatggcttcttgagatagacccgtgccagaacatgccagggataggctgaagaaacgggccagatgatacaaatttgtgtggtcaccatccatgagagaccagggacactggggctgatgatgacctctgcaactctgaagcaaaagtaaactaattggcaagttgggtgcggtggctcactcctgtaatcccagcactttggaagctggggtgggcagatcgcttgaggccaggagttcgagaccagcctggccaacatggtgaaaccttgtctctacaaaaaaatagaaatattgcctgggcatggtggcggacatctgtaatcccagctactcaagaaactgaggcaggagaatcgcttgagcctgggaggtgaaggttttagtgaactgagattgtgccactgcactgcagcctgggcgccagggcgagactccgtctcaaaaataaataaataaaataaaattaattaactaattgacattagaaaaaaatgttttttctttcttttcccacatcctttttttttttttttttttttttgtgacagagttttgctcttgtcacccaggctggagtgcagtggcatgatcttggctcaccgcaacgtccacctcacggattcgaacaatactcctgcctcagcctcccgagtagctgggattacaggcactcaccaccacacccggctaatttttgtatttttagtagaggtgggtttcaccatgttggctgggctggtctcaaactcctgacctcaggtgaaccgcctgccttggcctcccaaagggctgaggttacaggtgcgagccaccgcgccgggcccttttccgacatcttaaacgtaaagtaggagacgtgtcataatcatcgaatactgcagtggttttcattagctcctgtttgtcaaacttatgaacagagttttaaaaattgtgtatcagccgggtgcggtggctcacacctgtaatctttgggaggctgaggtgggcagatgacaagatcaggagtttgagaccagcctggccaatatggtgaaaccctgtctctactaaaaatacaaaaattagctgggcatggtggcgggtgcctatggtcccagctactcaggaggctgaagcaggagaatctcttgaacccgggaggtggaggttgcagtgagctgagatggcaccacagcaccccagcctgggtgacagagcaagactccgtttccaaaaaaaaaaaattgtatatgagagagacagaactagacagagaagaaggagaaaatgtgtcttctttatacactattttgtaacttgctttatcgagtaggttatgaaaaatcttcctatgtgaaaaacatttctgcatcatttgaaatgtctatataatatcccattgtgtttagatacaataatatttagccaatctctttatgtgtatatatttaatacagtcattctataaatattgactgagtagctgctgtgggctactgtccgcagtgctgaacaagacaagcatgaatccatgaaactgattttcataccagaatataaaaaagaaacttaaagataatcctcatcatggtaaaagatgaagaacctatttttgccgggacatcttactctttagtaattggtggccagtgttctttttcttgcatgctgttttggagagtctgttttttaaataaatatttaagtagcctgggcgcagtggctcacgcctatggtttcagcactttgtgaggccgaaggggatggattgcttgagcccagggcttcaagaccagcctgggcaacctggcgaaaccctgcatctactaaaaatacaaaaattagccaggtatagtggcgtgtgcctgtggccccatctacttgggaggctgaggtgggaggatcccttgagcctgagaagtggaggttgcagtgactgagatggcaccactacactccagcctgggtgacagagtgagacctggtctcaaaaaataaataaatatttatgtaatcatctttaagcagtgtttttaattttatttatttatttatttatttttgagacagggtctcactgtgtcacctaggctagagcacagctgcatgatcacggcctattgcagcctcgacctccctgggctcaggtgatcctcccacctcagcctcccaagcagctaggaccacaggcacacgccaccaggcctgactcatttttgtattttttgcagagacggggtcttgctatgttgttcagacctgtctcaaactcctgggctcaagccatcctcctgcctcggcctcccatagtgctgggactaagccatgaaccactgcacccggcataagtggtctttctttaaaaaaaaaaaaaaaaaaaaaaaaaaaaaaaaaaaaaaaccacattaattaaaatatgtatttgcttattataaatatatttgaaacatgccaatttttcttctctttttttgctctattggtttctgtgtgtggatggatatatttttaatggcaaataggatgagtgtctttacttccaagtagtcagtgtttttctttaatgtttgtactaattttgtcacattgcagttagaggttgtggcctgtctaatttctgcttttttggaacttgagagtctctgtttttatttgtttttggtagcctggcatagagtccatttttcttttcttttctttttttgagacggagtttagctcttgttgcccagactggcgtgcagtggcgcaatctcagctcactgcaacctccgcctcctgggttcaagcgattctcctgcctcagtctccccagtagctgggattacaggtgcccaccaccacacctggctattttttgtatttttagtagagacggggttttgccatgttggccaggctggtctcgaactcctgatctcaggtgatccacccgcctcggcctcccaaagtgctgggattacaggtgtgagccactgcgcccagctgtagatactttttaaaaaggtatagtttctgattatggggtagaaatgtgctatgtctgtcatttcagccttatgaattgcccagaataagctagatcacctttaaggccatgtggttagggaaacttgggcacagaatttacattttcaacttggtgataagatgggtttaaggtaagaatcaaataggagaaagccttagctgttccagcggcccatgtttaaaagaatgtgcttctttttccaagtatttctgccgcttgcatgcactgagcttctttggaaaggagcaccatgcaggcatattttccagacaggaccggatttgctcgttactcagaggtgtgtgcattctttgcttttaggatatttaattagcatcttttaatagtgatattacggtgtcttaaaagtttatgcatttgaaaagaaaagaacttactccttgccaggtctcaacctatcatggttatctttgcagctgagctgcgttggttttgaggctcacatatggtaaaagtggttggaaatctggaaatattgctgtgtatctgcaaagcagcttgatatagtggaaaaggtattaggtcattaatcatgagatttggattctagccccttagctgctgcctgccaggcctggagacctttgttctcttctttaaactgctgctttctcatcagaaaatgaagttcctctccataccacctctctgaagggctgtgaagctcgaagtggcagcttaaaaaactgcccatctcaggaggtgtcttaagaaggaggacataccgctggctcctgcctttctcacttagccaggtctgatacctgtgttgttttcactgtggccattttaggatttttcaaaggctttcagaaagcaacatgctaccgtaccccttatacaccaaaactggttttcattttggaatataaaagtgagatttctccaccagtacaataaagttgttacaagtggttcctatgtgtttgtttttgtttttgagacagagtctcactctgtcacccaggctgcagtgcagtggcacaatcttggctcactgcaacctccgcctcccgggttcaagcaattctcccacctcagcctcctaagtagctgggactacaggcacccgccaccacgcccagctaatttttgtatttttagtagagatggagtttcaccatgttggccaggctggttttgaacttctgacctcaggtgatccacctgcttcagcctcccaaagtcttaggattacaggcgtgagccaccacacccggcctcctgtgtgttttgaaggtgattgtgacctcaggttttggcagggctataccttgtgtttgctcttactccaactccatggcatacctggaccaggcctcttcatcttgaagagggatctgctgaaatgcaggcccagtgaatctccccatgcctggacacagttccgtcaagccaggacccggtgctgcctgcacccctgtttctgttagtctgactgtcctcgctgagtctaactccttgagggcagagaggatgtcttatttatttctgccccgctagccgtgtaaactgagtaggtacttgtaaatgttcattgaataagtacctgattaatagaatttaattcaagaagaatgtattgatgggcctgtgtggtcaccacagtactgagatgtaggtgggagctggctgaagggggaggcacctaaacaggagtgcagacagcggcacctacggatgatggcccgctccatcccaccgcagcgaaattgtcccagacctctgcagcttcccccacacctagactgagagagagctcttcttccttctgtagggagcaggtgtttcctccagatgtccaatatgtacctcccattacagcggtgttaggaaggtgagggctgccgctgaaagggtccccttcataatcatcactagatttggggtatattatggattaaatagaatttttataagatgacctgaggatctatttaaataaaatcctctttctttctgcaagatcatggatttaaattcaacacaactgacttcatagggaaggggtatggtgaaagggaagtgaggtgggcagcactgatatttaacaaggtgagggtccttctcctgctctgactgtcacattaaaatattcccaggagaaattggagaaaactcagatgaaatatcgtctgtgttccaggaggcaggactcatcggaatgcttttattttgctccattttaagagatttgcagataaagaggagtgaagatttctattcagatttacttgctttatattttaacttatagaccacaagccaactttcgaaagagcatcattttgaatagtaagagttaggaaggcaaatacagaaggactaatggcttccaagattatgagcttcataggaatggtttgagatgaggctatagtaaagcagaatattgaagttcccccaccccctttcatttttcatttttcatttttaagagtgagcgaggccaggcgtggaggctcacacctgtaatcccagcactttgggaggccgaggtgggcagatcacaaggtcaggagtttgagaccagcctggccatcatggtgaaaccctgtctctactaaatgtacaaaaattagccaggcttggtatcaggtgcctgtaatcccagctactcaggaggctgaggcaggaaaattgcttgaacccaggagtcggaggttgcagtgagctgagatcgcaccactgcacatctcagaaaaaaaaagagtgaggccccaagtttttttgcatttgtttgtaactgaatacgtctgaagttatgtgataaccacgccaaggtgacaaattgccaagtttcagtaaaagagacccagttatttagaggttgacacgtggatatgtccctttctaagaagttcgtggtcagctttacatgagtatttaaatgcgtgtttataattcagcaatatggcttgtaaaatacagattgccaatcaagtgacatgcaaatcttgatgatctgaaacaagttttcttctgttatctatggaagaaatggtaatagggatatttaagtgggatgaattttttgaagcattttcaggcagttttccacatggaacaaaataacattgagtgggctgctaacatgaggaacatattgccctctgcctaggattatgagtaaatttgataaattctagactgcagtctcattttagctcattttatgaggcagcttgacaactgggatagtgtctcttttttttgtcgggggtgttgaggctggagtctcgctctgctgcccaggctggagtgcactggcgtgatctcggctcactgcaacctctgcctccggggttccagtggttctcctacctcagcctcctgagaagctgggattgtaggcatgtgccaccacgcccggctaatttttgtattttttagtggagacgggctttcaccatgttggccaggctgggtctcaaactcctgacctgaagtgatctgcccgcctcagccaccctaagtactgggattacaggcatgagccaccacacctggcttctgttctatctgtgcattggggatgaaattaacacaaatgatgtttaaagaaaaaaatgctcagagaagttagaaatgtgctttaaattggaatcatctcttagtatgtaaaagttttttgtaatagaaacaagcagggcagtatttgacctgttgacagtgtccttggactttacaatttgtgaagcagcgtattttgcttgagttgtacgattgtcgtttttttccccccactttgacaactgttacagaacctgtcaccagatacaggcaagggaggttgggcttcccatctctgcacggcttccctgtgattcacaagcaagcaatcagaagtgcacaaaagtttagaacgcgattttcattctcttctttccttagaaaaactcgctttgttagccttttccagaaaggaaggcactcaattgttgtaatactcaaatcataaaaagaagcctagtctagtctattcagcaaggtgttctgaaagagggaattttttaagttcaattatgcgaagatcttgaaggtgggactcaaaggagagggctatcctgggaagaaggctttggaaaatgagaggcatgaaggggagagggtatttaaatgtgtttgaagccaaggatccttgagagaaaaagctggcactaacagcgttcaaagaacttgcgtgacaagtgatgactaatgacactgagggtgggttgtgggtgcctagtgaattcctccgaagccaagagagaggtttccagacccagggaagaaggtgtgtacacccagaagtagtgtagggacagagattccgatcacaagctgtgactggaagacgccgaccaccactgcagcagcctgaaaaccacagtcttgaaccgccagcgaagggctgggaagtgcggatccagggctggtgcactgaacccagaggagcaggctcccattcccagctaagggtggcagctggcggggatctttccagcagaaagctgtaagtggaagctttcaattcagagcagtagcaatgccttcaaagtcccaggcttcacgtgggaacagagaatgtgaagagtatttagcaggatgccaatataagaaatctatattggtgttcgtttgtttgtttttgagatggagtctcgctctgtcacccaggccggagtgcagtggtgcgatctcagctcactgcaatctctgcctcctgggttcaagcgattctcctgcctcagcctcctacatagctggtactacaggcacgcgccaccatgcctggctaaattgttgtatttttagtagagatggggtttcaccacgttggccaggctggtctcaaactcccggcctcatgatccgccctctgcagcctcccaaagtgctgggattacaggcgtgagccaccgcacctggcccaatattgtttgtttatttatttcttgacaggatctcactctgtcaccaggctggagtgcagtggtgtgatctcagctcactgcaacctccacctctctggctcaagcaatcctccctcctcagcctcctgagcagctgggactacaggtgcacaccaccacacccaactagattttgtgttttttgtagagatggggtttagccatgttcagctagtctcaaactcctgggctcaagtgatctgtccgccttggcctcccaaagtgttgggattacaggtgtgattcatgatgtccagcccagtatttttctttcactctggaaaccaaaaattattggctttttttcctgttgcattccctttacttagatgaatctagcaaggttggctgttagtgtctaggtcagaagtctaagtgaaagtgaatatttaaccacactcaagcacagctgatgatctttaatactaatagaggtataagacttaaaagaaacaagaacccagagggaaaatatggccatggactcagagaaaaccacggcagcttccatggactcataaaaagagctcaaaacctaggaagtggatggagactctttttggaatgaatgaattcaaatgtgggctttcttagtagattaaatcattttctagaaggaatttcagaaggatgtgtgcccaattatggtatcaggtctgttgtagactcttcaaggaggaagcctctgaaagacaagaaggaacaattaaaaattagaattcaggtgagtggatcacgaggtcaagagatcgagaccagcctggccaacatggtgaaaccccgtctctactaaaaatacaaaatttagctgggcatggtatggctgtagtcccagctactcgggaggctgaggcaggagaatcacttgaacccgggaggcggaggctgcagtgaaccaagattgtgccactgcactccagcctggcaacagcgagactccatctcaaaaataataagtaaataaataaataaataaaaattagaactcagaaaaggaattaatttcttctgagagagaaaaagatgagattctagcctaaggtgtaacacatccatccaccaggtatcatttttatacacgtgaagttaaatcaccaaaggaccaggtgagcagatgtggactttccgactgtgtgtgtgcgacttcctcagagccctcagtggcgttcccttttccgcgctagcgtttggtccctgcgcttttctggatgcccccaccccctctggctccacgaggccccctgtacgtcaccatcacctttgtgagcttgaaacctgtcacccacccgccttccagatgtcacctgggccctcccggaggccctcgccctcagtgtgtctgattctgagctgtcctgcgttttcccctcccctcaccctggcgacccttttcggtctcagttgccagcctcctgctagggctgggtgggggacatcaaaggcaggacaaggtgtagggtcctcacccaccacttagcagctctcagatgcagacagatttttcagctggcctgtggctcagtttccctcagctacaagaggggtgcatgctagggtttctctggattgctgcacctggcaggtagtgtgagcttggtaggtgcttccttgcttatcattgcctctcccatcttaatgttgtcccatccatccaatgtttatgggatgagaggttgataggagggcatggccctgacattccagggactgaccgacacgctgtctacacaaaccccttctggttcttctcgtgcactgggcgtgccggagacacactcccttaccctcataccccgccgcacccctgtgacctctacctttgagacctcagcttaaactcactcttagggaaggctccctgaaccacctgctggggttgtatgctgatgcaggtacttgtaacacctggtgcttttcctttcgtgcactcaggcagtgtttattcaagtgatggcttggtgacagtggctctccctgagaccccgtgaggccagagtccttggctcatcactcatggttgaacccggagcctcttgctggtaggtgcttcaggactggctctgggagcctgtggctcctgccgggtacccaccggttgagatacctcaagttttaaatgccacctccttcctgaagccttccttgctgctcccccaaactagaggcaggagttttgtccttcagataacctatggcatttgagtcactctgatttgatgaattctgccttcacttgagcagctattaggggcatatgtcagtcattcattcctcagttcatgtatttattcagcaaatatttactgagcacgtactgcgtgccaggcactgtcctgctgtggaaaacagcaggcatgattccctgccactaccaaccactgcatcgcataactggcagactcccagcttcaaggagaggcacggagggaaactgagagcagcctgcagaggggaaagagcggggacagagggtcacggaggtcgcaggggcgtgtgtgcagcacctgccagtgaacggaatgtgcggctccagatgtcgttgtctttaaacttcggaatttcctttcactaaagaaccaagtccagggggaggaaagagtgaatacaaattatccaagaaactcaagagctcattttagttctcctgattatgatcttaaaggcattaagcgctcaagttaaactccttgtgacccacataggttagcagaatttaaatcctaggtgattattaactctaatcatacatctaatgacctatattgaagatacactgcctgcttagttgtggcttcagcctttgctccgtcactgatagttctagcctgaaaagcaaatgagccctcatgctcacgatttcaccacagtcacataagcgggaagagcaggctcctggctgtggcgagcttgactccatttggtttgatagaaatgagaggtagatgattccctagacaaatgcaggcctttctcgaagcccctttcccaggacgacgtgacatgagtggtctgtgccttccagggcagccacgtcatgctttgcccagccagggcggtggggagggagacagccacatcctgcccggggctcctgggccccgctgcatcaagtgaaagcagggctggctccctgatgtccttggagaagtcgcccacactgctttcccccatgggagtgacaaggatgtgtcccgccagccttccacgacggaccccccactctctattaattcccaagaaaccaggccatggaggtgggtttgagggtttgtattggtgttttttaaagtcaggttgaccgagtgcggtggctcacgcttgtaatcccagcactttgggaggctgaggcgggcggatcacatgaggtcaggagttcaagaccagcctggccaacatggtgaaaccttgtctctactaaaactacaaaaaaaattacctgggcgtggtggtgggcgcctgtaatcccagctactcaggaggctgaggcaggagaaacccttgaactagggaggctgcagtgagccgagatcgcgccactccagcctgggtgacaagagtgagattctgcctcaaaataaataaagtcgggtttattaagatataatttacatacagtaattttttttttttttgagacagagtttcactcttgttgcccaggctggagtgcaatggcacgatctcagctcactgcaacctccgcttccagggttcaagccattctactgcctcagcctcctgagtagctgagattacaggtgtccaccaccatgccttgctaatttttgtatttttagtagagacaggttttcgctatgttggccaagctggtcttgaactcctgacctcaggtgatccgccagcctcggcctcccaaagtgctgggattacaggcatgagccactgcacccggccagtacatgctttcttgatttgtctgtttcccacctgtctcccctccctagaatggcagctccatgacgacagaggtgtttctctgttttctccatggctgcaccctcagctgctagaaggtggcccagcataggaggtatttaatgaagccttcctctccacttaaatctacacccttgtgcttattaaaaggtgacagttttctgtttgaaaattttattagtgttttaatgagaaagttattatttgggtaatgcctgaatatgaggaaaacattaagggtagaaatgtaattgttttcctatttcattcagtctatggattttattgaagattacagaattacttctttgtagctatggaagtaaaaaaataataagacgagtagctatttcaaaacgtagggctgataaatttgggatggtttgagaacgttaagttggggaactccatttctttttttacatttttatttattttcatttgtttatttatttatttgagacagagtttcgctctgttgcccaggctagagtgcaatgccatgatctcggctcactgcaacctctgcctccggggtataagtgattctcccatatcagcctcccgaggagctgggactacaggcgcctgccaccacacctggctaatttttgtatttttagtagagatgggatttggccatgtcagccaggctggcctcaaactcctgaccgcaggtgatccgcctgcccttggcctcccaaagtgctgggattacaggtgtgagccaccgcgcccagccagggaactgcatttctgacagtggctcagtagtttggaagttaactggcaaaggtggacagaatctttaaacatatgtggaggaattggagagtttacaagatagtgaagaactgccaggccatggtctggagaagatggaaacttgatgtttggggccattgtgtccctggggtgttggccaatttatgaaagaagcagttaagagcctgagtggcacttttgaggggctagaagggaagaccctggtaaacatcccaaactttggattgggacccaaaaaagctccatcccaggagtacaggtgacctggaaacggatcagcgtaatcgaggactgaagtccagttctagctacgcccagtccttgagactggattaaggtgatctcagattgcaaggacctcaaatgcctggcagaagcaagtgaatatccttctggaggaacagagcctcatcctaggcctctaattatttttaaggacaatttttcaaatgcaggctttcctccctttgcacagttcccttatgcataaatttcagtcagtggccagctgcagtggctcatgcatgtaatcccagcgctttgggaggccaaggcgggtgaattgcttgagtctgggagttggagaccggcctgggcaacatagaaccccatctctatttttaaaaataaaatattaattatcactgcttagttaaattatagtggtctcccaacaatacagatcagatcccagctcccatggtatatacactgtgagtgctgtataaagtacaagctctgccgccagttctccagcctacaaatcacagtatagataacagatgtgcatgatgatcactggccaattgcgtcacttctctcaaagtcagtctgtgattggtccctgagcatctgtcggtcagtttcatgcacagactgcaaagcatatggttttgtctactctttgtctctcagtgataaacccacatggcattttgtaaaagtggatacatcaggccaggtgtggtggctcatgcctgtaatcccagcactttgggaggctgaggcaggtggatcatttggggtcaggagtttgagaccagcctggccaacatggtgaaaccccatctctactaaaaatacaaaaattagctggatgtggtggcaggcgcctgtaatcccagttactggggaggctgaggcaggagaattgcttgaacccaggaggcagagcttgcagtgagccgagatcatgccactgcactctagcctgggtgacagagcaagactaccatctcaaaaaaaaaaaaacaaaaaacagtaatcaagcatgaaaattatgaaatgctcagagataaaatgcgcgaggcctgtacactgtaatctacaaaacactgctgagagaaattttaaaagacctaaataaatggcaagttataacatgctcttgaatcagaagactcagtatcttaggatggcgacttttcccaaaatgatctacagattcaaagcaatcggaatcagacctcagcatgcctacttgtagaatttgataacctgattctaaagtttatatggaaatgcaaggaacccagagttgctaaaataactttgaaaaagaacaacacagttgaaggacttagactacatgatttcaagaattattataaagctacagtaatcaagacagtatggtattgatatgaaaatagaccattagatgaatggaacagaatagcaagtccagaaatagatccacacatatatggtcaattgattttcagcaaagtgccaagtcatttaagtggggaaaagataatcttttcaacaaatgataccggaacaactggatagccatatgcaaaagaacctcaaccttcagctcacagcactacaaactcataattattatcattatattatactattatgtaataatagtatatatcatgttacatattatattatgtaatatatattatatgatactgttatgtcatataattattattgaaatgggtcatagatctaattgtaagagttaaaaccatccaggtacagtggctcatgcctgtcatcttgcactttgagaggccaaggcgggtggatcacttggccccaggagttacaagaccatcctgggcaacatagcgaaacaccgtctctacaaaaaaatgaaaaaattagttgagcatgatgacactcacctgtagtcccagctgcacagtagtctgaggtgggaggatcacctgagcccagagaggtcaaggttgcagtgagccatgattgcaccactgcactccagactgggtgacagagagaccgtgtgttaaaaaaagagttaaaactataaaaccttcagaagaaaacatatgagaaaattctagtgatttggggtttggcaaagattccttgaacatgatttaaaaagcattaactaggccaggtatgctggcttacacctgtcattccaatgctttgggggaccgaggtgagaggatagcttgaggccaggagtccgagagcagcctgggcaacataacaagagtgggtctttaccaaaaaaaaaaaataaaaagcctgtgccaggcacagtggcacatgtctgtagtcctagctactcacgaagctgaggcaggaggatcacttgagcccaggagttgaagcttgcagtgaattatgaccatgccactgcactccagcctgggccacagagtaagactaagactcagtctcttaaagaagaaagcgaccgggcgcagtggctcacgcctgtaatcccagcactttgggaggctgaagcaggtggatcacaagggcaggagatgaagaccatcctggctaacacggtgaaaccccatctctactaaaaatacaaaaaattagccggacgtggtggtaggcgcctgtagtcctagctactcgggaggctgaggcaggagaatggcgtgaacctgggaggcggagcttgcagtgagccaagatcgtaccactgcactccagcctggacaacagagcgagactccatctcaaaaaaaaaaaaaaaaaaaaaaaaaaagaagaaagcataaactataaaagaaaaaattaataaattagtcatcctcaaaattagaaacttttactcatcagaaaacacttaataaaatgaaaagtcaagccatagacttagagaaaatatttacaaaacatatatctgacaaaggacttggatatggattatataaagaactattgtaattcaataagatgtcaaacaacccaattaaaaatgggtgaaagatgaactaactcttcaacaatgggcatgtcatttgaatggatggtaagcaagcacatgaaaagatgttcatgtgcctttccctcattagtcactagggaaatgcaagttcatagacatctctcttcgtagaaagatatcactacacacccacaagagtggctgtaattaagcagtctgaccaagtatgcgtaagaatgtggaataagaactctcatacactgctgatgggaatgtaaaatgatagccactttggaaaacattttggcaaataataccacttacattattatcgaaaatattgtatacctgaaagaactcaaagtgaaaaagctatatactgtctgcttccaaggctacacattatgggaaaggcaaaactatgaagacagtaaaaagatgcgccagtggttgccaggggctcatggggagggaaagaggaatgaataggtggaacacagggcatgtttagggcagtgaaactattctgtatggtaccgtaacgatgaatacatgttattaggcatttgtcaatacccataaaatgtacaacacaaagagtgaaaatgaaaactgtgggcttcagttagcaataatatgtcaacattggctcatcagtggcaacaaatgtacctcaccaatgcaagatgtttgtttgttgtttgtttgttttgtgacggagggggtgcagtggcgcaatctcggctcactgcaagctccgcctcccgggttcacgccaatctcctgcttcagcctccggagtagctgggactacaggcgcccgccaccacgcccggctaattttttgtatttttagtagagacggggtttcaccatgctagccaggatggtcttgatctcctgctgtcgtgatctgcccgcctcggcctcccaaagtgctgggattacaggcatgagccatcacgcccggccaccaatgcaagatgttaataacagggaaactgtggtgggagtgaggtggtatatgagacctctctgtactttccactcaatttttctgtaagcccaaaacttctctaaataagaaagtttattaattaaaagttacttttatagtgtatctatatctaggaataaatctgaaaaagatatataagatctctactcagaaaactgattatgttattaagagagcttaaatatagcccaaataaatagatggatatactatgttcatggaagggacagctcagtattaggaaggtgtcagtcatcttaagaaaagcctcatgtgtcacacaagggatactgacatctgacaccaagcacatgtaggcatcctgactacgtttacttgaatgatgtggactttacagagctgactatagacagttcaaatggcctgaaaactgttcaatgcactccctcccaggctgtcatgggatgcacttcaggaactttactttttaacaagaaaattcagttttcctcttaaacagctggcttctgttccattagcattcttgtcactttaagttgcattcatctttgttttttttttttagaaaaacatttgttctgcaaccagtcttgtcctttaaatacttgtactgtatacaggctctttttcataggtccattacttaaaatgatgtaagtgtgtttttggtggcaggggggtgggagttgtttgttttgttttgttgagacacggtcttactctgtcacccaggctggagtgcagtggtgtgatcttggctcactcctggcctcaagtgatccacccacctcagcctcctaagtagctgggaccacaggtgtgtaccaccacacccagctaatttttttttttttttttttttttttttgtagggacggggttttgtcatatcacccaggctggtctcaaactcctggactcaagggatcagcctgtctcagcctcccaaagtgctgggattacaggtgtgagccactgcaccggtcctgatttgagtttttgtaagacagggaacaatgttcagaatttagcaccaatgtcagactcattctgtaaatttttattgaacgtctgcctggtgtaggagaggaagatgacagacaagaattcttcctccaagagttacaggtcagttgagcagaaaaggcatacatcaatacccacaatgagagttgtcgtgattcagaggagggacaaagtccttcccctggagggatcctgagcactttggagaggaaaggcatctgtactgccccccaaatgtgtagaatgggatgcattcctggcagaaagaagtaggataaagtacagaggccagggctgggtgcagtggttcacgcctgtaatcccagcactttgggaggccgagacagcagatcacctgaggtcaggagttcgagaccagcctggtcaacatggcaaaaccctctctctactaaaaatacaaaaattagccaggcacaatggcaggtacctgtaatcccagctacttgggaggctgaggcaggagaattgcttgagcccaggaggcagagatcgcagtgagccaagactgcgccactgcactccagcctgggcaacagagcaagactctgtctcataaaaaaagaaaaaaaaaaagtacagagtccaggaagcctggggtggggctggcagatgccgagtcatctattttggccagagttcaaggcttgctaggggacatgaagagaagattcgtgcattctagttcaaactccaccagatatttgagctccttctctgtaccaggcattgttctaagatacgtaagtgaacaaaacccatgacaccctcgtctatgagagctgatcctctggcagggacagacaggtcatgagtggagtgatggagcagctggcctggtgacttagccgccttcaggtacagtaggaggagcaagcccaggacaggtgagtgggtcaagggtgccagaaggggtgagggcaccaggaagctggtccagtttggcttccctgaggtggtgaccaggacctagcatctgaggaagggctggaagcaggtgagagcaggtggagcagacatcaggatgggagcatcctgacagggagggcagcagggtgggctcatgagaggaacagccaggaagtgtgactcgagcagtgtcctggagaggaggaggaggagaaagaggtcaggaggtcccaggggagaggcaggaccagtctcgtggaggtcggggccgttgtgaggactctggtttgtgttgtgtgtgaaaggccatgggatggggaccagcgagggcttcttaggggactggatatgctctgatctagctgctaaaaagcccccttgggcagcttgcagggcccgggcagaagctataggtggttctgaggtttgcagaggggcctgaaggggtggggcccggccaagcaaggtggctaagtgggaaaggctccaccgcgttgggtgtaggaagaccttgaccttagctccagcccagccactgagcagccgtgtcgccttgggtgatacctgtccctggtcggtttccctacctgtgaatctgggtacttggaagccatgctcgagaagagcccatccccaggaggtgatcagggttctccttcaggtgaggaacctggcagccgtgtgtgagaaccttagaaaagggagagggaagaggctgtggcaggaagtgaggagggagttagtgataccctgggcaggatgccatgagctgggatggaaaccacaggatgaatgcaagtaattaaaaaaaaaaaaaaaaaaaaaacagcattgggccgggcagtggctcacgcctgtaatcccagcattttgggaggccgaggtaggtggatcacctgaagtcaggagttggagaccagcctagccaacatggtgaaactgaaaatgcaaaaattagccaggcatggtggcgtgtgactatagttccagctactcaggaggctgagacaggagaatcacttgaacctgggaggtggatgttgctgtgagctgagatcgtgccactgcattgcagcctcggtgagagagcaaggccccatctcaaaaaagaaaaaaacagactttccgaccaaacgatcgacaaaccagactgtccaaacagccataagccgtaactttgtgcggaggtaaaagaccgaggtcacatcgggacctgttggattcaaggcatgttgacagctgtttccaggcttcagatagagcctccagctggcagggtggccacagggcttgttgagtaggaagcctcgttgctttgacaggttacttggccccatgagggacaatcccatagtcagttacccagaaacgtgactgtctccttgaaatcctcagcatggggtcttatgaataaacccttactagatttcctgttctgtcttatttttatgcagagctttactttatagcagaaaattccatttttacccttaaatggcttgcttctgctcccttagtgttcttgtcactttaagttgcattcatctttgtccctttagaaaaggatttgtcctgcaaccagctcttgcagaaggtacttggtttattgttaaccgatgtttgctaaatgtttgaattatgttgagttgcttaaagtcatgctatcgggtagatgttgtggctgttcttttcactctcttatttggggatttacaaaacagttatgtttttagttttcttttatttgttgtgttgaataggaatgtagctctgggaacctctagttccaaataagaaagccttggacacatttccagttggcaagctggcaaaatgaagggcgtacaagttgttagagaggctgggagcctatttaagcacccagcttcaggatgggacatgggatatacctcgagttagaggttcttattaactgtggattcttctatgcagatatctgtcacaatataagttactataagtcagtactaaggcagctgctacattctgtttgccaaggggaagaagaaagcttggaaatggtattccttaaaaatgtcagtatcataaaagacaaagaaaagctgcggaaatgtttcagattaaaagagagaagacaataaaatgtaatacctgactctgaacagcatccagtactgaaggaggaaaaatgctatcaaggacattattgggtcaattaacaaaatttgaatacgaatcatagattgaactgtatctgttaaattaacagaagcgaagtgttctgtggtgtgtaggagcacactgccattcttagcaaacgtgtagtttagtatttaggagaaagggccatgaggcatgcaactcaccctcaaatacacacacacatacacatatatacatacatacctataaagaaagaaattatgggctaggtgcagtggctcatgcctgtaatcccagcactttgggaggccgaggtgggtggattgtgaggtcaggagatcgagaccctctctactaaaatacaaagaattagctgggcgtggtggtgcacgtctgtagtcccagctactcgggaggctgaggcaggagaattgcttgaacccaggaggcagaggttacagtgagccgagattgcaccactgcactgcagcctggcaacagagcaagactctgtcttgaaagaaggaagaaagagagagagagagagagagagagagagggagaaagaaagagagagagaaagaaagaaagaaggaaggaaggaaggaaggaaggaaattatgataaagcagatggttaagttggtaactaccagtgaatatgggtaaagttaggatgttctttactctgttttgggggtgcaacttttctataagtgaaagtacttccaaataaaaagttaaaaggcaagcaaataaataaaagagacagtttctatgttatatatcctagctatgtttaccatgtctggattctgaaagctgcagagcagaaaacctgaagaacagatcacctgttcttaaaataccactgttggccagacatagtaactcactcctgtaatcccagcactttgggaagccgaggtgggaggatcacctgagctcaggagtttgagaacagcctgggaaacatagtgagaccctgtctctacaaaaatttaaaaaattatccaggcatcatggttcgtgcctgtagtcctagctactcaggaggctgaggtaggaggattgcttgagcctgggagttcgaggctgcagtgaaccatgatcacactaaagcactctagcctgggcaacagagcaagaccctgtatcaaaaaaacaatcaaacaaaaaatcactcctaattttcctcccttttagtacttttaaaaattaacttaaaacattttttggataattgtagttttttttacttttttttttttgagacagagtctcattctgtcacccaggctggagtgtactggtgcaatctcaggtgactgcaacctctgtctcctggattcaagtgattctcctgcctcagcctcctgagtagctgggttcataggcgtgcaccacacctggctcgtttttatatttttagtagagatggggtttcaccttgttggccaggctggtctcagattcctgacttcaagtgatctgcccgccttggcctcacgtgcagttttaggaaataatacagagatccccagcactctttccagttttccccaagggtaacatcttgcaaagtgagaggacgatatcacagtcaggatactgacattgataccatcaagatacataatgtttccatcaccaatcagtggtcatggtgccttttatagccaaacccacttctctcctaccttcccatcccttttttaattttgccagtcattaatctgttgcccatttctgtcattttatgaatgtcacataggccgggcgcggtggctcacgcctgtaatcccagcactttgggaggccgaggcaggcggatcacgaggtcaggagatcgagaccatcctggctaacatggtgaaaccccatctctactaaaaaatacaaaaaattagccaagcgtggtggcgggcgcctgtagtcccagctactcgggaggctgaggcaggagaatggtgtggacccgggagacggagcttgtagtgagctgaaatcacaccactgcactccagactgggtgacaaagcgagactccatcttaaaaaaaaaaaaaaaagaatgtcacataatgaatcatatggcatataaccgtttgagactcagggtaattctcatgagactcatccagcttgttggtgcatcaacagtttattcctttttattgctgagtaatttccatggtatggaggaaccatggtttaactattcacccattggaggacatctaggttgtttccagcttggagttattatgaataaagctgctgtgaacatttgtgtacaggtttcttggttttctggtttgttttaaacagttctagccaggcacggtggctcacacctgtaatcctaacacttggaaggctgaggtaggaggactgcttgatcctaggaggcagaggttgcaaggagccgaaattgtgccactgtactccagcctgggcaacatagcaagaccctgtcattcataggtaggtggatggatggatggacggacggacagatagataggtagaaatgtaaattacagggctacgctcagtggctcatgcctgtaatctcagcactttgggaggcgaaggcgggcggatcaccagaggtcagcagtttgagaccagcctggccaacatggcaaaaccccatctctactaaaaatacaaaaattagccaagcatgctggcatgtgcctgcaatcccagctactttggaggctgaggcaggagaatcacttgaacccaggaggcggaggttacaatgagccaagatcatgccactgcactccagcctgggccacagagtgagactccgtatcagtactttctttttattgtttttctgttattatagtttaagttcattgttattagattatatactctgtatggcttcaattcttttaaatttgttgaggtttgtttaatggtcaaagacatggtctgtctaggtgaatgttccatgggcttttagggaaaaaagtatattctagtgttgttgaatggtgtcttagtccattcaagctgctataacaaaataccgtaaactgggtgatttataaacaacagaaatttttctctcacagttctggaggctgggaagttcaagatcaaagtgccagcagattcagtgtcatgtgaggacgtgcttcctgcttcatagataagaggtacatacacgtttaggagcatcgtgtcttcctggtggatgaattctgttatcattaggtgatcctttgagcacttttaaaaagaatctgttggccgggcgcagtggctcacgcctgtaatcccaggactttggggggccaaggcgggcagatcacgaggttaggagattgagaccatcctggctaacacagtgaaaccctgtctctactacaaatacaaaaaaattagccgggcatggtggcaggcgcctgtagtcccagctactcaggaggctgaggcaggagaatggcgtgaacacaggaggcagagcttgcagtgagccaagatcacgccactgcactccagcctgggcaacaaagtgagaccctgtctcaaaaaataaaataaaataaaataaaaataatctgtttaatagcctactagtgttcttcctttactattttattgagcattaattaatcccaacattatgtctatgtcaggactgatgacaatatttggtataaaaatttgatagtctcagaggctgaggcaggagaatgcttgaatccaggaggcagaggttgcagtgagctgagaccgtgccactgcactccagcctgggcaacagaacaagactccatctcaaaaaaaaaaaaaaaaaaatcgatagtatcatatcctccaggattcaaagtgaacttcaaacagtcttatgtagtctaaattttggaatgcatcccagtattgagttgcagcagggatttgagtttttgtgaagagagagaggtatatcagaatcttgggcataaactaaggagccatgtcagaacctcaggtgtatgccaatgagatagatcagaacctcaggcatgtacccgatgagacagatcagaacctcaggcgtgtacccggtgagacaggtcagaacctcaagcgtgtacctgttgagacaggtcagaacctcaggcgtgtagccagtgagacaggtcagaacctcaggtgtgtacccagtgagacagatgagaacctcaggtgtgtaaccagtgagatatatcagaatcttgggtatttacccaaagaggtatagcagagtctcaggtatatactcaagaaggcatatcttgaggctttaagtatctagctaaggatttatatcaggatctcaggtttatacccagggaggtatagcagaatttggggtatagatctaaggaggtctatcagtctagagcatatagccaaggaactatatcagaacctcaggcacctacccaaagaggcattttaggactcgtaaggagggggtagatttcaaaagtgtagtctaacagtttatctactttgaaatttaaaacaatattaaaggaaaacatgaaatatttctatctgtcagaaggtgacatgagttttaaacaattaagaaatatactggctgtggccttgtaaccaaattattatgcctatagaaattacagactccattttccaggatagaataacagggactgacttaccttctcatctgagataacaaaacctccatacaaatacatgaaacaatgttcttcaagatgctggacatcaggcagtgaagggcactgatggttgtaagacaaggtgagaggtgtggcttgagagagtttccaggttgcagtgcagggagaggggaaactgaggcagatcttggcagacttcctcagttgacaaaatagagctgagagtccagggagaccatggtgtatagattatccaaagcaaagtatgagaggtgcaagccatatacagagggactccagagatctaccaaagtacttcttggtgcatccatatgagcaaaactacttgaggccaggaaaagaaccatctgagaggattagaaggaacagtgcccagtacttgtgccagccaggaatggtgcctgatactcacgcagggccaggaacagtgcagggatgtgagtgtttgttaggagagggaggtatatcagaatcttgggcataaagacaagaaaccatatcagaacatcaggtgtgtaccaatgagatagatcagaatctcgggtgtatacacagtgagatagatcagaatctcagatgtgtacacagtgaagcagatcagaatctcagatgtatacacagtgagatagattggaatctcaggtatgtacccagtgagtccaagagcatggtgctggcatccggtgagggccttcctgctggatcgtgacatgaagcaaggcaaagagcctgtcagctcagggctctcttcctcttcttataaagtcaccagtcctatcatgggggccccaccctgatgatcttataatcctaattacctcccaaaggctaccttcaaatgctatcaacatatgaatttggaaactaagtttccagcacatgaaatttgggggatacattcaaagtatagcaaatattacatcataaccagtaggattcatcccaggaaatgccaaatggcttgataatcaaaaattaatgtaactcatcgtattaacaggatgaaaaagaaaaaccatgtgatcatcttagtagatgcagaaaagcagttgattaaatcccacattcatttctaacttaaaaaaacaactggattttgacagaggtgcaaaggcaatttggtagagaaaggacagtcttttcaataaatggtgctggtgcaatggttatccatatgcccaaaatgaactttgacccatgcctcatgccatacacaaaaattaactcaaaatagatcagagatctgaaggtaaaatttaaaactataaaacttctagaagaaaacacaggagaaaaatctttgtgaccttggtctaggcaaagatttcatagatatgacaccgagaacacaatctatgaaagaaaaaaatcaataaattgaacttcatcaaaatgaaacttttactgttcaaaagacagttttaggagaatgaaaacacaagttacacattgggaagaaatattcgaaaagcatttgcctgataaaggtattgtagctggaagacagaaaaaattctcaaaactcacctagaagaaaataacccagttttaaaaatgggcaagagatctgaacaaacacattgtcaaagaagatagatgaatagcaagtaagcatgtgaaaaattctcaatgttatcagtcatcagagcaatgcagatgaaacctacagtccccatgctaatgttctacaacttacacagtggtggtatgataccactacatgcccatttgaatggccaaaattagaaaggttgaccataccaaacattagccatgatgtgcaggaactagaactctcatctttgctgacaggaaggtaaaatgatacaaacacattgaaaaacaggttggcagttgcttttttttttttttgagatggagtcttgctctcccaggctggagtacagtggcgcgatctcagctcactgcaacctctgcctcccaatgaattagaaaaataataataaaggtaacaatagcagtaataataatagaaataatgatagtttctttaataaaaatgctgtttaggcccagactgaaaggctttaagtaaccactcccccactgaagttagagttaagaaagaatattaattttccttgtgtgaaacattaatcttatctagcctccatgtattttgtaagttctgtaaattcctgttttccctgcacagctgcaagttcacaaggcagataagcttaagctgcaaaacatgtttttcttaagatgtaaggcatgtcacaagaatatcacaagatgataacggcctttattctcacttctgtatgcctgcttcctgcctcacatatttcctgcctcaagatgcgtaaaaggtacttgccttctttgtttggtgctctgactttctggatgcaagtccactgagccagtgtacaccttaaataaatcctcctgaaccccatcaatcgctccagttctctgatttcccactacattttctgggggctcgtccgggattggagatggcagattttctgtctcccttgcctgtggaactggagcccgggtcgagggagacctgggacctttggtgccaatgggaggactttagcccggaaaggagattggctctcctgcatcccggtgtccttcctagacagcacaacggaacctataaaggggttgcaggacggttccagcaggggctggggatggtgagagtagctcactgattcagatgacagggttttgccatgttgcccagacccagaggggctggggacagtgagagtagctcactgattcagatgaaacttacaccttagccgatgcaggacacgagagtggctcactaagttggtcaggaaagaaactgaaaatgggaagagtggcttcctgccttgactaaggatcgggaactgggagcggggaggtgtgtgaaagagatggttccgggagggccgtgatgtggggagacacagatctcttagcacggactgtgtgctctgaggcgagtgtgtgattgaccagaaccagggcatcacatacagctgacaggagctgccccacagctgcagcaggctgtggcaggaataaggtactctcctagctaagcagcacctgaaacttccgtaataggacccagtctggtcagtctggaacgaaagtgagagtgagtgtgcatcacaaagggcgggatgggaggaaaagcatcgaaacccactcctctggggtgcatgttaaagaattttaagaaaggttttgctggagattatggaattaagttgtcccccccaaagattgagggttctgtgtgaagtggaatggccttcttttaatgtcgggtggccagccgagggtacaataaatagggaaatgattggtcatatatttagggtagtgactggggttggaggacaccctgggcatccagatcagttcccatacatcaattcctggatgatcacagtctagacatgccccaaatggttacagccttgtctggcaacttactgtaagactctagtgacctgagccgaacctaaggcagttagagggcccccttcaccagacacctcaggtggaaagaaaaagccacaggaaaattaggaaagacctgttctacttcactgggatcaagtgattctcctgcctcagcctcctgagtagctgggagtacgggtgtgcaccaccacgcctggctaatttttttaaattttatttttagtagagacggggttttgccacattggccaggctggtcttgaactcctgacctcagacagtctgcctgccttggcctcccaaagtgctgggattacaggtgtgaaccaccatgcccagccagcagtttcttataaagttaaaccaatgcctaccatgagatctggcaatcccactcctaagtatttggccaagaaaaaagaaagcatatattccatacagagtctagtcctgaatgtctatagctgctttatttataatagctcagacttggaaaccattcagatgccattaataggtgaatatattctcaaactgtggttatccatacaatggagtattactttgcaatcaaaaggaatggcctatgaatacccataacaacatggatgaatgctgaaataattgtgctgagtaaaagaagacaggaaaaataagtataatacatactgcttgattctatttgtataaaactagaaagtacaaactaatctgtaatgacaggaagcagaccagtgacagtgggcatggaggggcaagagggagagattagatgggcacaggagagctttgaggatgatgggtctgcgtactgtctcggctatgatagtggtttcacaggttgatacatacggcaaaaaataccaaatttgtacactttaaatatgtacagattattgtatgccagttacatgtccataaagctttcttttgttgttttgtttttattttattttttgagacagagtctcgctccatcgtccaggctggagtgcaatggcaccgtctcagagcactgtaacctccgcctcccgggttcaagcgattctcatgcctcagcctcccaagtagctgagactacaggcatacgccaccatgcccagctaatttttctatttttagtaaagacagggtttcgccatgattgccaggctggtcttgaactcctgacctcaggtgatccacccacctcggcctcccaaagtgttgggattataggcatgagccacagcaccgggcccataaagctgtcttttaaatgaaaaaaagttgtcttgaaataagcattagaactgtggctttggctctgaaatcctcatctgaggacccacactcgggtgccccaatgtggcggtgcttacagaaatgactccatctgctaaatgagtaaatgggtaattctccactgaacacacactcgtttagcagcataagcagcaagagttcaggtaatcctcacattgcaatttgtcattagtttaaacttccagtctttgttttaaaaacacattagaataatactacattttccctcatctctaaacttgactgaagactccaagagagagtaatattcatcaagaggatcatctactcaacacagataaactgggaaagaaaaataacttgtgagtaattcagaatctggattatcaggtcaggctcaatggctcacgccagtagtcccagcactttgcggggcccaggagggcagatcacttgagttcaggagtttgagaccagcctgggcaacatggcgaaaccctgtctatacaaaaaatagaaaaattagccaggcatggtggcatgtgcctgtagtcccagttacccgggaggctgaggtgggaggatcacttgagcctgggaggtcgatattgcagtgagctgtaattgcaccatgcactccagcctgggtgaaagaaggaaactctgtgtccaaaacaaaacaaaacaaaacaaaaaaagctaaattatcaaatgtctagatcgttgatggttggaagtaaagttgagaaatgttcacactgggagatgacacacagtaaaccacacagagggttctaacgtggttgttagaagcagaaactagaggcttgctgcctgaggtcaaaccccggtcccggtggttctgtgccccagcgcatgttgtggtagcctctctgtacttcagtttcctcatctgtaaagtaaacataatgataatgcctgcctcatggggttgctgttaccaggaagtgagttaatgcacattaggttcttatttatgacagtgcctggcataggataagggctcaaaaagtgttagctggaactactatcattatcaacatctctaatttattgcagggttggatctgaaaaatggctgatgatgatttgatgatgacttcatttttataaaacaataatattgcagtgcaaattaaacacaagcaacctgcaacacgccactgcaagttggatgtctagaaaaggtgccatgagttaccttctaaaacatcataagaaaccatgttcaccaataattaccataataggagagaagtaccaagtaccatggggagacagagtccagaatctcagagagagacacagttaccttttagttacactaatggggaaaacaggagctttgctacccttgcacctgatggagggcttctctgaatatagggctatggggtcagaagccagtttcctcccatatttagaaggtttccaactgttatctttcacttcccatgttgctgttggaaaatccaaaagtattctatttggccaggcacagtggctcacacctgtaatcccagcaatttgggaggccgagattacctgaggtcggaagttcaagaccagcctggccaatatggcaaaacctcttctctacaaaaaatacaaaaattagccaggcgtggtggcgcacgcctgtagtaccagctattcgggaggctgaggcacgagaattgctttaacctgggaggtggaggttgcagtgagctgagattgtgtcactgcactccagcctacgcgacagagcaagactccgtctcaaaaaacaaaaaaagtattctgttggatcgtttgtgtgcgacgtgtttttccctctcagaaagctcgtagggtcttctctttgtctccagcatggtctggaatttcccagtgagtgaccatctgtgtgtgtgtattcatccattccatggagtccctgctgggcccttgcaatctggaaattcatgcccatcatttctgagaagttatcctgaacgtactggttggtggtttcctgtgctccatgttcttgcttcctgctcttcggagctcctgttatttggttgagttttgtctcctggactggtcctctcttacttctcttgcttctcccatgttccatctgttttcactctactttctgtgagatcaggccctttatcttccaacccttctattaggtttgcaattgagtttgtaattccctagaaaagttcttattctctgaatatcccttttgatagcatactcttcctttttcatgagtgcagtgtttctgcatggctctcatcagaacatgctagtgtctcccatttctcataactttctagagtgaggaccatttgaacttggagtgccctcattttaaaactctgtggttgaccttgttcccctcttttgctgctgcttttcaccagactttgaagaagcagaagtacattcagaacttgtctgctctggcaaaagacaatactgttggcttaatctaaaaattgaagaagaaagctcaaggagagaagtttaaaaatataccacctctggctgggcgcggtggctcacatctgtaattccagcactttgggaggctgaggcaggtggatcacctgaggtcaggagttcaagaccagcctggccaacatggtgaaaccccgtctctactaaaaatacaaaaattagccaggtatggtggcagccgcctgtaattccagctactcgggaggctgaggcaggagaatcacttgaacccaggaggcagaggttgtggtgagccaagatcacgccactacactacagcctgggtgacaaagtgagactccgtctccaaaaaaaaaaaaaaaaaaaaaatatatatatatatatatatatatatatatatatatatatatatatatacacacacactaaccttcagcatataggactattgcagaagggattatctttctacttggttggttcctcttggtcttgagcaaattttgacttccctgagttggcccctaaaagttaaagggaaagggccttttctctttcctttaaaaccaatatggcatatttgctgagaacttagataccacaggattggcagtgtagacttacattcatagaccggatgccatcagccaaccttgagtaatttgcagcacactgcatcattttatttaagtaatgcgaagtccttgacatgtctcagacattgtcttggttacttgtaaggtctcacataaatctaattttcctctttctctgccctttctggttcagctcagtttattcaagggtgtatttgtgcaacacacttgaataaggtgtggtcccgcctttgtagatgttatagtttgggaagaccagccgggcagagagaagagcatgattcaaggatgaaggcgtgggctgggggccgagggagcaaggattcccagtaacgagggaggaaggagcagcaccatgtgcccattactctatagacatctcgaaccacctggccatgtagctgtcattaacctaaatttacagttattgaaactgaggttcagccaggcgtagtggctcacgcctgaacacaggaggcggaggttgcagtgagccgagatcacgccactgcactccaggctaggtgagagagcgagactctgtctcaaaaaaaataaataaataaaagaaaagaacaaaactgaggttcaaagaaatgtacagtgctcccccccttatccaaagaggatacactccaagcccccacagtggatacctgaagcctcagatagtatcaagccctatatatgctatgttttttccctgtatatgcatacctatgataaagtttataaattaggcacagtaggagactaacaacaatgataataaaatggaacaattataacatacactgtaacaaaagggtctcttcctctctctctcagaatatcttattgtactgtactgggggtaactaaaaccaaggaaagtgaaaccatggataagggatatctactgtataaggtggagttttcaaggtcatagcactgccttcccctgaggttggccttgcagcctctctaggcactgctgctgctgctaagaacccctgtgaggtgaacactgtaagcatcatcattgcttctcagaagaggagacctggcttacagaggtcaagcctcaggtaccttaaacaccattttaaaactgaactcatggccaggtgcattggctcatgcctgtaatcccttctctccatgctcaaaacctgccctccttgtctttatattccaaatttcgtgggtgccacctcctctgcccagtgacttaagccagagcatacattcatcctagactctgtcccaggtccctggtccaggcagctgccagttgtcaggatcagctctttatctcgcagtcctcctgcctcttgtgtcattacccagggctgtcaccatcttttcttgggacagttacaacagccccgtaaggagttgtgctgcttctagtcttgttccctttgaatctggattccttcttgccatcaagacaatcctgatacaaatctgatcacgtcacacttcccttcaatagtcttccatggctccttattgttttaggatgaaatccaaactcctaaacatggggattaacaatgtgccatgattggcactgctggcctctcctacctctgcagactcacctcttgccacttctcccttgaggtagatcaaaaatggtcacaagttctttgaggctcttcccatcaagaggtagagtttatttccccacctcttggatctggcttgccttgtgacttgctttgacccacagaacgtaacagaaaggacactgcctaacttacaaatgaggtctaccttaagaggctttgcagattccacattcaacctcttggaatgctgccaccatctgagaagcctgaggtggcctctgtgaggatgaaagacttcatggtgagaaatacctagcgaacagcctggcaccagctaccaggcatgtgactgaggccatccagccatagctgagccacaaaatgaccacagctatgtgaattatcccaggtcagaccagtagaagagccacctggctgagctcagcccaatttgctgacccatagaattgtgaacaaataaaatggttgtagttataagccattaagtttcagagtttgttacacggtaacatgtaactgatacaactcttggagccagttgttcagccattctcaaccacttattcaatgatgttttgggccatatatgcagatatgctgttcccttttccttgaaatggcccttaccctcctttctgttgggttttcctatggaatatccagtcagcctttaggattcatcttgggtgtcccttcctgtatgtaggctccctggccctccaggattcccccagtaacagccctcatcatgctgcctttgcaaccatttgtttatttgtacctctcacctgctagttgggcaagttactcacttctctcaacctctgcatttttcttctttataaatgggaccaataatacctaccctgccctggcgtggatagattaaagaaaaaaaatacatgcagctgccattgagggcctggcccacgtgtgatgttcaataatattatttctccttgttttccttcccgtgccagtgccacacccccctgtcccagtgcactggggctgtggatcccttcaaagctgagattgcctgtctgtggtctccagcgttaagcacagtcattagctcaggtgcgtactcatgtgttccacgagttcaagcctcagccctgtaaagtttgcctgccgtgtatctgatatatttctgctaaaacccattaggcctttcttgctctgaaatgtcatcgttagttgtgtgtcacttcagttttgtaactggccaggccactgcgcccaggctgcttcctcgtcatctggctgctaaatgcttcaaccttacctgccttgctatgcgtcccatcctgtatcaggtcagagctcttgagtggtgaatacaaatttcatttcagttgacttttgattcttgtggcaggcctctcggcctactctaatttgattgcaacggacacaaaatgtgtccaaacttgcagcttttcttctcttattttgatatcaccatccacaaaggtaagatattttaaagcaataactacaaactttctgaaaattatgaagaagtgctgggttttaaatggaagtcatatagtgtgaactttgtgtaaagtccgtagggagttttcttggaaatggctgggaacattctttttgcacctttgaagataaaggtaggtggaggagctcacagctcttgtgccatgttgggcttgtcactcttgtttatgtgccaaattcttttgattacaaaattttaagtttaatgctttaggtattgttgggcaagatctagatgtatctagttaaatgtaggtgatatgcaaactatttatgatgtatttgatttaaattcattaagatagagtgtctttaccaccattatagtctggtccttttccttctgttttaaatgtgtttccattggcattttctaaactgactttgttagcgtgttaatcatttggcactggtaatgattaatcttttctttctttctattttttttcttttttttttttgagacagagtcttgctctgtcaccaggctggagtgcagtggcgcagtctcagctcactgcaacctccgcctcccaggttcaagtgattctcctgcctcagcctcccaagtagctagggactacaggcacgtgccaccacgcccagctaatttttgtatttttaatagagatggggtttcaccatgttggccaggatggtctcagcctcttgacctcgtgatccgcccacctcggcctcccaaagtgctgggattacaggcatgagcgactgcgcccagccgtgttcatctatttctgtgaaccgatgctaggtgaaggtacagagggctttctagcttctgggtttgtttattctgaaatgttattttaaatcttagcccaacaaattgagcgaaaagacttctagatgttaaatatgatattcaaaaaatataaagacaaggtgataaattagaattggtgggaaagagaaaaatctgtcttctgatggtcacctgccccagcaacactactcgtttgagaagacttccatcctttaccctcaaagtgttccatgaggttggatcagacatcatttagcaaagaaagatgtaaatagatttctgtagggtggcattattaagcatattaagtggttacaatacagtaaattagagggagtagtacagaagcataagcagtcaaaaaagtgaaagtctaacgttcgtaattattgttctggaggcttttgtatcacatataagttccaggctgggtatgatggctcacaccagtaatcccaacacttagaggccaagccgcgtggatcgcttgagcccaggagttcgagaccaggctgggcaacatagtgaaacctatctctacaaaaatacaaaaattagctgggggtggtggcagcgcctgtagtccaaaccacttgggagcctgaggtgagaggatcacctgggcccgggagatcaaggctgcggtgagccatgatcttgccattgcactccagcctgagtgacagagagagactctgtctcaaaaataaaaaagttttgagtgtgaaaattcaagctcaattccatttgttggttgtcttgagtgtctgatcacatagaatataaagatgttttgatagttgggacagtattcagctacctgctatttaatacattatttcagaaaatatttacaaagggggctgggcacagtggctcatgcctgtaatcccagcactttgggaggccgaggtgggcggattacctgaggtcaggtgttcaaaaccagcctggccaaacatggtgaaaccacatctctactaaatatacaaaaaattagccgggcgtggtggtgtgtgcctgtagtcccagctactcaggaggctgaggcacgagaatcgcttgaacccgggaggcgtggggttgcagtgagccgagattgcacaactgcactccagcctgggtgacagagtgagactgcatctataaaaacaacaacaaaaaagaaaatatttgcaaaggaccttctgggtccaagaacctcatgtccaatacaagggtgcacacgtgggtgagacacggcagctgctctccagaagcccacagtggaggggtttcccttcggtctccttttattccaagcaagtggcaaaactactttactcttaatacaaaccacttccttttatcacaggacgcttcccaagctctgcaactgttgctcctgaggaagggagtggaactgataatctgttcctccctattgtgttcagtatggttttttttttttttttccttttgctggctttgttttcctgtccctgtgatgattaaaattcactctgcaaattagatcacctttcccacgcagagtccctttgacttctgttctagatatccattacatttttgtagtcttcggacacactgtgtgtgccgctttgccctctgggtgacagcaggctgtggctgcggcgacagagctgaggtgaattctcacagaccatcactgggttactcctggagtaagtaattcccaagagctccttctgtgcagatcgttagaaatagatattgaggccaggcgcggtggctcatgcctgtaatcccagcactttgggaggctgaggcgggcagatcacgaggtcaagagatcaagaccatcctggccaacatggtgaaaccttgtctctactaaaaatacaaaagtagccgggcgtggtggcgcacgcccgtagtcccagctactcaggaggctgaggcaggagaatcacttgaacccgtgaaacggaagttgcggtgagccgagatcacgccactgtactccagcctggtgacagagtgagactccatctcaaaaaaaagagaaagaaagaaatagacattgaacacctgctacacagcagggattgtgctagaagtatggatgcaaagattaggtgaatatgttccctagcctcacaaagcatacagtctagtaggagagacagacacgtaaaaagtttcaacagcacagataatcagggctacaccagaattgggcccaagatgctgcaggaatctataggtgaatgggtttcatgaaggaagagcttcttctcccatttataactcattttagcctaatcttccaaacagtcacgcatctaagagcaggtgatgcagaaaataccctcgtgttagttatgaattaccgttggaatccttccagtgtttgcacctgccctgtgctcgggtaacataaaacagtgatataatttgatgtctacttcctcttgtatttgtctgtttttaagtgttctacaattttcatatactctgtttcatcgttctcaaaggaatattttgattgataaatgtttagttagtaagacctaaaaactgaatctcagtagtttgagcttatgatatacaagatgcagctctaacatttaaattggaagggaaatgtcaaaaagatacctgcactcttgtttgttgcaacactgtttacaatagctaagatttggaagcaacctaagtgtccatcaccagacaaatagataaaggaaatgtgatatatatacacaatggagtactattcagccataaaaaagaatgagatcctgtcatttacaacaacatgggtggaactggagatcattatgttaagtgaaataatccaggcacagaaagacaaacttcacatgttctcacttatttgtgggctctaaaaatcaaatcacttgaactcagagagattagaaggatggttaccagaggctgggaagggtggtgaggggttgggggcagtgaagatggttaacaggtacaaaaaactagaaagaatgaataagacccactaggttttttgttgttttgttgttgttgttgttttgagacagagtctcactctgtcacccaggctggagtgcagtggcatgatctcggctcactgcaacctccacctcctgggttcaagcgatcctcctgcctcagcctcccaaatagctgggattatgggcacgcgccaccacacctggctaatgtttgtatttttagtagggaccgggtttcaccaggttgaacaggctggtctcaaactcctgacctcaagtgatccactcgccttggcctcccaaatgctcagattacaggcgtgagccaccgcacctggccactgtttgatagcataatagggcgactatagtcaataataacttaatggtatatttttaaataacttaaagagtataattggattgttgtaactgaaaggatcaatgcttgagggcacagctaccccattccccatgacgtgtttagttcacattacatgcctatgtcaaagcatctcatgtaccccataaatatatacactgagtatataccacaaatattttaaataatttttaaaataaaaaaataaattgtaagggaaagaaaattatgaatttagaaatgtaaaaggtctcaggtaaggaaggaatgagaggatcatgcagaacctcccatcattgctgggactggaacagaagccctaccttttcccaacaccctatccacctgtccctcacctctcagcttttgtgagactctgtctgtgctatgaaactgaagatctaattcagtgctgtttgcattgtcttgcctcctggaccagaggttgcagttgttgagaaaagggatggttggttatgccttgatcccccccagagcatttggggcataggacacgggaactggccagcctggttcactcttctcgattagctggacagcggcatgtcatgtgggtaataggaaggggtggggacttccccgggatattctgctcctgatcagaagcgccagtgatgtggggggagccccagcaccagagcatgctgggagggcgtgcagggtggggcaggtgcccgtttggcctctgctgtctatctgggggatgcatccaaaggcaactgttccttatctgctcttgttgggagcaaggaagggccaatttgttcaatgatccgtatacagccagtccctctggccagagttcaagacagtattgcctcactctatatagagattgtatcttggttagctcttcattcatagcaagaccaatgtttctgtaaattaatcctggtattgtttaaaagcaactaaaaatgatgaaattgtaaaactttgaaactccctgaatataacgacaagcaaactaacattgttttattggtcgatgctcctggccagaagagagaatattagcagggataaaaggcataggccacatgcattttccaccccagtgctgagaacacgatgggcgaaaaagggaggtggccacagcccatccatcacacagtctctgcccatctacttgctttttcctttttttttttttttttttttgtgacagagtctcgctttgtcacccagactggagggcagtggtgcaatctcagctcattgcaacttctacctcccaggttcaagcgattctcctgcctcagcctcccgagtagctgggattacaggcacctgccaccaagcccagctaatttgtttgtatttttagtagagacggggtttcaccatgttggccaggctggttttgaactcctgaccttaagtgatcagcccacctcagcctcccaaagtgctgggattacaggtgcgagccaccacgcctggccccagctacctgttttctttcttttttttttttttttttctttttttgagacaaagtcttgctcttgtcccccaggctggagtgcaattgcatgatctcagctcactgcaacctccacctcctgggttcaagcgattctcttgcctcagtctcctgagtagctgggattacaggcgcctaccaccacgcccggctaatttttgtatttttagtagagacggggtttcaccctgttggccaggctggtttcgaactcctgaccttaagtgatctgcccgcctcagcctcccaaagtgctgggattacaggtgtgagccaccatgcccggccccagctacttgctttctattgggatgaacctcatggttaatacagttagttagtgactgcaacttttgaactttttgttcatagtgaaaaatattttaagtaatgcttaccccattatgtttcttgtcatttgaaaaaaaatctcccttcagacagaatgcagaataaaatactacagaaaatctgtacagagtcccagcctgacttatgctagtaggttacagagaaagaaagtcttctaaaccctatgaaaggttaacagttctcttatttttccctgtgtgctatttgatgatttccctgtgaactttgatgatttattgccagaattccaaacataatatgtgaatttcacaaaaatggatgaaatgtatctatttttcattggtagaagaagccaaaacatcccttcctcaccgcactaaaagctgttgtttacatgaagcaaacctcaaatgtgaacatatttttacgcaaatgcatttaatgggtgaatatttgctttgggacggtattctttactctatctggagagtctggcgttccgtaatcaccatgtgatgacggctgccctgacagtggctggtagcagcacatacccccgagcctctccgtggtgtgcgccgtgggcaccatgtgaccattttcagaaaggaagacagttctggaagctaaaggtcacctagtcagcctcgttgggtgattgatgactcagctgggttcagggaggtggacccgaggcagagcctctagaaggcagcggtgggcagggcggttcaggcaggtggcacctgggcaaaggtgcagacgtggaatcctgaaagcaattctcagcgctgctgcgtttccaggaggtagaagaacagtgacaagtgcacagtcgggtagggacaaatgtggaagggctgggaacagtgtgttcaggagactgggcttcaatctggaggtctcaggaagtggtttaggatgtttcagcgagagcatgatacagactaacccaggaagaaccgctgctttgtcacttatacccctatggaaatgccgttcgctttgctagttgaaatagcctaccattgtctgggactcacccagttagatttgtttggactccacaaagtattcttgaccatacaatcatggtcgaggaccccctacatgagctgccttcatggctacagggagagcacaccaaagtggatgtcacacccagcacacatgccaccggcttggccctgcgccccgcagcctgagccacactggctgcctgttcctggaatgtgccaacatgtttcagtcctggagcctttgcacttggtgttctcttcgctggaacattctcccccaagacatttacacagcttgccccctcattccctgaggttatctcctgccccctaatcagtgaggccttccctggcctcaccccggacactccacacgtgcattcatttcgttgttcaccatctgtgtcccagttacaagggaggctccctgagagcagggatctgatttttgttagttgttgttgttgctgttttgaggtggagtcttgctttgtcgcccaggctggtgtgcagtggtgcgacctcagctcaccgcaacctccgcctcccatgttcaagcggttctcctgcctcaacctcctgagtagctgggattacaggtgcctgccaccatgcccagctaatttttgtatttttagtagagacagagtttcatcatgttggtcaagctgccctccaactcctgacctcgtgatctgcccacctgggcctcccaaagtgctgggattacaggcatgagccactgcacccgaccctgttttttgtttggttttggttttggtttggttttggtttttttttgagacacggtctcactctgtcgccccggctagagtgtggtggcaccatctcggctcactgcaacctccacctcccaggttcaagtgattctcctgcctcagcctcctgagtagctgggattacaggcacatgccaccacacccagctaatttttgtatttttagtagagatggggttttgccatgttggccagtctggtctcaaactcctgacctcaagtgatccgcccgcctcggcctcccaaagtgctgggattacaggtgtgagccactgtgcccggcccagggatctgtttttgtctccgctgtgtccccagcacctcaaacatattgtacggagctgcgacagctgcgcagtcagtgatgactgagagattcctggccccgtgggctatggctccttcaacagtttgttgtttaaaggttcttcactttctcagcgtgctgatcaagagacaagcctggaggagaggctcagtggtgctcctgtgtagatgatgaattcaggtgtatcttggatggtaaatgacgttgcatttaaaaccaagcaagtggccaggcgcagtggctcacacctgtgatcaaagcactttagaaggccgaggcgggcggatcacctgaagtcaggagtttgagaccagcctggccagcatggtaaaaacccgtctctactaataatacaaaaaaactagctgggcgtggtggcgggcacctgtaatcccaaccactcagaaggctgaggcaggagaattgcttgaacccgggaggtggaggttgcagtgagctgagatcgcaccactgtactccagcctgggcgacaagagcaagactctatctcaaaaataaaaaaaattaaaaattaaaatttaaaattaaaacaaacagccggacgcagtggctcactcctgtaatcgcagcactttgcgaggctgaggcgagcggaatacgagctcaggagatcgagaccaccctggctaacacagtgaaacccgtctctactaaaaaaaaaaaaatacaaaaaattagccaggcgtggtggcaggcgcctgtagtcccagctactcaggagactgaggcaggagaatggtgtgaacccgggaggcggagcttgcagtgagccgagattgtgcccctgcactccagcctgggcaacagactgagactctgtctcaaaaaaaaaaaaaaaagaataaataaataaataataaaaaataaaaacaaacaagtgaacgttgttatacgtcagtcttaccaattgttcctctttcctcccagtagcttggagctcggcggcacaaccagcaccatctggtcgcgatggtggacacggaaagcccactctgccccctctccccactcgaggccggcgatctagagagcccgttatctgaagagttcctgcaagaaatgggaaacatccaagagatttcgcaatccatcggcgaggatagttctggaagctttggctttacggaataccagtatttaggaagctgtcctggctcagatggctcggtcatcacgggtaagtgtgccgtttcctagaaagttttatttagaaatgtttcttcctccaagaaaactgttctctcttttttttttttttttttttgagacggagtctcgctctgtcgcccaggctggagtgcaatggctcgatctcggctcactgcaggctccacctcctgggttcacaccattctcctgcctcagcctcccgagtagctgggactacaggtgcccgccaccacgcccagctaatttttgtatttttaatagagacggggtttcactgtgttagccaggatggtctccatctcctgacctcatgatctgcccgcctcggcctcctaaagtgctgggattataggcgtgagccaccgcgcccggccgaaaactgttctctttagctggaaaagaagtcacacttttttgcaaagaaagcttcagacgtggtaaagcatgacctccagtgcccctgggccctggaaggcgcgtgtcacggctcacggtgccccctcttgtgaaagccatgcacacatcaaacagtgcttgagattcagtcacggggaacagctaaagtacacagaccctaaccccagcaagcccgcggggggcagctagacatttttaagaggagacgtgtgcaagggtctgcatagaggtactgttggtaagagggaaggatgggaaacaagctgtacatgcgtcaaagggaaacagataaattgggatgcatttatacagtggtatatacttcatagcaatttaaaagaacagactaggctaggcgcggtggctcacgcctataatcccagcactttggaaggccgaggcaagtggatcacttgaggtcaggagcttgagaccagcctgaccaacatggtgaggccccatctatacaaaaaaaatttaaaattaaaaaaaattagccaggcatggtggtgcatgcatgtggtcctagctactcaggatgctgagggaggaggaccacttgagcccaggagctcgaggctgccatgagctatgactgccactgcactccagcctgggtgacagtgagaccctgtctttaaaaaaaaatttttttaagcaacattgaatgaaaataaacaagcttaatgaatatttttatgatccaattaatgtaaaatcttttattttttattttttgagacagagttttgctcttgttgcccaggctggagtgcagtggtatgatctcagcccactacaacgtccatcttccgagctcaagcagttctcctgcctcagcctccctagtagctaggattacaggcacccgtcaccatgccgggctaatttttgtatttttagtagagatggggtttcaccgtgttggccaggctggtctcaaactcctgacgtcaggtggtccgcctgcctcagcctcccaaagtgcagggatcacaggcatgagccactgcacccggcccaattaaaatctttaacactaaacaatctagtacatcactggtggaaacagacatacacctattgcaaagggcatctcagctttaaggactcagtcacctcctgagcaagatggagggagaactggggaggggtcccatggggactgtaattctctctaggttgtatatttttaaaagacttcagcagtgtgataaacctgggtggtgtgtacatgggtattacagtcatgttgcttaatgacagggacaggttgtgagaaatgcatccttaggtgatttcatcattgtgtgaaagtcatagagtacacttaaacccagatggtagagcctgctgcacaccgaggctctgcggtgcagcctgttgctccaaggcacgcacctgtacagcgtgttactgtactgaacggcgtaggcccctgtgacacaatggtaagtatttgtgcgtctaaacataccaaaacatatagtagaaaaggttacagcaaaaatacagtattatcatcttatgggaccatgataccacagttgaacttatggtctattgttgaccaaaatgtcactgtgcagtgtgtgactatacagaaataagctcagagaaattaagtaacttggctgggcgcagtggctcacgcctgtaatcccaacactttgggaggctgaggcaggcggatcacccgaggtcaggagttcaagaccagtctggccaacatggcaaaaccccatctctactaaagaatacaaaacattagctgggagtggtggcaggtgcctgtaatcccagctactctactcaggaggctgaggcagggagaattgcttgaacccaggaggcagaggttgcagtgagcagagatcatgccactgtactctagcttgggcgacagggtgagactccatctcaaaaaaaagttggggcgtggtggctcatgcctgtaatcccagcactttgggaggctgaggcgggcggatcacttgaggtcaggagttaaagaccagcctggtcaacatggtgaaaccccatctctactgaaaatacaaaaattagccaagcatggtggtacacacctgtaatgcctgggcaacagagcaagattccgtctcaaaaaaaaaaaaaaaaaaagtaagtaacctgccacggttcatacagccagaaagacacagagccgggcctggaccccgcctctcagcttgctctagagggctattctctgcatgctggcatgatcgcgccttgtaaaaggtggcagtgttctcagcttagtcaatcaggaattgcaagaggcaagtgagcccctgaggactctggggggcctttgtgaccgagcagctttgggagtgaccctgacagacctttacaggtggtgcaagttttgactccctttctcctggcgcgttaagcagaggataagcgctgtggaaggagtgaaggtgtagggagatcatggcccccagagcagtggggaaggggacagggaggctggaggagagcaaggaaaaggctccgtgtcaggtggcgccttgagtggcctgggtaggttgtcttgcagtgaacccgggttaatggccttgacaatgaccgcattgtttcctgagcactgcaggctgcccacacacctcacacctcggcttgcctaagcccagagcagccttgtgaggtcgttgttatgtttatttaaggaaggaggaaaggaggcaggtcccaggacatcctgacgtgctggagatcaccagcccagaacccagctcttaaccccacaatgtgggacctttcttcacccatcacagacacaccccatgctggttcaccgttttcctataatgactatttgtgctatttattagaaaaatcttttccttatggatttgaaaagatttatcttgcttttgtttttcttttttgcctttcttttttaaggcaggcaggctcccgcagccccacccccagggtgaaaaatatagttcattgtctagtaaaagagttcagagatacacttttttctttgggtaagatatactctagagcttgttctgaaatatggaatttgtgtgagctgcgggagtgggtgggtgtgtggctctagctctggaaagttctttcctggcagtggccaggagggctgcccagccccctcctgcctcctctggcagcttaaacacaggaccccttattctgtgctctctcctgacccctggtcctcatgcaggagggaaccctgctcttctagggtccttttctaaaagtagtgtcttttaggtcattgtcaagaactataatctaaaatgtatttttaactcatctggaaattctgacagaggtaaggcttgagaatttcctgcatactagccttgtggtctatataatccattaaaagccacatttaacccaattccacagactgaactgtgcttcccatctaaataaattaaaagcaggccgggcacggtggtcacgtgtgtaatcccagcactttgggaggtcgaggcgggtggatcacctgaggtcaggagttcgagaccaacctggccaacatggtggaacctcatctctactaaaaataaaaaaaattagctgggcgtggaggcgtgcacctcttaagcttaaggacatatttcttatgatccaattaatgtaaaatattttattttttatttattttttgagacagagtttcactcttgctgcccaggctggagtgcagtggtgcgatcttggcctgtaatcccggctactcaggaggctgaggcaggacagtcgcttgaatccaggaggcggaggttgcagtgagccaagatcacaccactgcactccagcctgggcaacagagtgagactctgtctttaaataaataaataaataaatagcgagggttcagggcaggagaaaaagggttccaaatttgttctgaaccaattccaaggaactttatggcacaaagaaaaaaaaggggaacttacaaaaagtgaccacactgaagcgtcctggtcacccatccctggttttgaccaccagcctttaaagtggcaagcgggtgataacccatttcttatttccccctcagcatttcctcactgttattcatacatgtggtcatttgtactcatctcacaattgttaaaacctctttcctcccttccaggttttactgaactgttactgcgaagtctgagagatgaggtcatttaagattatttcttatttgtaaattagatcgttcatatttgtacctaatctgatcttttgggtaatattcctagttatgtagactggtctctcagaagagccggatattaaatgcagtactttaaactttacacccaggagaccggatgggtgaggctggttcactcggccaaagtaccattttatctctgctttttcttcccggctttattgccataattgacatacaataaactgcatgtatttaaagtgtacaatctgttgggtgtacacacacacgcatctgtgaaaccatcatcacactcaaaatagtgatgtagaaattttgctccttagttcgactaaatctgggttcttgtgtcatgaccaggaaaaattaggcacgtggacacgttgaagggtgaggagagcagtattgggcgaaaaggaaaaaagaaaaaaactctcagcaaagctagaggggatcctgccaatgagttcccagctcacagactgattagcaggccaccacacatgagctggaggccaggctcctcccgctgcgcaaggtgagaacttcccgtggctccaccccattctcccaatgcccaggtgggtccccgtcccttgcgggcctgtccagacaagggaaccctgggcaggttccctcatctacacaaaagcacctgaggtaaacacttgtggggcaggttgcagattctctggggacgccccccttctctgcctcctgcatctatcagtagtgcctctgtctgtcacccctaaagtttacttgtgctgtttctaattcctctttccccagccccgtgcctccctgcctccctcccccagtaaaccatgaatccactttctatcattctaggttgctttatatttcctagaattttatataaatggaatcatacagcacgtactctttctaggctggcttctttcactctgcagaatggctgtgagactcatctgcattgcagcaagcatcaatagttcattcttcatccatcatgtggacatagcacagtttgctgattcacgcacctgttgatgagcatttaggttgtttctagcttatggctattacaaataaagctgctatgaacattcacgtacaagtctctgtacaaccctctgctttcatttcttttgaataaatacctaggagtatgacggctggaacagatggcaggtgtttgtgtaactttttaagaaactgccaaaatcttttccagcatttcagaaaaatcttagaaaatgctatactatgttatattcccactggcagtatatgggggagttccagttcctccataccctcatcaacatgaggcatgatcagtctttttaattttaaccatgtcagtaggtgtgtgatggtctctcactgtggtgatttttatttgcacttccctggtgattttgagcatcttttcgtatgcttatttgccatatatcttctttggtgatatttctgttcaaagcctttgctcattttttaattgagttgcttttctactattcactattgaacactatttatatattttgaatacaaatactttatcagacatgtgatctacaaatattttccccagtgtgtggtttgtctttcttttctttctactgatagtatcttaaaaaaaaaaaagaaaaaagattgttttgtttgttttgttttgtttttgagatagggtctcaatctattgcccaggctagagtgcagtggtgcgatcatggcttactgcagccttgacctcttgggctcaggaaaccctccgacctcagcctcccaagtagctgggaccacaggtgtgtaccaccatgcttggctaattttttttttttagatacagagactcgttatgttgccaggggtggtcttgaactcctggactcaagcgaccctcccacttcggcctcccaaagtgctgggattacaggtgtgagccatcatgcccgaccagttcttaattttgatgaagtccaatttatcaatgtcctttttttatggatacttcatttatttatttatttgagagagggtctcaccctgagcccaggctggagttcagtggcatgatctcagctcactgcagcctcaacctcccaggcccaggtaatcctcctacttcagcctcccaagtagctgagactacaggtacctgccaccatgcccgggtaagttttttgtatttatttgtagagacggggtttcgccatgttgcccaggttggtctcaaactcctgggctcaagtgatctgcccatctcagcctcccaaagtgttgggattacaggcgtgagccaccatgcccagccatatatatatatatatatatatatatatatatatattttttttttttttttttttttttttttttgagacagagtctcactctgttgcccaggctggagtgcagtggtgcaatcttagctcactgcaacctccttctctgaggttcaagtaattctcatgcctcagcctctttagtagctgggattacaggcatgtgctaccaggcccggctaattaccagccttatatttttgaactctgtttaaaacatttaggtgcataaacattcaggcttgttatattctgttgatgaactgaaccttttattattatgaaattgctgttgtaatccgtggtaaaattatttgttctgaacactactttgtctgttattgatgtagccactgcagctttcttttgattggtgttaacatggtatatcttttcccattctttttcttttaactggtttgtgtctttatactatggtttgatttaaatctattatctcacaatttgttctctttggtacatctttgttttgttcccttttcctctttttatgccttctgttgaattaattgagtcttttttgttttgtttcatttaattttgttttttgagacggagtctctctctgtctccaggctggagtgcaatggcgctatctcggctcactgcaacctctgcctcctgggttcaagcaattctcctgcctcatcctcctgagtagctaggatcagaggcatgcaccaccacgcccggctaatttgtgtgtgtgtgtgtgtgtgtatttttactagagacgggtttcactatgttggtcaggctggtctcaaactcgtgaccttgtgatctgcctgccttggcctcccaaaatgctgggattataggcgtgagccaccgcacccagcctaattgagtcatttttaagattccactttatctcctttgttggcttattatttataacaccttctggtgttattttagtagttgctttagggtttatagtgtatctctctaatgtctcccagtctaccttccagtggtatcattctatcttacagatattataagaactttatgacagtatactttcatttttcccttcatgcatttgtggtaatgtttcacataattttatttatttacctacattataaatattacaatatgttattgttttacatagacagccggttatctttttaagatagtagtaagaaaaattttttacatttacccacataattaccttttctagtgctatatacctttgtataaatccagatttccatctgctatcattttccttctgcctgaaagacttcctgtgatattatctataatatggctctactggtaacgaattactagcttttgtatgtctgaaaaagtcttcatataaccttcattctagaaagtatgtgattcaaagggccgggcacagtggttcacgcctgtaatccgagcactttgggaggccgaggcgggtggatcacctgaggtcaggagttcaagaccagcctgaccaataaggtgaaaccctgtctttactaaaaatacaaaaattagctgggcatggtggctcatgcctatagtccctgctacttgggaggctgagacaggagaattgcttgaacccaggaggcagaggttgcagtgagccaagatcacgccactgcacaccagcctgggtgacagagcaagactccatccccctgcaaaaaaaaagaaaaagaaaaagaaaaaagtatgtgattctacattggcaattttttttttttttttttttttgagacagagtctcgctctatcacccaggctggagggcggtggtgccatcttggctcactgcacgctccgcctcccaggttcacaccattctcctgccccagcctcccaagtagctgagattacaggcacccaccaccacacccggctaatttttttgtattttttagtagagatggggtttcaccatgttagccaggatggtctcaatctcctgacctcatgatccgcccacctcggcctcccaaagtgctgggattacaggcatgagccaccgagcctggccactttttttctttaaatgcttttaagatgttcctactatcttcttgtttttaattaattaatttattattattattattattattattattattatttttttttttttttttttttttagagacagggtcttgcgctgatgccgaggctggagtgtgctagtgccatcgtagctcactgcagtctcaaacacctggtctcaagcaatcgtcctgcctcagcctcctgaggaactaggactagaggtatatactaccatgcccagccaattttaaaaattttttgtagaggtggagactcgctatgttgaccaggctcctctcgaactcctggcctcaagcaatcctcctacctctgcctcccgaagtgttgggattacagggattacaagtgtgagccactgtgccagtccccactgtcttctggcttgcatcgtttctaaaagaaacttggtgtcatccttatttttgtttctctacatgttatatgtcctctttatctggttgctttaactttatttattaattttagtttaatttttaattgacaaataataattgtatttttatggggcacaatgtgatgttttggtctatgtttacattgtggaatgtgtaaatcaagctagtgaacatatccaccacctcacacacttaccattttttgtgtgtggtgagaacatgtaaaggctgctccttgaggccaggcccaatcccagcactttgggaggccgaggcgagtggatcacttgaggtcaggagttcaagactagcctggccaacatggtgaaaccccgtccctactaaaaacacaaaaatcagccaggcgcggtggtacacgcctatagtcctagctacttgggaggctgaggcaggagaatcacttgaacccaagaggcagaggctgcagtgagccaagatcatgctactgcactccagcctgggcaacagagcaagactccatctcaaaaaaaaaaaaaaaaagtctattccttgagcaattttgaaatacacaatacatcattgttaattatggtcaccatagtgggtagtagatcactaaatcttattcttcctgtctaactaaaacttttttccttttgaccaacatctccccattccctccctcaacctcagcccctgataaccaccattccactctctactgctatgagtttgacctttttagatttcacatatgagatcacatggtatttgtctttctgtgcctggcttcttttacttagcataataccttccagatttacccatgttgttgcaaatggaatttccttcttttttaaggctgaatagtattcgtgtgtgtgtgtgtgtgcgtgtgtgtgtgtgtgtgtatcacattttctttatctcttcgttcattaatgatcatttaggatgattccacatcaggctactgtgtatagtgctgcagtaaacatggaagtgtagacatctcttcagcatactgcttccaatctctttggatataaacccagaagtgggattgctggatcatatgtagtgctatttttgtttttttgaggaacctccatacttattttgcataatgctattctaattcacaatactaccaacagtggacatgggttcttttttctctacatgcttgccaaccacttgttatcttttatctttttatatatctggctgcttctaaatttttttctttcttaccaattctgaaccatttgatggtttcttcctttatgctccttgtgcttgaggttcattgagcatctgggatcagtgcacttattgttttcatcaaattcagaagattaggccattatttcttcaaacttttttgtcgttctctgtctacctttgagagctccaattatacatacattaggccacttgaagttgtcattacagttcactaatgctaagttctttttttaagtcttgtttctgtgtttcattttggacactttctattgctacatcttcaaatttactaattttttcttctgcaatatctaatctgctcctaatcctatccagtgtattttccatattagatattgtagttttcataactagaagcatgatttggttctgttttcacccatgtatctatataacatgtccagtctttcactcagcttcttaaacatttagaatatggtcagaataactttttttgctgttttgttttagagacagggtctcactttgttactcaggctggagcgcagtggcatgatcacagctcactgcagccccaacctcctcgtctcaaggaatcctcccacctcagcctcctatgtagctgggaccacaggtacacaccaccacacctggctaatttttaaattttttgaagagacgggtctcactttgttgcccagactggtctcaaactcctgggttcaaacaatcctccagccttggcctcccaacgtgttgggattacaggcatgagccactgtacccagcccagaataactttttaaaaatgtcttgaggccgaggttgggaaataatctgaggtcgggagttcgagaccagcctgaccaacatggagaaaccccgtctctacaaaaaatacaaaattagccaggcacagtggcacatgcctgtaatcccagctacttgggaggctgaggcaggagaattgcttgaacccgggaggcagaggttgtggtgagccgagatcacaccattggactccagcctgggcaacaagagcgaaactccatctcaaaaaaaaaaaaaaaaaaaactcttagccacaatttctatcatctgtgtcacttctgagtccctttctattcagttatttttctccttgtcatgggtcatatttttctgattcttcatgtgtcctgtaattttcttttctttttttttttggagatggagtcttactctctcacccaggctgtagtgcgatggcacaatcttggctcactgcaacctccacctcctgggttcaagtgattctcctgcctcagcctcccaggtagctgggattacaggtgctcaccaccatgcccagataattttttgtatttttagcagagacggggtttcaccatgatggccaagctggttttgaactcttgacctcaagtgatccgcccacctcggcctcccaaagtgctaggattacaggcatgagccaccgtgcctggccagttgttctcattggatgtcatatgttgggaactttattgggtgatggatatttttgatttcctataaatattcttgaactttgttctgggatgcaattaagttacttggaaaatctttgatcctttcaggtcctgtttctcagcttcattagatgggactatcacagtgtttgttttagagataactttgccccactgctgaggcaaaaccactttgagcttcacctgatgccccatgacttcagtgatcttccactgtgggaggcgagagcaggactatatccagctccatgtgggccccaggcagcgttcactatcatcatttcaggttgctactgaagtatccctttttcaggctctcagctggcagagcaaatacatatatgtatacatactaacctatgtctatacaggaatctatcggtatttctgtctgtggccatctgtagctgtatgaagccaaacatgagtgtgtgctgatgtctccagccctcatctgttaccagatggatcgttctagcctcctccacttgcctacctgtcaattcaccattccttgagttcatggttcattttcagtatacctgcacagtggtatcagaactgttaacccacaccctgtgggaaaaaaactccatcagctagagcacagtgtttacagccagatccttttgcctttagtcttacagattccaatcattccaaattattcggtgcagcgcctttccgcacctgcacccactttttcccctgagattgtttcctacattcgtagcacagttagattgttttgttacattctgcatttcaccctgggatcctccaacctcctaagttatttttgttttatttgcacacattaggttcaatctgaactataaagttctgtgggttttcacaaatgcgtagtgtcatgtatccaccactacattttccttctctctctttcttgctttctcgccttcttgtcttgctctgtcacccaggctggagtgcagtggcacaatctcggctcactacaacctccgtctcctgggttcaagccattctgctgcctcagcttcccgagtagctgggactacaggcacgcaccaccacccctggctaactttttgtatttttacaaaatacaaaagacgatgtttcactatgtgggccaggctggtctcgaactcctgaccttgtgatccacctacctcggcctcccaaagtgttgggattacaggcgtgagccaccacacccggtctctctccttcctttcctttcctctcctttccttttctttctttctctttccctctcctctcttctcctctcctctcctttgatggaggtctcactgtgacacccaggctggagtacagtggcagcataatctcagctcactgtagcctcagcctcccagggctcaggtgatcctcccacctcagcctcccaagtagctgggattacaggtgcacaccgctgagcccagcaaatttttgtattttttgtaaagatagggtttcaccatgttgcccaggctggtctcaaactcctgagctcaagttatctgccagcctcggcctcccaaagtgctgggatgacaggcatgagctaccgtgcccagaccactgttagattttcatatgaatagtttcaccacatcaaaaaaccccatgcttcacctattcaaccctgcctctcccacccccagccagctcagaaatggttctttttaccattgctataattttgccttttccagaacgccatgaatttgaaatcatatagtatgtagccttttcagactgacttctttcatagcaatatgcatttaagagtcatccatgtctttccatggcttgatatctcatttctttttacactgaatgagttcccactgtctgtttgtaccacagtttgtatatctattcacctatctaagggcatcttggttgcttccaatttttggcaattaataaagctggccatgcacagtggctcacacctgtaatcccagcattttgggaggccaaggcgggcagatcacttgaggtcaggagtttgagaccagcctggccaacatggtgaaacgctgtctctactaaaaatacaaaaattagccgggcgtggtaatgggcacctgtaatcccagctacttggaaggctgaggcaggagaatcacttgaacctggaggcagaggttgcagtgagctgagatcgtgccactccactccagcctgggtgacagagtgagactctgtcccaaaaagaaaaagaataaactgctgtatacatgtgtaggttttgtgtggacagaagttttcaaatcagttggacaaatacctaagagtgtgattccatcatacagtaaaactgctttgctttgtcagaaactgccagaatgtcctccaagggggctgtctcatgttgcattcccaccagcaatgaatgggggttcctgttgctccacatcctcaccagatttgatgatgtcagttttgtggattttagtcatcctagtaggtgtgtggtgacaccacattgttgttctcattctcagtgccccgatgacatatcatgctgagcattgtttcatatgcttacttgccatctgtatatcgtccttgctgaagtgactgttcagatgttcagatcttttgcccattttctttctttttttttttttttttccttttgatacggagtcttgctctgtcgccaggctggagtgcagtggcacaatctcagctcactacaacctttgcctcccgggtccaagcgattcccctgcctcagcctcccaagtagctgggactacaggcacgcaccaccatggcaagctaactttttcttttttttttcttttcttttttttttgagatgaagtctcgctctgtcacccaggctggagtgcattggtgcgatcttggctcactgcaagctccgcctcctgggttcacgccattctcctgcctcagcctcccgagtagctgggactacaggcgcccccaccacgcccggctaatttttttgtgtttttagtagagacggagtttcaccgtgttagccaggatggtcttgatgtcctgacctcgtgatccgcttgctccggcctcccaaagtgctgggattacaggcgtgagccaccacgcctagcccccatttttcaattgagttgtttgttttaagacctctttgtatattaccacatgtgtattgaaaatattttctcccagtctgtggcttgtctttaattttcttagcaatgtcttttgcagagcagaaggtttcattagctttcatagattccaacttatattttctctttcatggattgtgcatttggtgttgcccacacagatttttatactgtattctggtgccatttactgagttaacaattgcggaagaactggaagaaaggaagcaaacaaaacgagttctgcgtggcactgtcagtgcgggggcatggggagtcctgcagggtgaggtatgggcggtatggcaaggcgcgggcccatagatgtgcaggtctggagatgtgtgcagcggagatgtgcgggcccgagatgtgcgggtccgatgtgtgggtccggagatgtgcgcgtacccagaggtgcagatcggaaatgtgggggtccggaggaaatgtgcggatcaggagaagtgccagtcccgagatgtgcggatcggagatgtggagggctaggagatgcgtgggtccggagatgcgcagatcaggagatgggcgaatcggagatgcgcgggtccggaaatgtgcagagcggagatgtgtggatcaggagatgttggggggtcaggagatgcgggggtccagagatgtgggggtccggagatgtgcgggtctggagatgtgcagagcagagcaaagatgagctgatcggagatgcccaggtccggggatccacgggtccggagacgcgcgggtccggagatgcgtgggtccagagatgtgcgggtccaaagatgtgcaaatctgaagatgtgtggatgggagatgtgcaggtccggagatgcgcggggcggagatgtgtggatcggagatgctcagatcgaagatgtgggaatgaggagatgtgcggggcgggatgtgtggatgggagacgcgcgggcccggagatatgcggggcggagatgtgcgggtccagggatgtgtgatctgaggtgtgtgggtccggagctcggggtcagctcagcagcagtgagagcgagcatgctggctttgggagcacagcacaatggcagctgtaggagtgcaagagggtgtgacccagaggcagggcccggccccgcatgggtgttctgaggtttatgcctcagcactagaagcctcgtatgcgaaatcacatcctcatagacccggttcagacacaggatagtgatgcctggactattcatccgtctctcctctttttccccagacacgctttcaccagcttcgagcccctcctcggtgacttatcctgtggtccccggcagcgtggacgagtctcccagtggagcattgaacatcgaatgtagaatctgcggggacaaggcctcaggctatcattacggagtccacgcgtgtgaaggctgcaaggtagaggggagctggaacagggcctggtggccgccaccatcaactacttatggtcacttttatagcaaatggcagtcattactgagagattgcagaaagtcccggataagaaactgacttcaggccaggcgcggtatctcatgcctataattccagcactttgggagaccgagatgggtggatcacctgagatcaggagttcgataccagcctggccaacatgatgaaaccctgtctctactaaaaataccaaaaaaaattagccaggcgtggtggtgggcgcctgtaagcccagctactcgagaggcaaagacaggagaattgcttgaacccaggagccagaggttgcagtgagccaagattgcgccactgcactccagcctgggcaacaagagtgagactccatcttaaaaaaaaagaaagaaaaaaagaaaaagaaaaagaaactgacctcagtgatagattagcctctctttatagcacagaacccctgagagcgtaagccctgttgtgaactgcgtatttgaggaatctagcttgtacgccccttatgagaatctaatacttgatgttccaaggtggaacactttcatcctgaaactatccctccccacccccatctgtggaaaaattgtcttccatgaaaccggtccctggtggcaaaaaggttggggattgctgctttagagagtctaggacaaatggttcctctgtgctttgtaaatacttagagaagtgcattctttaaaagaaaataagtcacattggaccgggtgcagtggctcacgcctataatctcagcactttgggaggccgaggcggctggatcacctgaggtcaggagttcaagaccagcctggccaacatggtgaaaccctgtctctactaaaaatacaaaaattagccaggtgtggtggtgggtgcctgtaatcccagctacttgggaggctgaagcaggagaattgcttgaactcaggaggcggaggttgcagtgagctgagatcgagccatttcactccagcctaggcgacaagagtaaaacttcatctcaaaaaaaaaaaaaagagagaaaagaaaataagccacattaagaacatcacttcattcgaatacaagacagagagctgttaccgttgatctctggagcctccctgaaggccaggtggggcaggtgttctcatgctcctgccagggaaattggccatcagagacacagagtatcttgcttagggtcccacagcccccagcagcagggactggaaccagagactggctgctcctgctccccagcagttccttcctgcacatcaggggcttctccacctgattcaagcgacaggaaccccctgtgcatcttcatcctcctgctggctcagcctgccctaaacagatgtgacctgggccaggagtgcatgaaggcaggccctgttgtcctgcatgctgccagctggactggtggcccttccgtgtttgtcagcgtggtgatgaggagagctcctgtagcagcgtccctttagggttgcacagacgtgctcaagtctggcgccttatgtacgtgatatgtgggagatcatcatctgaatgtttggtttgaatcagaaatcccttctcacggtgcacgctgcaggtgttcactaacttggaaaatgccaccgcctttctggcacaatgtaccatcttggaacaccagcattctgccctgagccaggcctggcctcagaggcctgggccacagggagaacctcacagccaggacactgtggcactctgctgtctagaagcctgtctccccacccttcccattctaaccccatgcgttcctcagcctccccactgtgcaagcctaggtaaggacattatgaagacgtcagcctgcctctcacattcccctgcacactgctgtccctctcccgcgggccaagcagacccactgtggcaaaaatatagaagaatgacttaaaagcaaagagaaaaaagaacccaaagcaaaaatgaactccttcgcatgttttctaaccatatacctttgaaaaagctccttataaagtggccttttccttagggccatgattaattattcatttagttttgttttttatggactatttagtaacattgtttcttgctgggtagagtttaagatgcttttacaaagcaagaaaattgtttacaaacagctggcttccttttattataatttttgtctttgagggagttaatatactcttacaaaaattcttagaaagtctttagtcacaaatatggaaatgtcacaatgctggggatagttacattcatatacattgtaacaaggctgagtaactctttggaaaactataattgtgttttcccaagtcagatgagggcattttgaaatgacttcgaatgctgcctcattttattgtttttcacattaaatgtaacgacatttaaagttctgtatttgtcctaatcattccagacttcttagaagaactatttctttctttttttttttttttttttttttttttttgagatggagtctcactctgtcgcgcaggctggagtgcagtggcacaatctcagctcactgcaacctccgcctcctgggttcaagtgattgtcctacctcagcctcctgagtagctgggactacagacttacatcaccatgcccggctaatttttgtatttttagtagagacagggttgcaccatgttggctaggctggtctcgaactcctgacctcaggtgatccacccgcctcagcctcctaaagtgctgggattacaggcatgatcaccatgcctggcctggaataacttttctctaaattttgttcatttaaaaagaaacaataaatgagcaacaaaaaaggtgagtaaagcaagtgcgctggtttctcagtggcccaggtctttaaatccactgtgtattaccctcacagggcttctttcggcgaacgattcgactcaagctggtgtatgacaagtgcgaccgcagctgcaagatccagaaaaagaacagaaacaaatgccagtattgtcgatttcacaagtgcctttctgtcgggatgtcacacaacggtaggtaaggtggccctgcacattttcccagttcgttcctcagttccccttccttgctccaagggaacagatcaagctatggatgaatgtgcttcaacatttcacacccaagtcattttgtaatcagagtggcctaagaaaataaaagtcgcccaggcgcggtggttcacgcctgtaatcccagcactttgggaggctgaggtgggtggatcacctcaggtcaggagtttgagaccagcctggccaatatggtgaaaccccgtctctactaagaatgcaaaaattagctgggtgtggtggcacatgcctgtagtcccagctactcgggaggctgaggcagaagaatcgcttgaacccgggaggcggaggttgcagtgagctgagattgcgccactgcactccagcctgggcgacagagggagattccgtctcacaaaaaaaaaaaaaagaaaaagaaagaaagaaagaaaataaaagtctcccaggtgcggtggttcacacctgtaatcccagcactttggaggccgaggcgggtggatcacttgaggtcaggagtttgagaccagcctggcgaacatggcaaaaccccgtctctaataaaaatacaaaaattagctgggcatggtagtgcacacctgtaatcccagctacttgggaggatgagacaggagaatagcttgaacccgggaggcggaggttgcagtgagctgagatcgcaccactgcactccagcctgggcgacagagtgcgactccgtctcaaaaaaaaagaaaaaaaaagaaaaagtctcaaatagctgagattcagtggtgcattggactcgctgttagaaacttcagtggtaagactttgatacagaatcgaaaaaccaagtggaaggcaccaaaatgacagaatgttcacctcgtccataggaagggtgtaccacctcaaacatctcaccacgttatgaatttccttctagccaatcatttaatagtttcagaacatgctaattgtgatgtgaatgtaagtcgttcataagagttgcatgtctaccttctggaaaaagaagcagttattatataaactcatcccgaagccccgttcacctccttcactcaaaggttgatgatgcacctgatagtggtgtgcaccctactaatgagacgaacgatggtgtcaccttcagcctgcacctgttaacgatggtgtcaccttcagcctgcacctgtttaaacatctacagtgtatggagtttgagtttttcatctctccatagtggaaagccgaatagtaatgaaggatgggtctgaactgcctgtgaattttcattcctggtttaaagtcctgggggagcccctcgtccagccctgtccgcgcagtcatgacctcactgctcatgcctgtgtttccccctccaaaccctagcgattcgttttggacgaatgccaagatctgagaaagcaaaactgaaagcagaaattcttacctgtgaacatgacatagaagattctgaaactgcagatctcaaatctctggccaagagaatctacgaggcctacttgaagaacttcaacatgaacaaggtcaaagcccgggtcatcctctcaggaaaggccagtaacaatccagtaggtgtttgcggctgttctgggttctcttggcaacatggaaccagtgtcgtagaggacgattaaggacacatgtgttgaatgttgagaaaattatatttatcccacagttaagcaaaggacagcgaagatggaaacagttcattctgagactctgagctgtagcttaacaacaactcctttcttcttgcttggagccacctcaaagctcttagcaactaagttattatactggctatgtaattaatacacttaaaaaaaaccttaatagcttaccaagtactaagatgatttcttaggagcattttttcttaaatagagataggttcttgctctgttgcccaggctggaatgcagtggtgcaatcatagttcactgcagccttgaactcctgggctcaagcaatcctcctgcctcagcctcccaaggagctgggactacaggtgtgcaccaccacacctggctatgtttgatgttgttgttgttttgttttgtttttgttttttggtagagatgagatgtttcccaggctggtctcaaactcctggcctcaagtgatcttcccacctcggcctcccaaagcactggcattacaggtgtgagtcatggcacccagcattaactggatttaaaaaaaaaaaaactgaccaggcaagatgggtcatgcctgtaatcctggcactctggggaggccaaggtgggcagattgcttgagtccaggagtttgataccagcctggccaacatggagaaaccccaactctactaaagatacaaaaattagctgagcagggtggcacacacctgtaattccagctacttgggtggcttaggcatgagaattgcttcaacccgggaggcagaggttacagcaagctgagatcatgccactgcactccagcctgggtgacagatcgagaccctatctcaaaaaaaaaatagaataataaaataaatccctactttgaggtgtattagtctgctataaagaaatccctgagacctggtaatttataaagaaaagaggtttaattggctcgtggcccacaaggctgtacaggaagcttctgcttctggggaggcctcagggaatttgactcatagcagaaggtgaagtgggagtaggcgtcttgcatggcaggagcaaaaacaagagacacacacttttcacccatcagatcttgtgagaacgctatcactagagtagcaccaagaggatggtgctaaaccattcatgaaggatcacccccatgatccagtccctcccgccaggcctcacctccaccactggggattacagttcaccatgagatttgggtggggacacagagccaaaccatatcataaggctagaaaaggaaaccacttacttcccactcaaaatgtgctcttggtcctttctcctaaaactactccctccctctcagacaaacatgcctacattctttttccgccttcagtgaaaagacagtgacatcttggggcttagaaagggccacttgtaagccaggcgtggtggctcacgcctgtcatcccagcactttgggaggccaagacaggcggatcacgaggtcaggagatcaagaccatcctggctaacatggtgaaacaccatctccactaaaaatacaaaaaattagccgggcgtggtggcgggcgcctgtagtctcagctacttgggaagctgaggcaggagaatggcgtgaacccaggaggcagagcttgcagtgagccgagatcgtgccactgcacttccagcctgggcgacaaagccagctgtgtctgggcgcggtggctcatgtctgtaatcccagcactttgggaggctgaggtgggtggatcacttgaggtcaggagtttgagaccaccctggccaacatggtgaaaccccatctctattaaaaatacaaaaaattagctgggcatggtagcggttgcctgtaatcccagctacttgggaggctgaggcaggagaattgcttgaacctgggagctggaggttgcagtgagctgagatcgcaccactgcactccagcttgggcaacagagtgagactctgtctcaaaaaaaaaaagaaaggaaaagaaaggaccacttgttatagaaagcctgtcttttaaggtagctctggaccttttcagaggcagccaaattgcccctcatggttcgtcccccacatccccgcctgcctggcctaagtcctccttccccctccccaacagttaaataagtctttgtctccattacaaaacaaatctcagagctaccttcaaagaagagccagccctcagttggtgaatgaagatactttgacattttcctatgagcatggtgaaacaggtttaatttgtattaaatagcttgaagcaatccttattgggaattacaaggtggaattttagtcacaggaaaataaagcatttcacaagctacttactttcatgaacaaaccaaacctcttctttactgagtcctttaattcttcagtgaattctccaattaaataggccgagacattttagaagtttccagcagacacccacactaggcagctccagaggcttgtcccaattagaactttcctggattacgagagtgaaagaaaaggtaacttttagcttcgagtctctatcctggatatgattagtacagcccaaaattgggatggctaaaacttttgtttgccagcttatatttctcccttggatttcagaattgaaagcaggctgggcacagtggctcacactgtaatcccagcactttgggaggctgaggcgggaggatcacttgaggcaatccaagagtttgagaccaggcaacacaaggagacctcgtctctacaaaaaatgattttttaaaaaactagctgggcatggtggcatgtgcctgtggtcccaggtacttgggaagctgagatgggaggatggcttgagcccaggagttcaaaaccaacctgggcaacatggcaagaccacatctctacaaaaaataaaaacattatccaggcatggtggcacatgcctatagtccccgcgacttgggaggttgaggaggatgccttgaggccaggagttcaaggctgcagcgagccacgatcgcgccactgcactccagcctaggcgacaaagcgagactctctaaaaaaaattcgaagcagagttaagttgtctttcttcctaacaacctgcccccaccatggggtgcgaatgggactcctggagtcctcctgcacctccccttggagaccaccaagctctaggaaccccatcaccctcagctgagggtcacatgcagcaactagcaggcgggaatctgtttgcattttggccttaaagaaataaataataggccaggcgcggtggctcatgcctgtaatcccagcactttgggaggctgaggcaggtggatcacctgaggtcaggagttggagaccagcctgaccaatatggtgaaaccccgtctctactaaaaatacaaaaattagctaggcatggtcgtgggcacctgtaatcccaactacccaggaggctgaggcaggagaattgcttgaacctggaaggcagaggttgcagtgagccgagatcacaccactgcactccagcctgggtgacagagcgagactccatctcaaaaaaaaaaaaaaaagagggccaggcgtggttgctcatgcttatgcctgtaatcccagcactgtgggaggcagaggagggcggattacctgagctcaggagttcgagaccagcctgggcaacatggtaaaaccccatctctactaaaatacaaaaaattagccgggcatggcagtgtgcgcctgtagtcccatctattcgggaggctgaggcaggagaatggcgtgaacctgggaggtggaggttgcagggagccgagatcacaccggtgcactccagcctgggtgacagagtgagactccatctcaaaaaaaaaaaaaaagaaagaaatgatagatgaatagtttaggattggggttcacaatttggttttctgtagaaaaagagaaccgggcactcttccgagagtcagatgccctcttccacccacacccacaaagccagagcaccgcaggtaccagttttcaaggcaacctccaaccatcatgtgactctttgtgtttgatcacactgtttgctccaagccagggttgcgtcccaccccatgtccttgtctgcgcacgggacgctggaggcacggccccctcctccctgcctagcctgctgacgggctttccagagctggctccttcaggtgcaggataccctctctgcttagtctgggaaaaggccccgttggcaggatgcccaccaccaggccacactgcctgaatctattggcagagctctggttttgtggccaaggtgggtagtggaagaccatagcctgtgtcccttacacatctcagaaagcaaccccatctgtgggcaagaaatctgttagggagaccaagcagcggcctggaaacaccttgatctctgcccagtggcccacatgcggtcgccgtttcatcagtttccagcctgggtgacctcacagccccagccacgccccacagagcctcaggaaggcacactgacctcagggccggcggctgacttcatttctgtttggggatgagaggcggcacagtaaactgtccaggccagtaaactaatggattcatacgaaccgtaatgaacgtgggctgtgtgctggggaaggcaggctcgcctcctccctgcaggggctgctggggtgaaagcaaccctgaaatgttcaaagccttgatggggaagcacgggggatggatagattttaatttcaaagcagccctctggtttgctataagcgggggactgaatttctctttgcagtggccaatgcctttcttctgtcaagatcagctcgtggccttcagatcagatgacgcaaagccccatggctgagctggaacaggctagaatgctgggggggggcctgaaaccggtgggggagttgtgggaggcctagaatcagccaggaggcttgggtcggggttggaaccggccagggtgcacggaggaggctgtgggggcagggggaggccgctgcatggagccgcatagatgccattgcttgaggaaaggtgggctttagctgagggaaggagtgaggggtggatggagaatgtctgtgtccatctggacactgggactgtttgagcccctgagatttcagaaccgtgggccagaaaatggtcagggcccttggtgatggggaagggcgcctctggggaactcactgccccttgatttgagggtaacagggatggaagcagagtcagggggctgagggaggcaataaaaatgggtgcttttcaacagtgtctaaaaacataagatgttgacctgtcaggggttgagaatgtcgtcagaagactttggaggaagcaacagaaaatgagactgaggggcttgggcagagtcagtgccttctgtgtgatgcacgctcatgcacaaatgcacgcacatacccacactcacacatccgtgcacacacgggtacacacacatacacgtgcacccacatgcatgctcacacacatgcacccacagtcacacatccatgcatgcatgtgtacacaaacacacccacacatacacatgcacccacacgtgtacacagatgcacctccacccccatacatgcacatggacacacacatgcacccacacgcacacaagcatccatgctcacatgggtacacactcacacatccatgcatgcacgtgtaaacacacacacccccacacatacacgtgcacccacacatgcacacagacgcacctccacccccacacacgcacacacacacatgcacccacacatggatacacgcacactcacacatgtacccacacctgtgtgtacacacacacatgcatgctcacacacatgcacccaggcacacacaaatccacattcacccatacagtcacacacatgcatacacacacatacaaacacatgcattcacacagatgcatacacacacacacttacaaactacacatgtgcttatacatgctcacatgcatgtatatgcacacacataccctcaccttatgcacacatgtacccacacacgtacccacacatatacaagcatgcacacatatatatatatacacatgctcacacgcatacccacactcacatgtgtgcacatatgctcacacacacgtgcacacacatgctcacacacacacttactgttgctcaggcttagctgctttgggcttaagaagcaaactgcaccttccaaaaaatgagtgtggtgttcagttaaacaaccaaataattctttagcactgaatatgtggactttagaaattcaaactataaggtgataataacgttgtcctgctactttttaatctaacaaacatatcagaactgacactcagttcaaatgaagaaagtaggaattgggcgtgccgtgttattttttcaaagattctcctattgctccaaattgttggggattatcttaaagtctttgaatagcttcagttatggaagattttaccctctgagaatagaactgaattttagacaaaccatgagtccattgtagctagactggcatgcaagttgggattaaacagagtaaaacgtcttgtttaaaaaaataagaaaggccggcttgggcaacatagtgagacctcctctatgaaaagttagctgggcatggtggtgtgcgcctgtggttccagccgctcaggaggccgaggcaggaggatggaggtcaagactgcagtggactgtggttgcgccactgtactccagcctgggtgacacagcaagaccccgtctcaaaaaaagaaaacagaaaaaagaaaaaaaaagttgagcaaggagactaatttgtgacatgcagctgaacatggtttttaagaccagttttgaaagaggaattccaacattattcttaacatttcagaagcctgggcataagggtgacctccagggtgccgtgttataacaggactgctcctttcaacagctatgaccttataccatgtcttggggtgttgcctgccgtgtgacagtccaatattatacctactacttaagttttctttagattaaaaaatgtgcttcatattttatgccatttctacaaatgtatagtaaaacataaccaagagagcttattaaataatttcatccaaagcagttctaccagtgcttcacatttattttttatttatttatttatttttgagactgagtctcactctcttgcccaggctggagtgcagtggcgcaatctcagctcactgcaacctccccctcctgggttcaagcgattctcctgcctcagcctcctaagtagctgggattacaggtgccagccaccacacccgactaatttttgtatttttagtagacacgggcttttgccatgttggccgggctggtctcgaaatcctgacctcaggtcatccacctaccttggcctcccaaagtgctggcattgcgggcatgagctactgcgcctggtccacatttaattttttgcaaaaagatgacagctgctaacagagatgaattctcatgagtgatatcattgagcttcgtaggccacatgagtgtgtgccgggaccagtgtggcagcaagcggggcgttctgctctcggcatggagtgattggggaaaatctaggcagcttcctgcctcacgctgtttaaaacctttataatgtgctttatttcatttatttgaaatgactgcctgtcgtgtcagatatattcatagtcaagcttgagtataaaaggcatattccaaagttaaatataagctgctgcatagatttttttgtaaaatgatctcaccaagaatgtttatccataaagtttagcgaatttgcaagtgtgtttttcaacagcatttctctttagctttaataaacattggtttcttcatggtaccactcattttgaattcagtggtctccagttctccctgctaaatgaggcccactttctaaaaccaaagtgataattttataaaaatgaaatgagatatttgttaccacagaagtcctcatttacgagagtacatccccatagaactagtccacggtgagcctcaggggcatgcaagctgtttaacgatgcccccagcctagaaaggcccaggcttgggtgttcatgctccgctgttgccttcttgaaattcataatcatctttgaacaaggggtcccgcagtgtgtggtggctcacgcctgtaatcccaacactctgggaggctgaagcgggtggatcacctgaggtcgggagtttgagaccagcctgaccaacatggtgaaaccccatctctactaaaaatacagaaattaaccaggcgtggttggtgggtgcctgtaatcccagctactcaggaggctgaggcaggagaatcactcaaacctgggaggtggaggttgcagtgagtcgagatcacgccactgcactccagcctgggcaacagagcgagactccgtctcaaaaaagaaaaaccaaggggtcccacatttgcatttttgctctgggtcctgtaaattacgtagccaggcctgcatttgtcctgggagatgctctaccaaaaaacaataaataacaccaagcattctgtaatcaaacactgtaggaacccctgcttatcctagcctcattctcattctggaagactgcacatttatcatgttaaagactcagctagggaggcccaacttcattcaactcagtgtttcttatttttttaaaacagaactcattttttaaaaaaattattggctgggcgtggtggctcacgcctgtaatcccagcactttgggaggctgaggtgggcggatcacgaggtcaggagatcgagaccatcctggctaacacggtgaaaccccgtctctactaaaaatacaaaaaaaaatgagctgggcatggtggcgggcgcctgtagtcccagctactggggaggctgaggcaggagaatggcatgaacccgggaggcggagcttgctgtgagccaagatcacgccactgcactccagcctgggcaacagagcgagactccatctcaaaaaaaaaaaaaaattatttaacacctttatttctgctgaatgtactttagaaagattgagtgatttgaataaagtgacggtggcctaagagtctattttctggaattgagggaatactgccatcgatccttgaaaaatatttatttagttcctcctagaggccgggcacagtggctcacgcatgtaatcctggcctgcactttggaaggctgaggtggacagattgcctgagctcaggagttcaagaccagcctgggtaacaaggtgaaacccgtctctactaaaatacaaaaaattagctgggcgtggtgatgtgtgcttgtaatcccagctactcgggaggctgaggcaggagaattgcttgaactcaggaggcggaggcagaggttgcaatgagctgggattgcaccactgcactccagcctgggcaacagagcaagactctgtctcaaaaaaaaaaaaaaattatctagcccctcctagaaatgttaattccttaaatctgagcttcagctttctgtgaagcagaattatctccaaactttaacaaacaatggtcagaactgtttttaaggtcttggagagagatcattttcagtctttattaatcggacttgagattatttagaaacttggctctgaatattgtattcagaatgttttcactcatttgtgagtaattttttaaatatcccctttcctcagatgcagaatcagggctttttgtccagcattatgttgcaagtcctggttctgttgaaacattccataccatctgtgtgatggttatcggcacctccaccggtgccctgaagacagttttgtgctgtgagtccagaaacaggaaacacttcaggctgtgtgtcagaagcattgtcagtggttgtgttttgcccactggcagggggcattctttaaatcctgggatgcttctgcgctttgggctccactgttccagcagtgattagaaataacgctgtaggccgggcgcggtggctcacccctgtaatcccagcactttgggaggctgaggtgggcagattacctgaggtcaggagtgcgacaccagcctgaccaacatggtgtaaccccgtctctactaaaaatacaaaattagctgggcgtggtggcgcatgcctgtaatcccagctactcagaaggctgaggcgggagaatcgcttgaacctgggaggccgaggttgcagtgagccgagattgtgccattgcactccagcctgggcaacaagagcaaaactctgtctcaaaaaaaaaagaaataacaccttagcccactgcattattgacctgtgtctgcatgagctgtggaccacattataatcagagagatctctcagatgttgtcactttcctgctctacccgcagatgtaaatttcagccaacagcagtgtttgtgctcattttccccggctctcccacacatgtaatcccttctgagcatgttggcttcaaataatatggccagccacctcttccaccacgagatcttcaggaaatggcaggccactgggtttacatgcagatggcatgggagcacacaaggcacggctgtggggagttggcacttgctccagaatatggagcaccgagtgaaggtttcagtttcctgcactgagagaaacaagggcattccgaggcttttccactttatccctaaagagtttcacaacgcttgtttgccgatttctacatagatgccacctttctgagttgtatgtatttacatgccaaatgtattcattgagcagcgttaaataatggtgttcacccctaaagtgcatatactggtaaaattaagaatgatcgtaattaagcctcttgcaatagtcattagttcagagaatatttaagaatattaaaggtgctttgctaatgtcctcgttagttttgttttgacaaaatcagtacttcagtttcttgtttcttttttttttgagacggagtcttactctcgctctgtcgcccagactggagactggagtgcagtggcacgatcttggctcactgcaacgtccacctcccaggttcaagcgattctcctgcctcagcctcccgagtagctggggttacaggcacacactatgcctggctaattttttttttttttttgagacggagtctcgctctgtcacccaggctggagtgcagtggcgcaatgtcggctcactgcaagctctgcctcctgggttcacgccattctcctgcctcagcctcccgagtagctgggactacaggcgcccgccaccacacccagctaatttttttgtatttttagtagagacggggtttcaccatgctggccaggctggtctcgaactcttgacctcaggtaaaccacccacctcagcctcccaaagttctgggattacaggcgtgagccaccatgcccagcccagtacttcagtttcttagcgatgaaatccacccaatgtcaggcgatgactattattattttactgatttatactgtttgttctctattaatgtcttattttccccaaccgattttgaagttgagtaaggactatgttccgcgggtatcttgagtcctctgaggcactgagcttggtgatttggacgcaggagctgctcattagtgagctgatagctgggagcatagcgcatcccacatcacctgacttaccttggtgtcctcctttgtagccttttgtcatacatgatatggagacactgtgtatggctgagaagacgctggtggccaagctggtggccaatggcatccagaacaaggaggcggaggtccgcatctttcactgctgccagtgcacgtcagtggagaccgtcacggagctcacggaattcgccaaggccatcccaggcttcgcaaacttggacctgaacgatcaagtgacattgctaaaatacggagtttatgaggccatattcgccatgctgtcttctgtgatgaacaaagacgggatgctggtagcgtatggaaatgggtttataactcgtgaattcctaaaaagcctaaggaaaccgttctgtgatatcatggaacccaagtttgattttgccatgaagttcaatgcactggaactggatgacagtgatatctccctttttgtggctgctatcatttgctgtggaggtgagtggttgatttaatctgctggtatcatgtcactgacaggctcctgtcttgaaaaatttgacaatgggaaatccagtaccagcctgagctgttccagtggaggggacactcacatggtgggaagacgtctgacccccagtcactgctgagaattcagtgggaattataacaatattgtataatattatagtatatattgttattatctataaatacatatttaatattatgtaaatgtatgacattttaatcataatattagccaggtgtgggggtgcacacctttagtcccagctacttactcagtagactgaggcaaaaggatctcttgagcccaggagttcaggttgcaatgagttatgaatgcaccactgcactctagcctgggcaacagaacaagacctatttctttaaaaaaaaattatatattttgcacaaatatatatatagagaaaaagaggtcggacatgggcctgtaatcccagccctttgggaggctgaggtgggtggatcacttgagcccaggaggttgagaccagcctgggcaacatggcaagaccccgtctctacaaaaaaaaaaatagaaaaaattagtcaagtatggtggcatgtacctgtagtcccagctacttgagaggctgaggtgggaggatcacttaagcccaggagacaaaggttgcagtgagccaaggtcacgccaccacactccagcctgggcgacgaagaatgaccctgtctcaaaaaaaaaaaaaaaaaaaattatacacacacacacacacacacatttcgtttatattatatctaatattataaacagatataatttatatattatgatattcctgtatatattatataatgatgttgtattcatattatagacaatattgtatgaagtgctatacagatgtcagtatagttgctgtcacagttggttatgttgatgaaaagtatatttcctaatgcaaaatataatatcagtcagcagccaagtggcagtgactgcaaggtttgctttgcccgaggaagcagatcccagggaaggccgatctggtcctctctgtggaagctggctctgcagcctccacatttttggctcggtgtcacgttcctttaaatagccccatctcaggtctaggaaggtcatccacctactgcaaactcggctgaccttacccagggttggtggagacagatggggtctcccacactgcctgcagccatactgcgcctgggggattgactcactgtcagcatggagctgactcagccctaccagccgtgcccgttactgtgtggctgggcacaagtcagatgaaggaagtccttgcgctctggcataaagtgtacaaagacaaagcagttatgcataatttgtcctttagtatggtcaggatgtagcattgtgggtaaaatgcagttgcagaactatttatatgtagcatgatcacagttttataaaggaaattataatcctatatcaatcctatgtatatagaaaaatgtccagtgagatatatgttaaacctattatggtgggattaaaattatgaggggggatttctatttttcaaaagattcctccttttttttttttttgagacagagtctccgtctgtcaccctggctggagtgcagtggcacgatctcaggtcactgcaacttccgcctcctgggttcaagtgattcgcctgcctcagcctcctgagtagctgagattacaggaacatgccagcacacctggctaatttttgtatttttagtaaagatggggtttcaccatattggccaggctggtctcaaactcctgaccccgggtgacccacccacctcggcctcccaaagtgctgggattacaggcatgagccactgcacccggcaataattcctctctttagagacttaatagttatagccccagccactctggaggccgaggcaggaggattgcttgagcctaggagttccagtccagcctaagcaacagagcaagaccccatcactaaaacaatacaaaaacaagaattttagaaataaaaacttaataattacatttacaaccaaaaacaatgaagatgtttaaatcctcatcactagcaaccctgttaagaatcatagtaatgactgggtctgtaagggagcaccgcctgctgaacatggctcagggcagtattttctggaccaagaatcaggtctcatgctttgagactgtcccaggatgtctagtgccagctaccccaggcaggtcatctggtgtgaatgttgactcttcctgcaccaagtctcagacctgccccaccctcctccccactctgggtctcctgatcttggctcactgcaatctccgtctcccaggttcaagcgattctcccacctcagcctcccgagtatctgggattacaggcgtgagccaccgtgcctggcctacaaaacctagttctaacacaatcactccttaaatatggtggaacacttgaagcttgatatctagtttggattcaaaagcttcatttcccatattatgcaaaactggtggttgtgatctccagaatgtactgttcctcctactagctctaatttttctccctgacaggtggtcatcaggtaaatcacaagtgaaaaggccgcaccataaggtgtacttagggcactattgccgcctagtagtatgaatatttaggaaagagtactggtcctgtctgtccctacttcacctattgactttggaaaaacctatgtctatcttccagtcaagttgacaatatctaaaggcagctcagtttttttctaagaaaggccacataaaataggcatgtttggttcctgaaactgataagcagttcttgggtgattatcacactcaaacctctctctcttctttcgagactagatcgtcctggccttctaaacgtaggacacattgaaaaaatgcaggagggtattgtacatgtgctcagactccacctgcagagcaaccacccggacgatatctttctcttcccaaaacttcttcaaaaaatggcagacctccggcagctggtgacggagcatgcgcagctggtgcagatcatcaagaagacggagtcggatgctgcgctgcacccgctactgcaggagatctacagggacatgtactgagttccttcagatcagccacaccttttccaggagttctgaagctgacagcactacaaaggagacgggggagcagcacgattttgcacaaatatccaccactttaaccttagagcttggacagtctgagctgtaggtaaccggcatattattccatatctttgttttaaccagtacttctaagagcatagaactcaaatgctgggggtaggtggctaatctcaggactgggaagattacggcgaattatgctcaatggtctgattttaactcacccgatgttaatcaatgcacattgctttagatcacattcgtgatttaccatttaattaactggtaacctcaaaattcgtggcctgtcttcccattcaccccgcttttgactattgtgctcctttataattctgaaaactaatcagcactttttaacaatgtttataatcctataagtctagatgtatccaaaggtgaagtatgtaaaaagcagcaaaatatttatttcaaagacttcacttctgtttcctgaatctaaagaaagacaacatgctgctttttaatcataggatggagaattttaaagaactgtttgggccaggcacagtcgctcatacttgtaatcccagcactttgggaggccgaggcgggtggatcacaaggtcagcagatcgagaccatcctggccaacatggtgaaaccctgtctctactaaaaatacaaaaattagccgggtgtggtggcacatgcctgtaatcccagctactcgggaagctgaggcaggagaattgcttgaaccagggagttggaggttgcagtgagctaagactgcaccactgcactccagcctggtgacagaacgagactctgtcttaaaaacaaacaaacaaaaaaaaaatctgttagataagctatcaaaatgcagctgttgttttgtttttggctcactgttttcgtggttgtaactaatatgtggaaaggcccatttccaggtttgcgtagaagagcccagaaaacagagtctcaagacccccgctctggactgtcataagctagcacccgtggtaagcgggacgagacaagctcccgaagcccgccagcttcctgctccactcagctccgtccagtcaacctgaacccacccagtccagctgtctgtgggaatggtggtgttcttagggacagactgacaccttacttgtcagtgttcctccgggccccatttggcagctcccgtatcttttgttatgttgcttttaaagatatgatgttttattgttttaactcttggtgacagtagatgctctctggagcgcagacgaggcacatgtgtcttcatagcctgggctgggtgggagccagtcaccctgcggatcgagagagggggtagagtcttcttcaaatggcagttttacttcaaatggcagatttcacaagagttggttattttttacaatggtttaggttgttaagtctcctttgtatgtaaggtagttttttcaacatctaaaatttttgttttagccttcaaaaccaacttaccaacctcagtccagctgggaaggcagcgttgattatggtagtttgtcaagaatatatggacctggaaacactttctctctctgtccacctggtagataaattgtcctgttgagaatttttagatctggactggaactgccaggaccaccgcctccagggagtcgctgggcacctggaggtatcgtcgatgcctctcccccatctttagaaaatttggctcttctgaggtcattattattttaagaatgattaggattgataagggtcccatgaccagcattatgaaaatgcgagagtgggaaggacacagtgtgagacttccactagaaaaaagtgaaagttagggttaggacatccttttttaaaaattacaaatttagtccgttttggtttttgtaatcaggctaggcacagtggctcacacatggaatcccagcactttgggaggccgaggtgggaggatcacttgagcccaggagttcgagaccagcctaggcaacatagcaagaccctgtctgtacacaaaatttaaaaattagttcatcggggtggcacacatcagtagtcccagctactctgcaggctgaggtgggaggattgcttgaacccaggaggtcgaggctgcagtgagctgtgatctcaccactgcattccagcctgggtgacagagttagattccaccctctcccaccccggcaaaaaaaaaaaaaaaagatgcaatcaaaggggctgttggccagcaatggcagcagcagcggcgggcagtctgcccaagtgtcttaggaaccaaaagcaaataaaagtgtttccatatatgccaccagccaagtggccatcctaattcagaaagaagctagcctttgagtgtctgtcatggtgcatccgtttcagtattatttcctaaaatgagaagcccctgtgtcaacaagatccaggggctggagcccaatgccaagcctgtgttgtccccagcgaccctgcagctgctcgctctgatgtaccctgtgccattcaaggagatgtggtccaggaaagtgagcctcatggttttcagagaagtcattgttctgtttacattttcataaaacctgtttaaaatagctccccgtctcaggctttcagcagtaacagtgagctgactggcaagttcgatgttagctcccgggacactcagcagcgatggtgagcattttggtttccttaaggcccagcaagacttccagggacatctctggtgaagccagaatggagacacccgtgacctcaggctgaaagtcactcgacattggtctcttgtgttgatagggaaggaaatcaggcattcctatttctttaaataacaaaaccactaattgccactcaatgctggaatattttgggtcacctaatcatagatttctcagggcatcaatactcaaatataggctgattatgccccagttcaaatgggaactattaacagagtgcatttcttgcttgctgggtttcaacagacatcagccaaaagaacaaaagagatgtcaggacagattccaggagtgtcggagcacatgtgtggcacccgctccctctggcagcgaatgtaggaagtcgccaaatttacccactcttcaacaagtcattgtttaaacacggtttttcattttctcaacttttaatagcaaaaagtgccaaagtcctcagagacctaacagccttggtctaccgtgctgaccagggtgaaggcacggcgagggactcctcccagacgtgcctcttgtgtgccagctggctgtggctcgggagcagacgcaggcctctccattgtccaggggagcctggcggcgcatccctcctctcccacctcctggcacttccagctgggtgtcccacatgttggattccgtccccaccacacttccagagaccggagaactgtgcagggcctaaggccgtttggatgaattgtcaaaacaagatgcttccagttacagcggcaggagcgggactgggagcacgggctgacggctgctggtgcctttcttcccacctcgcttgcctgtttccgcttgacccttcctccagctccgatgagaagagtataaagcatcttcctaacgggtgtgtttgctatacgaacataatggacgtgaagtggggcagaaacccagaactcagcattcaaggatgcccaggagagctgtccctgttttaaagagctgtgttttgttttgtttcgcatttagagagcagacaaggcacccttctgctgcgctgatacgtttcttacactgggccattttagacccccagggaaacagccttcctggagcgttgtctggaggttccagggacagggcagcctcccagagccgagcaagagctcaaggtacaaatgagagatttgctataccgtgagaagtcaacaacttagccaccacttccccgcaatggaccatgtaacaaatacctcagcaggccctgcaaaaggccatgctagagctgaggcgcacagcctgtggcctctgtagttagggcaggtgggatggagactccttgagtgcacacacctgagcctgcccacacacaggggagcagcatctcgtatgacgtctggaaggaacttcggttgtgtaaagggagccttgaagatacgtgcaaaaggtgctaccccaatttggtgaaactgacattgggcacgtcttgggcttaggagaagcggccgatggtcccggcctgcagtgacaaacccccctccccgcaccgcccccagcaccccctctcctcttcacctcttcctgctggccacgaggaagccacttcctcagagagaccctaccagatgcggatggaaacagatgcaccaaagcaagccctgatgaaaccgcgacttcctaaggtctgtctcctctgaacttgcacctgggcctctctgtgtttggttccaagcacttcccacctcaaactcccattttcaaaccactgtatctctgcgcacatctgctacttaccagccgcatacatgatggagggttttttggtcctgatccagtggccacacctgtctttgaaatgtctcactgaactccagttttaaaatagattcattgcttcaacacagcaagcccaatgcacccagctaagactggcttgaccgacagcctggcctttggtggggggcttcctggggcctggggaaagctggccaccttcaacagctggtacctcttcaacagtgtggcctttcaaaatgcagatgccaccaggagaacatgcccacagctcaccacctatggatgccatggctctgggcagctttcaaagcaggttcctgtggtctcctcagctgtttgagggggtaacagcaaatcagcctccattttaaaatgaaaacaccagcctccagatgtagggcctgctgggtgttgctagccgctggtccccaggcacggtgcactttctccacctcctgcagcctccctgttgtttctagactcttgcacctggtgagtgcaaggataggtgacccaggggcctgcagccttgtcctcagctcccatctcctggactgccagcctcaccctctgcagttagcatggttggcctgatgcagggatcccgagggattactttttagaccttctttcacattcagaaaagtagtatagattcaggagaggcaagaaaattatgctgtccatagaagtcacccatgaagactgatgccaccacctgaaggctcatgattgttaaaaatgtccacgggaacctctcgtccacaggaggtttgtctcaacacttcccatttttacggcattggcattgccaagcatggggaagtatctgctcttctcatgttaaaagtggcccagcttttcttaactcagtccaagctgacttgtttagctgcactggaatttcttaccaaccaaatatttgcatcgagcaaagggggctgtgtgcacctccctaatggcagcgatgatggctgctgtcattcaagcccatcttcagacgtcacagtctggaagtgaaatgtccacaaacatctgtggcagaaaaggctatacggaccacccagttgtgctgcagctttacagagcaaggaagggttgtggcaaataaatgattaacctgcctcgactgtgctgagggcaacaaaggccatctcaccaaaggattattcgatgccattaaatcatcccgtgaccttcctgcttccgagtccatggcctttgcccagggcatgtactcccctgagaggccttctgcctagaaagatctatgactgggttccaaagttgaggcctaggtttttgctgggatttagatattttcaggcaccattttgacagcattcaggaaaacggttattgaccccatagactagggtaagaataaaggcaataaatttggtctgactcagaatataggagatccatatatttctctggaaaccacagtgtacactaaaatgtgaaattgaaggttttgttaaaaagaaaaagataatgagcttcatgctttgtttaattacataatgatttccattacgctatttctgtgaaatgcagcaggttcttaaacgttatttcagtggcatgggctggaagcttatcacaaaaagccatgtgtgtggccttatcagaacagaaagagacaggctggtgcccaaggctgctgcctgctccaccttttgccagctctggacatctgaggacgtcccggcagatctggaatggggccctcaactgaccatttgcttctcagaatttcagtttgagacatgagaggtataatcagttacttttctccccccagagaaacccttttgtgaggggagaggagctatggtatgtggttcagctgaaacacatacaactgcatccttttggagtcctttgccaacaaaaacagaccaacagaccagatggtgtccatgttcaatatcatgtcttgatggacgcagctgatgacctcaaatacttgagtggtctcatggctgttagatggattatttgaaaaaaaaaaaaaaaaaagagagaaaaaataattgatttttacatcagagatagcaaactaagacctggggaggggggtcagcttttattttattttattttttttaagtttgctagttgggtcaaatgtgaggaggagggagtctacctgccacctcttctcttgcccctcttctgcccacacatccagcatccaaaatccattcatttaatgaattgataaagtgccgtgcaaactggtgcacaaacaggcccccagtccacgcagcctggctcctaggaaaagtggtgaccgggcgtgggggggcatgccgcagccctgggacacagtcgggcaccttccccggacccccaggccttggctgtgcctcaagtcagagagggtcagccttcaggccccggagacgagtgactggccgatcatttcacaataaaatcactcacttttggcaacttcactttttttaaggcacagtcagttccttttctcatgtacctcacaaaagatgaagaccatgtagtactctttttggtaaagttacagtgttcatgttaaatatcacttttttctacattgtgtggtaaaaagaactacgttaatagctatatcttaaatactgtgatttgactttttgaaaaatatcctaatacaaatattttactaacttacaatcactcatttaataagaaacatttggattcttttgaaatcagtgttaattgactcatattcttaaaagcctggctcttgaccctattggaaacacaaaggaagctgaaatcaaacatctaaaatacactgcgtacacgtgtgcgtgcacacacacacacacacacacacacacacagctcttcatttctcctgagccatgcagaatttactttcaatgtggaaatctgttccctttaccacactgtatatgcacagagcacaagagaggctatctctagtcacttccaccagcgaggccttagactccgtattagaggccaccgatttcatacaacagtgtttcgctaaagacccttcactattcttgtttagtaaatagctgtctgctcttcagggaactgttacctatgggttattaccaaagaacgctggcaattggaaatgtcctgatggaaattctttgcacgtgccggttctctggcatcctccaggtggcccaacccaaagcagaaagcagaaaccacagaccccgtgagtctccccataccttgtttccaataacttggcaaaacttcttggtgcatattggttacaccctctgggattcataatgccattaggctaaaaccctaagagagagggttgacagaaacacacgcgagaatgaggcagatcccagagcaaggactgggcccagactctccacatgtgctctactagtgagtgccttatactctcagtattttggggcttacagcttcttatttgtgctaaaaaggtgcagttccaaagtaggaactgccacacaggccccagcatcctctctccaacttcatacctctctcctggtggggggagcgggcatccaggacctccggaatcaaggatgtgcagagaagagcgaaagtaatttttctagtcacatgaactgattggttccaggcaattagaaaatggctataaaataaccttaattttaaaaaaaaatcttgggtcttcgttttcctattaggagactgaactgaccacatgtattgatttatatcctgaatatatgggaacttctgtgtttgggatgtcctactgtaagactgatgaatgtacagagttaatttcagggtacagttttgccttaatggttttaaaaaataaactattttttaaaatttt

SEQ ID NO: 210 - DNA, 33483 bp, Homo sapiens
  source 1..33483: mol_type = genomic DNA
cgccgcctgcttggaccgcagaagagcaggaggacgtctgagccatgctcgcggcgatgggctctctggcggctgccctctgggcagtggtccatcctcggactctcctactgggcactgtcgcctttctgctcgctgctgactttctcaaaagacggcgcccaaagaactacccgccggggccctggcgcctgcccttccttggcaacttcttccttgtggacttcgagcagtcgcacctggaggttcagctggtaggagtgggagaaggtgcctagcgtgtcctgaccctaactctgttctgcagcacaagggacgttccggcaacgtgggtggggtgggggatgaagggcaggaagaggtgtggctaacgctggtaacctggtaaaacccactttgagtttcatttcctaacccattaactggcatgattccacctgcactttctagggatggaatattattaaatgtttactatttgcatgttgtcatgttaaacattactggaacaccttacttgtaatgtgattaccttgccctcttttatatgattgtccttaaaaatgctatactttctttctgagaaacttcatttcccatacataaaatggtgataatactacctcaatcttgatcatttctcaactgagttattcccactacactaactgagccctccagcttcaacctccttcccttgcagtgcactctcactaagtaataattttaaaatgttcttcctctgcttaaatttttgccaaacggtgttcagactcctgactgaaccacctgggacccttcttgatgcagcttctttccgtctctatacaataatctcctatcagggctccccgactctggtgaccaagttctttcaagttctctcagacatcaaaccctatctcaagaaaccaatactggttttcctgccactcagcacaggtaacttgctgagagacaacagtgtgacaagtgattatgaagattagataaaatagtgaatggtcaatactgacatatagttggtacataacaaatagtagttcccctttccctgcacatgcctgcagtactttaaacacatggctgtatattgccctcaaatattgatagacaaagttttatcactttatgggagaaatacccaattggtaatactaagtgacagaattagccacagaatgttaaaactaagcccccaaacctgtgtccttatttaattaatatgttgtttaatttccaagtatgtggagattttcttgttatcatttctgttaattatttccagtttgactccattgtggtcaaacatcatactatgtacaatttcagttcttttaaatatgttaaggttgattaaatgacacaagatatagtctatcttgataaatgtgccatggaggctggaaaaaatatgtatttgactattgttgggtggaataattgatataaattattgttgggtgaagtaattgatatcaatatcaatttgattttactgggtaatgatattgtttggtttgcctatatccttgttgacttgttatctacttattctatcaattactgaaagaagaatgttgaagtttcaaaggacagttgagagtatctatttctccattcagttctagtagtttttccttcatgtatttagaaactctgttgttttgcacatacacatttaagattatcatgtcttcttagtgaattgatccttttatcctgtaatgtccctcttaattcttcataattttatttgcctaaactgtactttatctgatataatatagccacaactttttttctgattagtatgtgcatggtatatgcatttctattctttaacttttaaccttcttgtattattatacttgaaattagtttcttgaaggcagcatatacttgggtcttttttttcattctggcaatctctgtcttttaattggtgaatgtagactatttatatttaatgtaattattgacatattaagatttgtctaccattttattatttattttgtttttcctgttttttatgcctctgttttccttttcctatcttcctgtgaattacttgaacatattaaaaataattttattcttatttatctgaggtgttttttagcagctctgtttgtattatgttttacaagtgattgctctaaggattacgatatgcagatgtagctgattgcagtctattagtgtaaaaattttactacctcaagtgaaatatagatatcttgcaaccatttaggttcctttaccctctctacttcataattgttgtaagtgttatctctatatacattgagaactacatcagataatattataattttgcttttgaatgttaaatgcaattttgaaaactcaagagaataatagtctattgtatttactcatttatttacccttttcatttatcttttttcatttctgatgttacaagcttatcatatcctttcagatctgaagaactatctttagatattcttttagtgcaggtgtactggcaagaaattctcttagctttccttcatctaagaatgtatttatttcaccttcatttctgaagtatatttacactggacatagaattctaggttgacaattcctttcattcaacattttaaaagtttatgcttcttctttttggcctctgtggtttctgttaagaaatctactgtcatctgaattgttatcccccatatgtaatgaactttttctcactgccttccttcaagaaattttctttgtttttgtttttgtttaattttcagaggtttagttatgatagatcttggtgctactttctttgggtttatcctgtttgggtttctgaaaatatagatttctcttttgccagtttgagggagcttctgccactctttcttcaaatatttttcaactacacattctttttcctctctttcttggactcttggatactgatggcacaaatgttaggtctcttgttgtgccacgagttcttgaaactctgtttttgttgtttccaatgtagtttctctgtgttgtttagtttgaatatgttcttctgagctgtcttcaaattcacagattctgctatcattaccattctgctattgagctattttactgaattttaaaatttattctattgtattttcagttctaaaactttcacttggttcttctttatcttttatttctttgttaaaatgtcctaattttttgtttgttttgagactattcatagttattggaaaagctttataacagctgcttttaaatatttaattattctatatttctaacatctgtgtcatctcactgttggtgtcaactcactcaattgatgttctcttgattcttggtaaggtgagtaattatggactatatcctggacattttatatatttgttataagacttaccctggatactatacagatcttttattttagcatatagcctatttagattctgaatgctcacttttgtgggtggcagttcaaatatcaatgcaggttataaagcctctgcagtgctattctggtctactccacttttattacccactcccacaggagcccatctcacattctcatcagtgcaagctggggaaaaggaagatggaacagaagacagggatccctctggcatagtagcttatgctttactacggagggaagagagtcagagatctgcctatatctcctccaaggggaagtgcacctccttattactgtagaagaaggctggaaagcctaatttgccctctgactcctgcagggagtttctttacttcagcttaggaatagaagtcgcaattcagctcacagactcagcagagaagggtactacctcattattgcaaagtaggctgaaagacaaggtactatccatgtactccagtgctataggaccttttagagttgggaagggtcaaatgtttttcatggtatttgcctccacaacaaagaagtaaaaaggctaaatggtttctgtcctgttgggttttccttttcctggtcctttggctagagagagtagacttttcttaaagatatttttgtctgtgttaattggtgtcatgattaatagaagtaaaatggaatgctttttttcaaccttatctggaataagaagcttgatctgcacctttgttgtattcctaagataggtgttaaaagaggggttaaatgacttgcctaatgtcacaaaactagccagtgacaaaactgagactgggatctcatccttggccctgtgattttcttatcacactgtcatcatttatttttattttatataggtttgcatttttatgtttctgggtgtaaaacaaatggagttaaattatgaaatttagttataattaaatttacattcttgcaattgggaaacattaagtactaactaatagatcttacataagtatttttatgtcagttttcatttcatcttcatgatgggcacacaagttaggtatgatctggtggtgcttccattttaccatggagcaaaatgactgagaacgaacagtgaactgcccgggttattcagctaaataataacaaataaggatttgagcccgagactatttgatttgtatacctattgtgggatctggccagcagcctgcagtgcaacagggctctttctttgttcccaggtggatcggcaggtcgagaaataaaagatacacacaagatagtgaaagctgggtccaggggggtcacgaccttctggacctgcgatgccgccagtgcgctggatataccagcatttattattaagtttagtgaggatgggggtaggttagtgagggatttagggttgtttgattatgaggtgagatggtcacatggggatgaagtaattctttaacatcagtatgcagaagtacagtatacagagataagaatttacaatatagtgtgtgcatcagcaatttctaacagagccttagaacagaaacacagtctatccataacctatgattagcaagatattaatcagcatggttaatcttgccatggctcttctaggtctctttaggattaaggcatactcctgagaatttttggtctaaccggttgtctagcttcacgtcctgtttctactgattgtttgcaaccagcttttgctagacaaccggttagaccaaaaattctcagaagggagtatgccttaaccctaaagagacctagaagagccgtggcaagataagggcgtttataaccctatcttatccatgtgaacaggtgcccctcatgggtccatttataggctctccacaagggttgcattccattcccagagctatgatcatctgcttttctgggataggaatcttggtgatgtgaaacctccctgactgcatgtccatttataggctctctacagggggaagcacatcaggcactgttggctcattctggcagcccaacctggcattgtctttacacaatcctgcatgcaattttgcatttacaataatcaggagcatttcatcttttattccgtaacaatagtttcagggggtctccctacatatacccattatctactttatgttgcctgacttttcatgacatggttagaggacaattgatgtactcacatgtttattcactcaacagacatttattaagtgcttatcatatgccaggcaaaatacaaggctgtatatgactaaatgtatactgtacactcttggtaaccaaatgagatataaggagattggatcactgaatggaaaccctggggataaccttttgtagaatgttggaagaaattgggctaaattttaaaggaaattttgatttttggcaagtggctaaatggagtaaagggacagaagatttttaataggggaaaatggtctgagccataataattttattattaattttagtattatgattacttatcacaacaatactaaacatgggaactaataaagtctataaaatttggaaactaagacagagaaaagttaaataactttctcccaaatcacacagaaactaagaagcagaacctggattcaaacaagtttgtataatttcaaaatccaaactcttaagcactcccttacatcacctcccctactcaaacatcttagaattctgattgaaaaccaaacaagatccaaaatattatacctgatattaagactctcctcagcctagctcagattaccttgtcagccttgtctcccatctcccttatcaactgagaagatgcttttcccaggagccttcctcaaccctggtcctcttatgtggttcttaacttcctcccatcaaatattttattgtaaagaatgataataatgagaagtgattatttatctatatgctccattagattgttagcttcttgaagtgaaggacttgttgcactccccagcacctggcattgacctgccacatggtcagtgctctttaaataatgaaccctatgcttcagtcagacaaggtagctctcttgctcccaaacaccttctgcatttcccctttacatctgtatatggtgttctcaccatctagaatgcctttgatttcttactacatgttttttattatcattgtggtttgggggttgttggtttttgtttgtctgttttttggtggcatcctgactttcatttaagatctggctcagataccatctactctttaaaaagatatttttcttatatctgtggtggaaaatcatctcttcttgcgatagctttatgtccctctctatcagcataataacacatgtcatctgctgtgcattccattttttttctgcacagtcagtctctcccaagagactttgacactttaggaacacatcatatcatattgatctttgtattacctccatgtatgatatgccagtgccagaaggtgcctggcaactcttaagcatctcataaaagcctgttaaattgaacatgaatttaatctccacagcctgttctcagaaaccagcgcagccccaagaactacctgtgagaccattattcttggaaggagttcatgggccccagaggactggtaactcctgaaactgcatgcaaagctctttatgtgtatagctgtgtatgtgtttactagagatcaggtctatcatatacattatattttcaaaggattctataactcaaaaaagtaaagaaccactgttttaaagctttatttcccatttccttgtttatttttttttctttattggataaaaaagctttttgactgtaaaggcaacaatacatacacagtgagacaacatattaaaatacagtttaaggagagagagaatcttacctgtctttgtgcctatcctgccaccactgtgcatgcgtgcacacgtgcacatgtgcacacacacacatacactcagcggtacctctataggaccttggtggatatctttccagatttgtatgtaagtgaaaataaaattatatttccaactttttattagaaattccacgttatcaatgagaaaaaagttgaataccttgatacagaaatgtttgaaagacataaacatacgactttaaaaatacaacatccagattgagggacagatgttaaacctcagagaaatatagaaacagcatgcatttttgtgcctcttaggatctctctctctctctcgctgtcacacacactcacagaggcacagctcaggggaacagaccctctgacctactgctggtaggagtgtgaattagtacactctttttctgtttttcttttcctcttttcatgtctttgttctgttggttattaaatttaagaacttagattcagtggaatctctgtaaactttatatctcttggtagccatggttcaatagttcagtctcttctcccactaatcctttacttcttcctctttactgtaaacatttattttgttccacccttttttaaatgcttatgctacatttggaatttttattcctagcattacatttcctgtctcctattgcttttgtttgacttttatagattctgtttcagttcttttctttttctattttcatttctgattttaagactgtttttgcctttcaaaaggcatcttatttttatctccttttgttttattctgttaaggttttttttttttcgtggctcatttaatgatatacaattgaaaagtgtgccctgccttacaaagtcttctcagaggccctctgggtcatttaatctttctaaagaaatggataaaatgactgacagggtgcacgtaagaattgttagacatcgccatcctcatcccagggctcctaccccgtgtttaaacagttgataataccatacaagttttttatctagttctgtttaattcgaaatatgcagtggcagagagttggtagagataaaattcttaggaagtttatttcagtaaatagtaatggagttctgaatccctcccaagtacaagctaagattctaggctgtatactttgctagttagaagtcatttttaacctgagatttttcagctcttccaaaaacatccttatttaatgtcctaaattagtcaagaaatccttcttgtcaggcctaagaagttcatccaggaattcagcaagggtacattaaaaaaattgcttaatgtgtatggtcccattactgccatttcttagaagcaaagatgcttactttaggagcaaactgacttgagattgaatctcagctctgcttttcctagcaagacaggacatgctgtgtaggagataaggactgatggaggactctgggccaaaagaatacaaggactgagttcaggcttggactttaatgtgggagcaaggtggtgggataagactgaatccactgtatttgctccgatggggaccattaggaacaggactctaagaggaatatggtggagtgtaagtgcaaaggcatctggattgtggagaagaggccacaaacacctaaaggaaatgaagcccttcggattgttaccactgcctgcagctagacacaacccaggcagaaaaaaggcaggggcagggtctacctgggaccctctgttgaacagatacattaggaaggattttgattcgtgaccatacactgtcctccaacctacatttgcagatatttgcacacttgtgcacattcatgaacatacacatccccattctccctctctcccaccccaactctctcactctcactcattcttactttcactctgtcactcccactaaactctgtcactcaggttctggagccatcttgggctcacgtctttgtcctcaaatcttacataatgcctgggaaattccctgcaccactcaatagctttgtcacctttgctgtgttgtttcagctataattcattttctgtcttgaaagataagaactattactactgtaaggtggttgtgagattaatgagataaaatatgaaaggtgcttagcaatggctgcctatgaccatgagtgccttcttcccacacaccagtgggttcctgtcccctttgccaccataagaatgcatccacggccctctgcacacagagctctttcattcctcggagactcgctgggtggctgtgcgcctggaacaagaaaacaaagtgcctttcacattgctgctctcattcttcctcacagaaccttaagagagaggaataattttctcccttttatagctggggagttgaggctcaaaaaataaagcaacttccgcaagagccgaaaacgattgaactatacagcccagattgtcacataactccagagctcgagggctttcctccatgcctggcacctgccctaaaatgcacctcgtattatctagcatacgtttctattatctatgcccagtctaggaagggggcattctcatttggttaaacagatagttatgatttactaagaagtccatacttggtacaccagattaacactaatcatgtctcagccttcttaagtggctgagacatgattagtgttcaggtgagaattcagatgtgctgaattctctctattcactagactctaggatgcttggggttagaaatcttgtttactatgtctatatattgagacaggctttcactctgtcacccaagttggagtgccatggcacgatcatggctcattgcaggctcaaactctcaggctcaagtgaccttcccacctcagcctcctgagtagctgggtccacaggcatgtaccaccatacccagctaatttttatttttttgtaaagacagggtctcactatgttgcccagactggtctcgaactccttggctcaagcaatttgcctacctcggccccccaacgtgttgggattacaggcgtaagccactgcacatggccagaacttatttattttattacagttttatcctcatgccttgctctagggacacatgatagatgctcactcagttcatgttggttgaatacataaatagatatttataaagaaacattcacattctgaagtgaattgaatctgagccttgttgagagaaggagaaaaggaaataaaagcattcccatgagaccaatgtacactcactcacacacacacacacacacacgtacacacacagacacagacacacgcactcctctcaatatgatcccctccagctacacacatcctccatttctgaacacatggacatgtgcatattcaactgttacgatttaactatttttcagtttgtgaagaaatatgggaacctttttagcttggagcttggtgacatatctgcagttcttattactggcttgcccttaatcaaagaagcccttatccacatggaccaaaactttgggaaccgccccgtgacccctatgcgagaacatatctttaagaaaaatggtaagtttcttggccaacgaaaggtgagtgtttgatgttgatagtcctataatctgttaaaggcaccttggtgactgtaattttccaacactcctagaaaccagccccataataaacttcctgccactaaagaaagctggatattcacatttcctgattgaagtcactccctgagaagatttgataagatcatccctcactgggatttgggagaaaccacatgccctgcccaaacctactctggatgcttttataatgaagtaaccatgttacccatttatagcagaggaacgtgttctctctgttttcctcttccaaccctctctccttaggaaaatggatgtggatcttcctcctcctgctgctgcttcttcctgtctctatttccttattctctttcattaaggttgtgtcacacagaggatcttgagccttctggtctatgatagaacagattggcatgaacagattggcatgaacacttaaaattaccattaaatataatgaaacatttaaaaattgaaatgaaaatctcaaatctattattctattaaatcaccacttttaggtatgaagggggccagcccttccacacctatgggtatttctcctcaagtgggacaagagactgagaaaagaaataagacacagagacaaagtatagagaaagaaaagtgggcccaggggactggcgctcagcataccaaggacctgcactggcaccggtctctgacttccctcagtatttattaattactattttcagtatctcagcaggaggaatgcggcaggagagcagagtgatagtggggagaaggtcagcaagaaaacatgtgagcaaaggaatctgtgtcacaaataagttcaagggaaggtactatgcctggacatgcacgtaggccagatttatgcttttctccacccaaacatcccagtagagtaaagagtaacagagcagcgttgctgccaacatgtctcacctcctgccatagggtggtttttctcctatctcagcattgaacaaatgtacaatcgggttttataccgaaacattccattcccaagagtaggcaggagacagtggccttcctctatctcaactgcaagaggctttcctcttttattaatcctccccagcacagacccttcacgggtgtcaggctgggggtcggtcaggtctttctcatcccatgaggccatatttcagactatcacatggggagaaaccttggacaatacccggcttccaggggagaggtccctgcagcttttcacagtgcattgcgcccctggtttatcaagactagagaatggcaatgattttaccaagaatactgcttgtaaacattttgttaacaaggcacatcctgcacagccctagatcccttaaacattgattccatacaacatatgtttttgtgagctcaaagttggggcaaagagattggggcaaagaggttggggaaaagttacaaattaacagcatctcagggcaaagtgattgttcagggtacaggtcaaaatggaatttcttatgtcttccctttctacatagacacagtaacagtctgatctctctttctttaccctacaaggtgcttttcaattcttagaaatatttcatcagttaattctatatccattcactgtattatctgccttgtgaagcatggtactaggcatgagtgatggaacagtcagaagaatagataaaatccatatcctatgtagtttatattctatgcagaaagaaaaatagtatcagttaactataatagaagcctacagtgttatgaagtcaagttcaggatgtacttattaatgcagtcctgggatgcagaaaaagtaaataaatattcatttaataaactggtgaaacaatctggcagacagaatagaaaatgaaaagcccctgaaatgaaaaggacagggaacttgaagaaatgaaaggtggccaacatgacaagcatggggattaaaaggagataattaaagggagatgaagctactgagcttggctaggaatagttcatgcaggttcctgttaaggacactagttgttatcctaacattaatggaagctcttgaatggctttaagtagagaagggaattatatttacactgtatatttttaggttttatttaggctgccattcagagaatagaagaaaaggagcaagggacttttgtagcattttaggttacagacagtggtagctcaggctaggaaggtccaatagcagtagggaaataacagtaggttagtccaagatagtagcagtgaagacctggatttgagatatccaggaaggtacacctcttaagacatgatgatgtaggtgcagggagaaggaggtgttgaggtgacactcaaatgggtagatgatggaaagaaggaacacttagaagagtataaggtatttggtttagttgggcatgggtgaaaagtcatatggagaaaactgtgagttcaatcatggatatgccgaattcaaaatacctttaagtcagcaaagtgaggcaggcagcgttgtatatatgcttctggagctcagggacagaaatagatggtcactatcaatagatgttatttaaaattttaggagttgataagatttcccagaaatagagtatagggtgagaaaaagaagaggttttagatgaagaagaagttcctgaagaactccaccatttcaagatttaatagaagatgaaccagcaaaatatataggaagttgctggcagagaattaggacgaaaatctggagacagtggtatcctgagcaccactggaaggcagtatttcaagaaagaagtgtctactgctgctgcaagtaagacgaggtcaaaaggtatccggaccaattcagtgggtgagcaggccatagtcagatattaaaaggtgttgaggagtgctctggaattgaagaaattgaaaggagtatggcattacctgtgttataaaacaaatgatggtctgtcaaacacaccaaaatttttttttctttgcttgtactcttctttctgtatggaactttcactcctccttgatctcttgattccttacatcatcttttaatgtccaggttagataggacctctcctataaagcctttcttagccttagcctctttaagagtatgggcattgtcttaaccattagtgcattcctagtgtttagcataacataaatacttaactttacttatgtaactaataatcaaagcatgggctttggaataaggcagacctgaaattgaatacctgtttagttgcttacttactgtgagaccctgtaaaatgcattttatcctttatcccttgttcctcagttttttcattagtaaaatgtgtggggtggtaataattgtacctatcccagagagtttctatgagtactaaattatataatgcacaacaaaatgcatattaaagtgcctgccattgcaagcaatcagtaaatattagccattatatccattgctttgggattatttctctgggcagttttcaagtgccttaatgatcttctcctgtccttcatctgatacacattcccatatcatttgctggatattcatattatggaatcagaatactgtaatgttgactttctttttcccaggattgattatgtcaagtggccaggcatggaaggagcaaagaaggttcactctgacagcactaaggaactttggtttaggaaagaagagcttagaggaacgcattcaggaggaggcccaacacctcactgaagcaataaaagaggagaacggtgagcattgcatatgacagaggtgagagactgtggcccatttgttcattggacagatacttactaagtgagtaagtgcttgttctatgcccagcactgtgctaggaatggaagatagaacagtgaacaactctgtcctcaaagagttttagaagtaaatacacaaagatgggcactaaacacattactgaatttaagccctggtccgcagtttgacttccctggagttgactgaatacttgttgtatgtcagatgcagtgtaaggtcatgtggccagctcctcatatatggttctgcactaggtatgtcttatgccatgtaaagtagactctcagtaggaaatggagacaaatccatcagaaggatccatcttgcccttcctccaccttcaggacagccttttgaccctcatttcaagatcaacaatgcagtttccaatatcatttgctccatcaccttcggagaacgctttgagtaccaggatagttggtttcagcagctgctgaagttactagatgaagtcacatacttggaggcttcaaagacatgccaggtaaggcagctgtctctccatatctttgttcagtaaattggggccgatgtcagccacagatgggtttttccttttagttttttttgggtttttgaagttaaaatataacctttcaaaactaatttcaacacaaacttatttgaaataaatctattgactttagttttttaactaatatggaatatttatatgcaaaaaccatttctaacatgcatgtaaagtacaacatgttatatgacatacgcctatccacctatgttgttctttttaaaaagaaaaacaatattgctgttgcccttgagtctctcctctctgtgtccttccccaactcgtccatttccctcctccctcagaggttctcttctgtatcctctttcttcctcagcaagttgctttgagagtcatctgtgctggttgctcttttttaatgcagattagtatttcattgtatgaatgtgccactttttgtcaatctgttctgtactgacggacatttgtttccaagttttggatgctatgaataaagctgccatgaacattcttgtacaagtgttcttgtggttacatccactcatattttttatatctgtatctggagataaaagaagtttaaagattgccaagctcattgcattatttgcctgcccaccagcacttaatatcatcaatcttctaattccatagagtgtagccgtttggagttcaaactcacttctcccttggtgggccctgcaccacaatttttgtccctctaagcctttgagtctttgtcaaaaactctgctcggtttcttggttcctcagacactttttggaatttggaagacatttctgggagctggggggaggggggagaagttgaccccaagtattgagttcataccctgggctttcttcttcccctaagccttatcctggaaactacctcactaccttgatttgtatgtatgtgtgcttaaatgtttacacatgtatctttttcatcttttcttggtgttctcagtagaaagagtgcccttgaattacacagtatgccattatcaaaatttttaaaaatttccttggtttaagaaaatgactttatttttgaaaattacaaatgtgtataaaagaatacaatcatgaatcactgtgtatactcatcagtgagctctaacaattatcaacacatggccattttcactgtatctgcatctatgccctactaccacattcccactgtccctgaattattttggagcaaattacagacctcaattatttgatacataaatatttcagcatatatttctaaaaagacccattttaacaaaaataaaataccattgtgcctgaaaaatatgaacaatagttatttaatgccttcaaacactcaaccagtgctcagatgtccccagatgtctcataagtatttttttttggtggcaagctgttgcggtggtgagaaatggtccaaggctggatatatttttgacagagagctgaactgttttgctagagaggtgagagagaaaagaggggtcaaggataaccaaggtttaagtgtgagcaaataaaagagacggaaagagaagatggtttctgttgtcttaaaaagaaaaaaatggcaccatgttatctgcatgattgttttgtttttctcaattagctctacaatgtctttccatggataatgaaattcctgcctggaccccaccaaactctcttcagcaactggaaaaaactgaaattgtttgtttctcatatgattgacaaacacagaaaggattggaatcctgcagaaacaagagactttattgatgcttaccttaaagaaatgtcaaaggtgagaaaaccaaagtcattttgtattttgttcttagagcacaaatagaggtatattagtttccaactgctgctgtaaaatatgatcacaaacttggtgcctaaaatagcacagattgattctctcacagttctagatatcagaagtatgaaatcagcttcactgggttacagataaggttttggctaggctggatctctttggaggtgctggaggagaatctgtttctattactttcccagcttctaggagccgcctatgtcccttggcctgtggtcccctccttcatcttcaaagccagaagcacagcatcttctcttctctctggtatctgcttccatcctgacatactttctctctgactttgaccctcttatttacctctaataaagactattatgataacactgggcccactggaatgttccaggataatctgcccatctcaaaatccttaaccacatctgcaaagttcctttttccctataaagtaacatccctaggttccagacattaggatgtgaatggatatctttgcgggtcattactcagcctgctacaggagtaaaaataggggcaatatttcagaaaatgtagggtagcattaactcaggattgatgatgcaattagagataaagacaagggttaatagcatttggtttgaggtcctgtgaatgcccaaatacagccctttcatcccccatcccctaccctttactgttatttggaggtatacacaaagggggaacatagcagttaatcctcaaagctctgttctatcattagttgggcctagacccaatgacctaccattttcgcagccctcatagagaacacaagtaaagctgagttggatgccagagtttaaaggccaactttattaaggcctgagttggactttgccttcccttctgttttgtacctttcactttccaacattataggccagaggtgaggaagaaaccaaatgggatgcgtgacctttaacacagttacccctctggttaacacatatcactgcatcaatactgtcatctttacacatcaggaattgggtcctacttctggagtggaaagaatggtggatttctttccctcttatttcaccttattggtatgacatttatagaagtattgttttctcctcagaggaggagactcgctatatgttgtgcaggtaaggaagggatcattaacattaagagcaacattggacaaattgaagtttccagaagatgatggtaaagatgacagagtatcatgaggaatggttggtagaatcagtgagtttcaaattggaaagaaaaaggtgaatgaagagatatgagaattgttgttcataagagaaattccatttgccttttctgttatcagtacaaatgtttgttgagtatttgctctgcgtccttgcattcatataattcataatgccctcttaagaggtgtgcactcctatttccagtatataaaacaggaaactgaagaacagagaggttaagtgacttgccctaggtcacacagctgctaattgaagtggttaatattggaagccaaatctgtctcgttcacatcccattctcctttcactgtactaaaagcttccccaaaattataggcataagaaaataattgtcttgattttcatccatccaaaggtgtccagcacttggggcaggacaatgctaatgatattgctgtaataagagtctgccttctgaagaggccaaagggaaaattgtttcttttggggaccttttcttccaaatgtcctcctaggatgaagcccctttgtgttacggcaatcaggaatcctctgaataaaccaataaataacatcaaacattgtgttttctagcacacaggcaatcctacttcaagtttccatgaagaaaacctcatctgcagcaccctggacctcttctttgccggaaccgagacaacttccacaactctgcgatgggctctgctttatatggccctctacccagaaatccaaggtgagcatgtcagtgagtaagcctgaaccaggacagaatagtgcctcctgggatgtgctgcctgaagtcggggccagaagatagcattgtaggatgaaaagagaggcagaacagtcatgagtgatgaggacttggaaactgcacattcttcatattttctgtctgaattgtgatgggcccaggtaatacaaatgtaagagagaatccttgtcctcaagaagctcagaggcaagagggaaatcaacgaagtcagtcgacattgagatagttccaggaaacagttaactttctgatgtgaaagtctagttgtgtccttcccttcttttaagtgatgccttccaatttcctccagaataatgttcaagcactttagtctggtatatgttaacctccgatatgccccttctgcctgtctagccttggccgcacctaccctccatggtggcctcactaagtgacacgtcactttctttgcagtctatatttatgcctctatgtcgtgatagatgcttttccctctacttgcccagttttcctacatagtaaactcctagctcttcttgaagaatctgttcaagtactacctctctaagatgtttctgtgctcccctaggaaattattagcattttctccctccagagatgatgtaatgtgcctttattactaggcttatcatgtattatctatatatagcttccccacagactatagtccactcaagaatgatgttctcattatttttcttcctccagcttccagaaaagtttgaacatatgggggtgggaactcttaacaatacagtttttcaaattgtgggtaactgtttattaatgaggcataaaatcaatttagtgaatcaagaccaacatttttttcttaagataaaaatagaaaagatcagagtgcttcccatgtactaaggtaagtttgtttacagaactttatttttttcatctgtagttgcataatgtatgctttatatgtatatttaggtatatgcatccaggttcatgctcagttaaaaaggctagtaacaaacagataagcactgtatgattccacttacatgagttatcaagaatagtgaaattcctagagacacaaagtagaatggtggtggccagaggctgagggaggggatatagagcctcagttctgcaagatgaaaaagttctggagagtgattgcctaacaatgtgaatatatttaatactactgaactgttcatttaaaaatgctaacatagtaaattttatgttatgggtattttacccccaaataagatgttttacaaaaatgataatttatttcgctttcaggtaaaaaaaaaaaaatccaaactaggctttgcaaagccattagggttcccagctccttccaacttgttgctctgttgtgattagaatgatgcccttgttagcactctgtaagacggctcaccaataggctttccaccagtaggaagcaaaagggggaaggaagtgcatatcctttctttaggaacctgttccaaggattaaacatcacttctgcttacattctattagccagaattgagtaatatggtcacacttagttacaataggacctggaaaatatattcttttttctcgctctgtcacccaggctggagtgcagtggcaccatctcggctcactgcaagctctgcctcctgggttcatgccattctcctgcctcagcctcccgagtagctgggactacaggcgcccgccaccacgcccggctaattttttgtatttttagtagagatgggatttcaccgtgttagccaggatggtctcgatctcctgacctcgtgatccgcctgcgttggcctcccaaagtgctgggattacaagcgtgaggaaaatatattctttagctgggcagtcaggtctccagctaaaatctctattactctagagaaagagaaaagagataaggctgctacagtttctctctttggctaggtgagcactcaaccaatgaaagaaactgggagcagtcctatctggtcacacaaatctcaaaacatcagttcatgtgaatgtcaaaacatccttaagatgaaggtagatttatcctcactaatcaaataaggaactgaggtttaaagagtgtaagtaacttgcagcatcaatgttgtagagcaagagtttgcaacctgatgggtcttacctcagggcccactttccactcttacatatctacctgagaaattagagtctgtagatctgctatgggttgaatacttgggcccaccccagcccaaatttatatgttgaaaccttattaccagtgtgatgatattaggaggtggggcctttgggaggtaattagccttcaggaatgggagtagtactgttataaaagagactccagagagctgcctcactccttctactatgtaaggacacactgagaaagtgccatttgtataccagaaagtgggtcttcaccagacaccaagtccgctggggtctgatgtaatgaagtttagccatattaatcctggtcattccatcccatagcctaaccaggctcaaggagatttacagaggtggtagttttctgaataagcctttcaaaaggttaagaaccattttatttcttgcaacctggtcactaattgaaatacaacagatgacatcttggagaccactcatacctctttataataaagcataaaagtttaaaaaataatagaacccttccctctttaccagaaaaagtacaagctgagattgacagagtgattggccaggggcagcagccgagcacagccgcccgggagtccatgccctacaccaatgctgtcatccatgaggtgcagagaatgggcaacatcatccccctgaacgttcccagggaagtgacagttgataccactttggctgggtaccacctgcccaaggtaattaagcagatcttcaagcccatcttttaggggggtagaaacttgaacttgagaagtgacatttattcttgtcctaaggaatcatttaaatggaagaaaaagatatcttatacctgatataatactagattttctccatgtgtagtcttcaactagataaataggtattgtggggaggggagcaggaaggattcctacgttaaatatgtttagataaagactggcttttctttcctgtggggcctctcagtgtttttactatgctaatgtgcattgtgagtctgtgggcacgtggcaggcagcagttctaggtcagactttatcacagaacacttttctttgttttggtagaacatctcaccagactagggatctgccaaactttgggaaattctgcttcatgaacctggggttctagaatgctaaaatgtgaaaggacatttaagaccacctgggacaacatcatattaatgctggtgtttttaacataatatccccacaggtatttttccagttatttcttatagtcccgtgatgtataatttattaattaatgtatgtatttatttatttgagatggagtctcgctctgttgcttccaagtagctgggactacaagcatgcgccactatgcccagctaatttttgtatttttagtagagacggggtttcaccatgttggttggccaggatggtctggatctcttgacctcgtgatccacccacctcggcctcccaaagtgctgggattacaggtgtgagccactgcttctgacagatgtataatttattatcttataaggaagccaatctaagcgtgtgcaatattcattattgggaagggaaagaaaggagtgaacatgtattaagcaatgattatgggttgtggacaatgtggtctctttcaaaatgtcttattcaattctcagagtaagtttactcagaagaagcttgttatttccatgttatggattgcgaagtcaaggctcagaaaaattaggtttgcatgagatctctcaactatgaagagttgggatctggaagcagatctgttctgtttctttgtgagacaccatgctcccttcacaggacttgctttacattgattttaaaggcatctccctattattttttcaattggtctaagttaaattccctgtactcacaagtggaactctttctttttctttcaacttttgttttagattcagggagtacatgtgtaggctcgttacaagggtatattgcacgatgctgaagtttggagtatgattgaaccattacccaggtgactggcatagtatccaattagtagtttttcaacccttgccccactctctcctccagtaatccccagtgtctattgttcctatctttatgtcgatgtctatccgatgtttacctcccattataagtaagaacatgcagtatttcattttctgtttctgcgacaaacagaattctgatgtcactccattcgccactcttaggatctctgcagacaactatcctgtgccctctagtgccctctccccacattgcacattttcagttcctttccttgctttctaaccactttggtcagcctccgtggatcgattccagtctgtctaagtacctctgagtgtgtcatacctggggaaaatctcgagaagtagaatcagaagagcttacccattgggcactacttggttactatccctgcagagccaggaaaagcagctgttacatttactatttccttactgattgaccatttagtggataaaggctgaggtctaaattccccaggtgctgtttgcatttttctagcaatttatttaactcaaggaaaccagcttgacttctgctgctgctgatttttgtcagctttaaaaatcatcttgggaactgacaagttgaaataattgtgtgttacacagtctacgagctatgactttgacgtcaaatagacctaattcaaatcatggctctgcctcctcccactctctgactctgggcccattattttacctctcaaagcttcaatttcttcatctgaaaaatgcatttaaacctacttaacaagatccacatggaggtaaaatgagatcatgcatgtagggcatttaacccagtacttagtacagaaagtgcttaaaatagcaattattggccgggcatggtggctcacacccgtaatctcagcactttgggaggctgaggcgggtggatcacctgaggtcaggagttcgagatcagcctggccaacatggtgaaaaccgtctctactaaaaatataaaaactagccaggcgtggtggtgggcacctgtaatcctagctacttgggaggctgaggcaggagaattgcttgaacccaggagatggaggttgcagtgagccgacacactgcactccagcctcagtgacagagtgagagtctgtattaaaaaaaaaagttattactaatattggcaatcattgatattaattccttgaagtaatattatattaatatgttaatatttgaatgaattcaacaaacactacatacctgaaatgctcaggtctggcaaaacaaccctgagaaaagtaatcatgcaagtacatatttagaaacgtgataactgcccaaaggaaaaaactcactgtggtctgtaaaaacagactagcaggagtggtcagggaaggcttccaaaaggaagtgatgtttgagctgaggattagcttcaagagttagcttgatgacaaagtggggaggaggaacattcctggcaaggcaaatagcatttaaaaaggatgctgaattaagtaggaaaatggcatgtttgagaaactgaaagaagagccctgtagtgggagtgcaggcagagggggagagtagtgcagaccaggaccaggtgaagagtctttgccctgagagcaatgggtaactattgaagtgtgtcaagtcctaggtatgagcagtgggggctgtggaggtggggaatgacatgactaaatcatgctagaagctcactctcttccagagtgtgaagcagattgaaaggggtgacaggatttggggcacagttaggaaactataacagtggtccaggcaagccaggaagaagtctggactaagtgagcattggtggacatggaatggaggtgaaagtaaaattgaccagtctcactgatgggttggataacgacagagtaaaggaaaagctccctctgggaactcctgtgtttcttagcatgtacctggatggacaggggctccttgcatgggtctacctgattctattactaaacctaccatggggagtggggtgccatgtactagacattggaggaaagagaatggtgaaaccaagatgaatgagatgtcttttacctttgtagagctgccatcgttatagcttcactgagcagctgggctggttttggtacagtgcagactgactgttggattattctctcatcagtgcattcatgccccctccttccaagccctactgaaactgacctgtccctgtaaggaagctcgatcctgcagtcaagagtagccagacatccttgttaaaattcccagcagggaaatccaatctaatttgaaagctgtcccagacaaagagaagggtcctgggttgggggacacaggagactgtgtaccacaattggggagggtggggcagtatgttcaggcccccggcaaggaagccggaggatgaccacccctctgcataggtgtgctttttcatgggtcaagccttgcctgagtctctgctgctttctctagggtaccatgatcctgaccaatttgacggcgctgcacagggaccccacagagtgggccacccctgacacattcaatccggaccattttctggagaatggacagtttaagaaaagggaagcctttatgcctttctcaataggtaagttgtagtaaacaggtgtgtgggagtccagggcccctctcccagccctcccctgctctctcctgttttcccttgttttcattggaatgtctccagacagcctggccagtgcgactcactccatcttgctgtagggggcagccctgggatttccaaggctgggcattgcttcagcctgcccttacttcctaagccctccattcattgcctctgctagagatttcagctttcctgtgttctgtcctctggaaaactggtgacagagatccagactccaccaccagctcacaaagaggattaggtgcttccattttttttctttttttgatacgaagtttcactcttattgcacaaggctggaatgcaatgccatgatctcagctcactgcaacctccacctcccaggttcaagcgattctcctgcctcagcctccctagtagctgggattacaggcatgcaccaccatgccaggctaattttttgtatgtttagtagagacgaggtttcaccatgttggccaggctggtctcgaactcctgacctcaggtgatccacccgcctcggcctcccaaagccaaagtgctgggatacaggtgtgagccaccacacccggtcgggtgctgccatccttactaaatgttaaaatgtcctcagttctttttaagggctgcccactcacacagaaatagagctgatttataatgagatagagagggacaaggggaaggagaaacttatttgccacatgggcatcagtcagtggcttaacttgattggattctactctctaagtactcccttgaaaaggttctttggcctttgtaaattttaattcattttttaaaatctaattaatacatttatataatatgtaacttgaaaattaagaaagaagaggcagtgaaaactctctttttttctcttgtttttaagatagccaggtccaaaaatatatttttaactcacgacattgaacaatcaataacaaaacttcttaatatgttccaggttttgagttagatatgttgcatagattatttcaaataatttcacaattctttaattccatcaatatttattgagcatctattatgtgtcaagcattcagccctggtgatatgacaatgaatgagtgaaacagaaaccaaaacaaaacaaaactgctcccatggtgcatatgttctagtgtaatcatataaagtttatattactataaccactttagtgatgaggaaactgaggcttaaccaagtatagaaactaaagtcataaaactcatctggcagaggtaggatcaatgtcaaccagattaatcaaaaactaaagtgggtgttcttgctaacactatctactgaaaataactaaatactacacagacccacactgtggaatgcacgatagtttgcttattgttaatttaaaatatgtattgatgttccgagacaagatcattttgctgagaatgacactgaggctcagaaagggcagaaacggaatgacccatgttggtgtgactccaaagcccatgctctccccctgtgctgtgttgccttaggtgtctctgggctgattctgatgatcgatgctgtctttgtctttcttcatctaattctgtcacctccgctcacactggacaattcacttagaatatgaaagctgatataagacataggactatcttccagtcttcctgtctacaagagtttgaaattttgtattatagcacaaagtttcggctgttatgttccagttattataattaattattcctgttctttggctcttgcacaacatccatgtggaaatgctagaaatgtgacctctgcattccacaaaaaatgcttcacctaatgccagctgcaaccgtgatgagaggaatcttattagaagtccgtggttttaaaaggaaaagggatcctctgggctaagtgatgcctggataccttttcttcacatcacagaagcctctttctcatagttccttcatgtctcctgttttaaaaaaattatcttatctgaattagcagtagtctttttaaaaactatacatggtgactcactgctgctttgctattgagaggtgtattgcaccctcttagagacttcatttgcaagaaaattgtctaatttaatcattacaacagcccagttattaatagttaggcaggaaatggataggtatctccttttaatttaagataactaaaaataagagagagttctttcttatccaagatcatatgctcaaggaatttgcagaactggtcctaagactcaagattttatacttctagtctagtgttctctctagtacgactagaatgtagcttacttccccatttaaaggcctaagattcactaatttcataacatatgcatcagttagcatattgctacataacaaacagtccaaaactctgcagcttaaaacagtaagcatgaattattgctcacaagtctataagtcagatatgtggctgtgcccatcttggctcggccccctggatatctctgatcttggccagtggtcaacaggctgatggctgatataggatatcttcacctgggacagtggggcccttctcacattatccctcatcctccagcaagctgtcctggcttagtcacatggtggtgataaggtcaaaagagggagaatggaagcacacaggcctcttaaggtccagactgggaactgacacaccatcacttccattgcattatgttttccaacaccaatcataaggccagccccagtttaaggggaggggatattactacaatttttgatgggaagagctatgacatcgcattgcaaatgatgtggatccaaggagaggggaaaattgaggctgctttgttcttaccatctctctttctgactgagaagaatgaaattcatagaaggcaaaaaatttatctgggatgtcccaaagcagatgtgataggatgaggaccatttaaatggatcaggagatagaaatctgaagaatccaaagggttgacaaaacatcaacacaactgtctgtttttttcatcacatgcccatcttttggcatgcagttgcttttccttgctgttcctttactcttggtaaagagtcttctagaggactcttccgaagtcctcactttagaagatgtaacagcttctaaagtgtgcataatcaagacaggtttcaaagtttttattgcaaatttatatttacttttcctcatttaaattcttcctgtttgatccatcaaagcagcaagcagctttatgaaatacatgagcccagttcctctctttccagttaaaatcattagattctaggagatagggctggaaagaactttgccaaaattgtaagtcagttctctcattttactactgaggtaactggcctggttggttagtgatagtcagtttgtggaagcaccagggaggggagccaagtatcctttcttccaggccaaagctttgacacctaacagtcctagtttccatgcttttaaaagcaaattcatatctgccattgcattgggatccttgcctagccgtgtaacatggttaggagagaagttatttcatgtatgtgacaaatgagataagtttagttttgcgagaatgaatggtttattaatagtcacacagttggttactgatgaagccagttctttaaccctggttcctgacttgctaggtccagtttgtcatgatatatggattcttttaggataatcttgggtatttacaataaactgacttggtatcattttagcatgttgctaattgtactatttgtgatggataaagagataaaggtgaggggaaccgagatgaattagacacacactgttgggaaaacaggcacaaataatataacgacataaccatgaagcatgtttgcctttactaagcatttttgcatatatgatctaactttatttccttaacaacctgttacagacaaaggacaaaacttaggcatgcatacatttccacgaatattaaattacatgggaaaatataaagcagtaaaagcagcaaatagaattgactatagggaataatatctgttatgatgtacagataatctccacaaggacaatgaggaaatatgttaaaatgttgacaatggttttgtctagattatgggattacaaacattttatggttttgtctttataactttctttttcatgctttttaaaattattgctgtgaataggtactacttagggagaaagtaagctactaaaaatacacacaatagagatggtggtagtgacttgtgtggggtaatgtagcccaggtggggtgaggaggacattcacataggggagggggtggtggaagctgagtgctggcctcagagcacaaatggtatgaggtggagtctgcacagggtggctgtggcagtgatgagaggtaagttatatacaagggatactgatccaataagtaaatatattgaggataatgagaggaagttgcaaataaagaaagggagaaaatcgaactttgtgatgttggattggaatctgatgtaatctacaatgaactcagattttcaataggtgaatcaataaatgtagaaatgtagatgtaaatatgggtatatatatttggtgtatatatatatatatacttggtgtgtatatatatatatattttatatatgtacacacacacacttttggacatatacccacattatatacatacatatatttcttagctctgcccactgatataagctaggggcaacaacatctggagagcaatgagcatgcctaatgcccagatcttgatttctacatattattatccactaaaagaaaccaggacttttggaaaaaaatggctgattccagggctggggaagggaaagtattataaacctggaatagattgttgtgcccaaagtcaggaaatatcagcttgattgggcatctaatggtcaaatctggaatattttgagcatcagaacaagtaatgatagtaacagattataaccctttgaataaaaacaggaatcccatgcatttaactgatatcaataaatgagtgaataaataaatggggaggggagcaagcatttcccttagtaaagtgttaactaataaatgtggaagaaatgacagaattttaaaaatcgcgatttggtagccatcagcaattaataatatggtcaagagatatacctaatgctagatgacgagttagtgggtgcagcgcaccagcatggcacatgtatacatatgtaactaacctgcacattgtgcacatgtaccctaaaacttaaagtataataataataaataaaaataaaaataaatcaaaaaaatatatatggtcaagaaatagcaatggaaaagaatggatcacagcttaatgagaatggtttgttgacatagtctcaaagtacttattagttacagagaaaaagaataattttacaagagaacttggtagacaccaccttaatcaagtgattaccaataatgtaacacatcacaattgtatagcacttgatagtataaaatgagaagaatacagtatcactttggtgatattcctacccaaaatggaaaactccacagcctgaatccaatcatgaggaagcatgagaggcatttacaaaacaactggtctgtaatctttaaaaaggccaaagccgtgaaagttgtataaagagtgaggacttattccagactgaagaactaaggcgacatgacagctaaatgcaatccatgatcatgtactggctgtactggacccttttctaatgaaggactttgggacaactggtaaccctgaatgggacctcgggaagatgttggtcatgcatcagtgttaatttcctggcttggatggttgcattttgactatgttggagaatgtctttctttttagaaaatacatactgaagatttcatgggtaatgtagacaatttacttccaaacaacttagaagagccaagttctttgtctatctctgcaagttttttgtacatttgaaattatttcagaataaaaggcttgttatggaaagtatcacagtaaagaattgtaatatacagaaagctgtttgagtaatgctaccacccaaaagattttctttagaggtcatcttttaaattgtattctcctgttttttgagaattaaccagatcaagttaataataagcaattgtacagttatgtttattattacctaggtgacattttaaaatactttgttttgaggtataaattattaaattatttagcttatttggattcagcatgtagctcacacaatatataaagttctcatcttaaacacatattcgttttcactaatatgcacaatgtacattttcactgattcctagagaggttgtttaatttgccccaatcacgtggttaggaggtgggagaagctgaattgaatctctgcccttctgccttcagttcacccacacataacagggagtgggacaaggtcagggcaatgctaggtgtcagctgtggagaccaggacccagccttgggccacacttcagaagaaatgcctgcaaagggaaagggccactgtgcataagaagaaccactgaaggaggaaggccaaagcagtcgcaatacagagggccacccatgccagtaggtcccccatgattaaggaggaaaagtggcacagggaaaagatgacttataccttaggaactctgctctgacatttatttccttatattttcaacaatttttttaaggattaaaaaagtgaacatatttggttgtttttgttgtctttttttgtcacgtttgttaaatgatttttttaaagctcttaggctaaacatcccctttctagctcagcccacgccttccgcttctatggtcctacaccctgcaacttcattctggaagctcgcctgccggacccctgatggcatttgacttcgtgttcctggacttctgctttctatgcattgatgaacccaagtggttatcagacttaaataagctgctggccataacaccctggggcctacaggcccttcctctgctccatttttttggggatatgattgaggatagcaatctctgctaggcacaaatgccacctgagaagataacccgtcttttgattttgtcttacaggaaagcgggcatgcctcggagaacagttggccaggactgagctgtttattttcttcacttcccttatgcaaaaatttaccttcaggcccccaaacaatgagaagctgagcctgaagtttagaatgggtatcaccatttccccagtcagtcaccgcctctgcgctgttcctcaggtgtaatattgttaagaaagaaaggggcaaggaaagtaagaagacatggcacgtgttctgaaaccactggtgtctgctcagatgtgttgggacaaaatgaaagtgactttcaagaaagatcagaggaatttgactcagagaaaactagatccaaatcccagctctactgtctcgtccgaattagccttgggaaaatcatttatatgctaaataatttacctttttatctaggagatgaaaagaggataatgtttccttccataaagaaagttcttgtaagaatcaaaagaaatggtgagctttaagtggtttgtaaaccataaaacacatcataaaagttctatctata

SEQ ID NO: 211 - DNA, 37881 bp, Homo sapiens
  source 1..37881: mol_type = genomic DNA
aatcatcatctcagggtctggagtctaagatatctgtaggtatggagaaccctttttagactggattttcagattttgatattgagcttctctctctgggggatctggggtcgttttttcctcaaatcaggagtctcttttcctctagattttggccctgtgtctcaaattaccccacagtggggggtggtgaagtatctttctctgtgggtctagggtctctctgtctcagggtctggggtctgcatctttaggacctctgtctctctctggtgtgtttttgagtcaggggtctctctctctctcacaatctgggcctcccggagtaggggtgggggctgcagagtctctccctcctcctcctcctcctgctctcttcgctctcgctcgctcccccgccccccctctctctcggctgccgctgctgccgttggctcttattctcctcctcctcctcctctctcctcctctctgcttctctctgctcctctctcctcctctctcctcctcctcctcctccacctcctcctccttctccccctctttctccccctctttctctcttctttctcccccgtccccccgccccctccccccaggcctgatgagcaggtctcgagcctccatccatcgggggagcatccccgcgatgtcctatgcccccttcagaggtacgtggtggggggagggggagggccatatggggggcaacagggggaggggcagggggcgggggagagtcggggccgagggaagggagcggctgaaatggagggagaggggaggaccgggaaggcaggggtgggagcaaccgggaaggagggattggaggccagagggataggggtagataagggatggaggggccaggaaatgggccttgaaagggggctgaagggaaaatgatgaaggggaaagaaagcgccagaaaggggtgggaaggtagaaggattgggttggggaaaaagctgcagaaataatttgggggtgggagctgagtgatgaggaaaacatcaaggaaatagagggacagagtcttgggagaggggctaggaaggagaaatgaaaacataggggtgaaaagagaagccaagaagatgtggggggataatttggtgggggactcagagtatggtaaggggcggaaaaagagaggaggatggagggagagaaggggccagatggagagagagggaggcagtggggggtggggggatggagggtccagatggagggaagagagaagagagagggaacggtgggggaggggagaccagggcagggggagggccaaattatgtgtgcttgggggggtggcagtacaagtaagatgaaatgatgggagtaggggacaggttaggatcctgccccagactctgaccctcttaaaggctcttgaccagtaaaatgtaacctctggggtcttaatgctgtcttcacttcatcacttttacccccttcccccacccctccaatccttatttccattccccctccctcctctgctgtccatcacctatatctttccccccatatggtgtccgttccttatatgagtcccccttctgtccttcccctatatcagtcccctctctggtgttcattgcctctctcttatctcttttctatgtggtcgctcccttatatctctatcacttctttactagtccgtcttgaccccttctcatagcctccgcattaggtctgcctcctttgctctgacacatgtccagtcgagcccttcaggtgtattcccttgcccctgggcatttaccatcatttctgcctccttttctatctactcctattatttgtctcccagaccattccttgtcaccacaagtctgtgcctacccactttcccttaatacctcaactcttattatcatttctcttttcttgtctcctctacttattggggtgttggagatttggggtacaaagacacaggttttgatgattagaacaagggatccccatctcagcccttgagggatttctcatcctagtaaaaatttcccgtttctcagccatgttgctctgcctcttgcatctgcctcccagaatcattcttcaccaagtccagacagtatgtgtgtgtgtgtttctagagttgttcctaagttccctgctgccaggagaaagatgccctctgaagtctaacccgcctcccttggctgcagcctgaaccagccctttccccaaatgcttatgtgtatcaacagatttctcctctgggtataccaagtgtctaagtgcggtgggcatgttgcctgcaatgtctgtagtttcagaggctaggtattggtgatctctgtatctagagaacattagttagtctctgagatgggttgagatagagtttcaaagtatgtggtttctaaatggtggacattctgagggttcatcgctcactgtgatctggaggttgggtaaatttgagagacatatttatagacagaaaagggctgaatttgcaaaactctgctactcagtgcattctgttggaatgaagctcaaagaccagttctcctgcagtatactcatggttatcccataaaggtgacagagtttgatcttttttccatctaaaatctgataccttaagcctaatttctagctctttgctgtcgccaatgtgacatctctcttacttcaatagggcctgtgtggcattggggtttaaaggagaggcagtttgcagggagagcggcatggcaagaacaacagagctggggaaggaggaccctggtctcatctcagccataggcgacacttggtctactgttctctcttctcaaagttttgttcccatctccagctcttgtctttggaggcccctctgtgtcaccaggcctggatattccattctttccccctgacatctttcttcctcaagctcctcactgtgccttgagaaggctcctgacctatggagtggcttccatcctgtccactgagactaggtggggtgaggtggtgggggcagtgttgaatctctgggcactgaatgggagaagagataaatttggtctctacttgtccaaacaagggcatatttcccaccttctgccctggggcctccacagccagatgccgacaaaagccatcttctccttaccaccagaagaaccagaactttccctaaaggatgagcagggttgaactaggggaggagggcacagaggagggaagagttgggaggggaggccctctcatgtctctgactgtgaacaggtaagctccccgacttcttcttttctagatatttagccctcagaatctcatgatcccaatgttcctacacacacaccccatccttctttcccacagccatgtagctttcctcatactcttttatagaggggtggtgccaccttccaagtccttgtcttctgcagctatttggatgccttcctctacccagatatctgacaccaacttctctgtttttctcctgccaattttgcggcacctctaccttattttcctgaagtagatggagagctccttcatctttctctgcccccaaacgtgtaccttctctgtcatataattcccatccctgaacctctgcatttcttcccccaagtctccagagccttctgtgatgtgatcctctcctcttttcccctttgtataaatgcttgtcttgtgttcctttagagttgccaggtgtctcactttcaactgtgatctcctgaaggccggtagggtccccttctcactttgtggactctcttcttgccattttaggcctctgcttccaaatgcatagagcctcccttactgtttctgtgtgtctctgtcctccagatgtacggggaccctctatgcaccgaacccaatacgttcattccccgtatgatcgtcctggttggaaccctcggttctgcatcatctcggggaaccagctgctcatgctggatgaggatgaggtgagtgtggtgagaaggctgggaaaacgcatgtgggagaatggggagagtcctcattagtgaaggggagagagacacaaagaaggcagacaaagaagaaacatttgcaaatggcaggagggtggccattgagacttgggttggagtgtgacaagaggggtagtcattctctcatcttgggcagggagtctttgagggttatgagctgtgttggggaggagatgtggttctgaagatttcgggggtggggaggctcctgttttcacactgtccatattgtaggataggttagaatggggaaggggaactgaagggtttggagaaggggtgaagacatggaaggccctcccaaccaaagcaatcctcaggacccctctctgctttgcccactgagcaagactcccagtcctttctccatcagggggcagagtgcaagaagagaaattgcaggacgcagagaaaaggcaggggatagaggaggttttaggtagctggaggatactgggaaagaagactgaggtcagtggatcttggcatgatggggtgaagactgggagagtgattgagatcaaggtttagagagacactgagagggcttctgcaagggagtggttggacatcaggaaggaatataagggaggggaactgggagtatgtggagttatctaaaggagtacaagtggagtaggggcagggactagccagagtaaaggagatgaaacggacagaggcctcttatgggaggtggtggccaggtatggagatctgagagccagggaagtgtgggttctgatttgggagctgggtcagcaggagtgtccattggaggaaatagaggataaaaactggaatggtgccccacaagtgtgagtcagggaatgggggtgatttgggggacaagctttaaaaaatggtagggtagcctggaaaaccaaacgtggtgagagatggaccctgaaagttattgggaatggtgtgatgaggaagggttagaatttgagtcagggctaactagagtgtcaagggacctatgggggcaggtgagagtgtggagagatggctgggtagacagcttccaggccacagagtaaagtagaggtgttaaggagaggatatggtgactttgaaaggagaggtggcttggggagtctaagttttggacaccattgggagacatttgagtgactgtggtcaaacccctagatcaaggtttggagtctgtaggagaaatgggggaaactggaacccagagtggggactgttatagggatgaagagggaagacaatggattggggtaatgaaggaatgacagagatagggacagactgaagggaccagtggccagcaagttgaggggcaataggaatggccggtctggagcaggaagggcgtgtgtgtgggaggaggagtagatagaattgggaaaatgagcagcctgaacagacgcagggagttggaattggatgggtggtggaactggggctgggggatagtgaggggtctgttcctgtggctctttgtagaggtggaggagactgcaggggtggaggtgtatggaggtagggatggaggtggacagggggagctgggtgtgaagcttagggaaaggtgatggctgaggggaagaagggaactgagagatgctgggtcgggtgatggaaggagatgaaaggtgggggaaggtgaccaggccctctggcgggaggggaggttgggtcccagtctggccgcaagccgggccgtgggagggagacaagctgtggatcctgattataaatgcagcttctgctacccccgtgacaggctcggagggagagaagggggtaagggaggtgggaggttgggaggaaagcagggagaatggaggaactgaaggtcaagggaaaactggattcaggaagtagctaacttctgaggagttgcagaagagctgagtagggtttgggagaattctccggaaggtgtttcaagacaaatggagggagaaaagagggtgggacggcaaagaatgagagagagagactgggggagagaagggagagatccagtcaccaagtgtggaggggccggggcagaaaaagtgggcaggcttagggggaaaaggaggcccgcccttcctgggaggaggcggaggggggaagagggaggggaggggcggcgtgggccagggaggtctgacacacccccacctcccctagatacaccccctactgatccgggaccggaggagcgagtccagtcgcaacaaactgctgagacgcacagtctccgtgccggtggaggggcggccccacggcgagcatggtacggcggccgagcaggctctcatgacccggacaggcgcggggagagggctgaagatggaccgggctggcggggcgggggcgtcggggagcggcgggagctggccgggggcgggagaaggcggagacaaagtcttgcttcccgaggggagatggcgccctcctctggaaggtggagcgggacaggggctgtgggtgagaggcccctgtgggtcctcgctcggcttcgctccctttctcctctccagcagtgaagtttgactattttcctggtgcttgtaaaaatagtctccttagatctttagcttccagtccgtgtgttcctgcccctgcccctcccagcccctggtctgggatcttggaaagaatgacctagttcctgccctccccccagacctcttccccacccctatgctcctgattcttcttccggaccttcagtccttgaggtctccttttattaccccctgttttctcctctcatcagctgcttctattttctgcaattgtatcaccctttctctttcctccctgatttctcttattttctgtacccctcttgattaccccgtccctcccctctgctcccggcgaaagtccatcagactcccatctcatctcctttctgtctgtagagctatctgcgcggtctgtctctccaactctctccctctctccatctgtctcttcccctccctccccctttctgcccccccaaccccctctttagtcatttaaaaaaagatttttgtcttcctgagaagttcgcttaaaaggtttccatgggaacagtgaggggagatgaaggcagagaacagagatctgcagccaaggtgcagagagacgccctcagcccccggaaaccccctcgtcactgcccccttccacttcatttcccttcccggacctagcgatccaggttccccattcctccaacccccaggtgacccctttttcccaccagctccccctcccttcaggaattcaagctaccagtttctctcccttagagagccagtgacctgtccccatcctttggctccttccagccttctgataggtccaggccctactagccttgtgggccggtttggggaccttgggtgggtgggtgggtggtcagggatgtgtgtcattgtcatggaaaccccataccatcggggtgtgtgggtagcacatctctgtgaggcaaagtcaggtggtggtggagtgtatacagagaatgtgtgtgatgtctgtcacatctgtgtgtatatgtatatgtgtgtatgtcatgttcatgtctggggaagatgtgtgtgtttgtgtgcatgtgtgtacacctgcgtttccaggccagaatggtcacatgctcacagagcatgtttatcatgtgtcctgtggttggcagatctgcccacttattccccatctttctccttatcctgagtcctcagggtctaggggtctctggcgggggtctcccgtgtgttttgggtggggacaccgtgtgtgtttggagttgaggtggcatgtggaggttgctgtattggggttcagtaggggctgggaggggttccaggggcatatgtatttggggggagggcttagtgaaagttgatgggggtgaacgtttagggtcttcaggcagacatggaatgtgtaaagggcatggaggatgtgcagtggacataggggtcgttgggaccttggggacttggcaatgccaaggtgtttgctgaggctgtggactctccagcccgggagaggtcgccggacctttgaggggcattggaatcctgggctcctcctctgctgggtggagccgcgaaccctcgttctctccgcggttttgtgtgtgtgggggggtcctgctcaggaggggatggtgggtggcctggtttgttttgggggtccccttgcccccctcccccgtctctctcgcgctgtctccgggcgacagggctcgtgacagaggcggccacggcagcagcggtcgcctagcaacggcggcggggcccgggcaacggcggcagcggcgggagcggcggcggagggagccgttcccgcggccgtcaccgcgcggccgtcccggccgtcccgggccccgccgccgcccccaccgcgccgggcggcgcgagccgggccgtaccgccccctctccctccgcaccccgcccttcccccgcgcaggggcggggcccctcccccaccggggacacccctggcccccccggggggcggtgcgaggtaagggcggggccgggcggactaggagcgcgcgtagaggggggggcgccgcgcgcgtggggcgggggcgcgcgtgtgcgtgggcgcggggaggggggtggggaagccgcggtggcggcggcggcggcggcagctgctccctccgcatgttctcgctgcatcttccgagtggggggagttatggtaaccggagggggacagcggaggacgggagggtcggggaccggcctcgtgcggacagggtcttgagcacgcgggggcggccggtgtgtgtgggatcttggagcccctggtggaaggggcagcccgtgtgtccgcgtgtgtgttcgtgcccatgctcgtgtctcctgtgtgtcggtgccatgtgcacacgggggcccagttcctcgtgcacacatgtgcagccatccttgtgcaagtgtgtcctgtcttatcttgcctctgcctgtttcctgcctagggggctgttgggccagccacgggcttgtggggcagtccgcggccttgctggtccatgtcacctctgaccctgagcatgcatatccctggctggggctcacctcctgtcaggcttctgtgtgtgggaatgtgtggccctatgagcaggattttctgtgtccctggtggcaggtgtgtgtctttgcatgtgtgttccagcactggcctgagtatctgtgtcaatcccagcatgggtgtccagggcgtgtctggatgtgggtggtgtggctggggggagtaagtgtgtgaatgtgttccttggaattctactgtgtatgaaacacctttgggctgggcaggtgtaagccctgcttggtcagtaagtggggacagaaaagcttaaaaagggaagaaatggggtaaagaggaaaagtggggaggggataggagagaaggaatgagagaggcttgaagaagagagcagagagcagcaggccagggagaaagaatagctggagaatgggaatgtgggagaaagccaagccagacttagaagagagaacaggggataagagcttaagatggggaactggatagagatggtgggagaagaaggggtctgggagctggggaggcagtggggaggagagagtcaggccttctggtaaagtgatctctgaaagaagaaagggaagaagatgggagaaggcactggattcttgtaggccttgcaggatcaggcttggttttggatcagggaaggccactcaggcatacgggctggctcacagtgaggcctgtcatagcagggactgtcattagaggttcatatccccagcacagagctctgtctcccatttctctgctctgtgtccaaccctgttcttcgcccttctctggcaacctccctcctctggctccccttgagagctgccagctgggtgtggagaggaagaaaggccaaagggaaggttagggatttggagggcagggggagattctgtgggtgatggcaagattagagatgttggaggggcaggagtccaagcccttgctgtgtgtgtgtgagtgccattgtgtgtgtacacagggtgtgtacatgtgtgggtgtgtgcacaatgcctgtgttacgggtttgtgtaggtggctgttatgtgtgtgcatgcgtgtatacatcgtgcaggcatgggacatggagacccaggatcacagtttgtgcttttcaggtttgctgtgtgtgtgtgtacacgggtgtgtgttgttttctctgtacatgtcactgcatgcagcattaataacaggatgttctgtgtttctgtcactctgccccccctttcctctgtgtttctgctattcttttcctgcggcaacaaaagtgtttaataagcatatgtgtatgtggcctctgtgtacctgtgacttatgagtgagttcatggatcttagttcttggtaatatgtgtaaggttatattacttccaagaaccaagcaagccaattagcaaatttgttcttctgttaatgctttagttccaaagcggaattttaatgcatttaaagttagactttatgcctttattagatgagcttgcacatgaaaataatggctgagctcggttccctgaaatgagagtgaggcagccatacctgagaaatgcagaaaaaatgttactagggaagagatatcctgaaccattggatgcattgcttagtgtgtaccagaaggataattaacacatttgctcctggtttttctttactctggtggcaatctcggatgcctgtgttagagtgagagaagggctgggggaggaaagggggttgtcctgagacagagtggatgtggttgtacttttcacgtgaatgaaaggatgtttgtgcttctgagatatggggatacctttctgtggtcaggatcatggtgtactcaagcatgtatttcaggggttaaactggaattcccctgcatggggatatgtgtgtcttagggttataggtccatttctgtagtgtgctgtccacatgattgcccaagagacttgggccacaaagtccacaccagcagctctcatgtgggtcactgggttcaagtatgtactcccttgttgcagagctcacatatgtcaaagcatgtatcctgtggggtgtgtgggcctcagggtctcagaatgtggatccgtgctatgcccgtgctcacagttgtctgtatgtctcaaaagcacatagatccccagttatttttctgtattgtggttctcatatacacgtacctccatagctcagtatatgtttctgtactatacacctgttcctgagggagtgatagggttctcgtgtcatggggtccacatttttgtatgcaaacctcctaacacctgggttttacaggtaaagggaagctgaggactgattctagggcagtttgcaggcaatttgcaattctggaagcagacagtgaaaatataattgtggtcctcccttgttctgttctggaacctagagggttaacaggcagctcttccggtccacccccctccttccagcctgtagcttcttgttgccgtggagatggtggccccgccccgatgcagcacctgcccccccattggctgcagtggtgactgtggggctgaggggggagcccaggcctgggcagccattctggagctggagccggagcttggcatccccccacttacattctcttccagcccctcggcccctctaaattcccttgcagccgagcctcagcttcctttttcagcgcttgccatccctctaggctcttggcagactgagctgcatccgcattcacctcccctcctcctcctttccctatccttacttgggagtcccgagaacccccactgtccatccttcctgctccctgcccattcccctgcattctttgcttttcccctccccccaccaaccttctgagcccctgccactgcagtgcacgtggaaccggctccttctcccttccccccacctgccccttccttggattttctgtccccagcttctccccctgctactcttcacaggtctcttccaagacctccccctccagtccagggagggggtcatgggaggcagccctggccctccagacagacaggggttccaggaggtggggggcaggtggaagatgtgcccaccagggggaagaggaaagcctgcctatgggcaatgacctttaacccatctttccccccagctagccccttctggggtgggtgggcaccagggacctagcctccctggatctttggtgtccttcattactggggttttactgaccctctcagccatgctcccctgctgactgccagccccagtcatgggcctaaggcctcccaccccatccccctcagggggctcctgctcaggttccttgccccctccttcccgctgccagcctctccgccgtcgctgctcttcctgctgctttccggggggtaggtgaggccggagctgaggggcagagggaggtgggggcatgcactggggtcaggggtgggaacctgggttaacagcttcccttctggccccctccccaacttcccttctggccatttcctcccctccagaataccacttgggtcgctcgaggaggaagagtgtcccaggggggaagcagtacagcatggagggtgcccctgctgcgcccttccggccctcggtgagtggtgcctaccagatgtggctcagttgggccccctcccctccagccccaactggggccctaggagtctgagaaagagggcaggagggggagagagggagtgagagtgagaaaaagagtgtgtgtctgtgtgtgtctccccacctctttggtttcccccttcttggctctgcccccctgcttctgagaccagccctcccaccttctccaagctgtgtgtgtgtgtatatgtgtgtgtgtgtgtgcttgcactgtacccgtgggagcaaggaagacaaactggtattagggttcctatccccctttcctcgcctctggagacttcccttttccccatcccactttcatccaggggctctctaccagctgagggatgagtaggtagaactgaccctgccccaacccaccccatccccatttcccccccagcaaggcttcctgagccgacggctaaaaagctccatcaaacgaacgaagtcacaacccaaacttgaccggaccagcagctttcgccagatcctgcctcgcttccgaagtgctgaccatgaccggtacaggggctggagcatgtgggatgagattgatgtaatgtagggtctcctgtgtgagatgcagagggagggggttatctgtgtgcaaaggttgaaggattcaactcaagttggttgggggatgtcatggcacaggggacagaacagaaaagaactagaatagggatctgtgagcagcaggagaggggtagggtggcagagagaagacagacagacaggctggaaagggaatgaaggtgaagccaaggagggactcctcagggactcctcaggccaagaaggatgggctctagcccaggatcaaaggagctgtacaggaggagagtgaccctggaggaatgtttaaggaatgcagggaaggggttggtaggtgagtgagcaataggctgtaggtggaagggtgtcagggaaggtcaggaaatacaggggcagcaggttggagtggggctgggggtggctgaatgaatggatgatggctagggctcaaggacctcatcagtgagggaagagacagtatagagcatggcagagaaggggaggctgggacaggtgtgcagggtgacagaatgggaagcaacccatggactgaggcatgaagaagcagccagcggagaagtccagaaggcactgtccctgagaccaggctgaaggagacctccactgtttgcctttgttgcctgccatttggggttcctctctgggtttccccctcacccagtcactccccagggagaaccatgccctccctttcccccatgtctggccacccccaggattgggcaggtagggaggttgggataaagtgagtcacacctttccctgcccccctcccatgttgccagagctggatttggggccggcagggggtgagggcatggtattcctggccgcgggggcgggggggggggtccgggggccgggggagcgtcgcgctgacggcagccagagcctgcgatgacggggctgctataaataacttcttggaggctcccacacccaagctcccctcccgctttcccactgctctctactcttcatcccctgcccatctccataccgcttttgtattgctatcctacccctcattattccatgcccctagccccctttatcttctgccctcctgcagtgatttttttgcattccatcccctcttagccctcacctcggttctcccggccatctctccagttggccttcctcctcttctcctgtcctctgtcttgctgcacatacctttgtctccccctttcttcttcttgccctacctcctcttcttccctagtccgtgtattctgtcttttatcctctttgagctcttttctgcccacagctttctcctatttcttatgcttttccctcactctttcccctgcttctgctaaaacttgtcctcttatgctgtgttcattcattctttgaatcattaaatgtttatcaggcactagccgtgtgccaggcccaggctagacatatctcttctctgtgccttcacttctttacttccactttttcctttatactgaggctctggtttctggggttacctggaggtactacctagaagtgccccaggcccactttgttctctccttttttttttttcttttctgccatggtccatttctgggttgagatatttctagatgtccccagtcctcgcaatcccttaggtgtgagatggtgggagtttcttttttttcctttttttttttttaaatagaaatagggtctcactgtgttgcccagactggtcttgaactcctgggctcaagtgaccctcccacctcggcctttgaaatgttgggattacaggtgtgagccaccaggcccaggtggagcaggggagttccttaaaggattctgatttttctcacatccctcacgtccttcctgataggcagggtttctttctgtgtctgtttgggaagggtgttcagggggccttctctccaagtctccatcctggaacagactgatgatgcagggtacctatgtgtctaagaagagtaggggggccgggcgcggtggctcatgcctgtaatcccagcactttgggaggctgaatcacttgaggtcaggagtttgagaccagcctgaccaacagggtgaaaccccgtctcagctaaaaatacaaaaaaaaaaaagaaaaaaaaattagctgggtgtgctgaggcaggagagacgcttgagcccaggaggcagaagttgcagcaagccgagatcacaccactgtactccagcctgggcgacagagcaagactgtctcaaaaaaaaaaaaaaaaaaaaaaaaggaagagtgggaagccctgatcccttcctctcctgaacctcctgcctgccagggcccggctgatgcaaagctttaaggagtcacactctcatgagtccttgctgagtcctagcagtgcagctgaggcattggagctcaacttggatgaagattccattatcaagccagtgcacagctccatcctgggccaggagttctgttttgaggtactgggtctggtgggctggggagggccaaaggacaggggtgatggaaggtggggggcagagaggtctagagaaagtggcacaggtggggacatcaaggaaacagaaacttctgggactggaggaaagggtaggccagggaggaagagaaggtagcagagtctcctcccctctgtagccctttccctcaactccacactcctttctaggtaacaacttcatcaggaacaaaatgctttgcctgtcggtctgcggccgaaagagacaaatggattgagaatctgcagcgggcagtaaagcccaacaaggtattggggaataaaggggacacaacctgtgcagggcaaaggttgcaccaacacgggaagctgggggcctagggaggaaagtgagttaaaggaggagaggcttggggaaggagaggattgaggtacagtgtatctggacaagcagggggagacccccattattctgagtcccccatttcttttcgctttctgtactgctaccctgccttacgatctctttccctgccatagaagtcatagacttacagagttgatggggctctggaaattctttagtctagcttccctgcaggcaggaatgcttcactaataccccgcaggacacatcaaatacacttagccaagtttctgtaccttggtttcctctctaagacagagggaactggtggcaatgggttggattaaatgatctctaaggtccctttggcacataaattctatgagtctgttcttcccaaaacttcatgcttccagttctgtcagctattctctgtatcccagtttctagcaagcttacagtcctagtcacactcctctggggggaactcttgtgtcttgatgtccttaaagaactcaacccaagatgctgacatgatctgacctatgcagagtacaaacaccatgttccctttcaacacactgcaatatcacctgagccttaccattagcttgtgctcaattgtatccccccaggcccttactgattcttttttttttttttttgagacagagtctcactctgtcacccaggctggagtgcagtggcgtgatcttggctcactgcaacctccgcctcctgggtttaagcaattcctgtgcctcagcctccccagtagctgggattacaggcatgcaccaccacacccgactaatttttgtatttttagtagagacgaggtttcaccatgttggccaggctagtctcaaactcctgacctcaggttgtctgcctgcctcagcctcccaaagtgctaggattacaggcatgagccaccacatctggccaagctttacccattctatatgcaattcttttttcacaatttctgatagtctctgcaggactttccagttcccttcaaattctacattaatatttttggcttgttattccagcttttgaaatctttccaatactgtttgtgttgtctagtgtatgtctacgcttctacagtagcttcctggggctgctataacaaactgctacaaactgggtcacgtaaaacaacagaaatttattctctcacagttcaggaggctggaagtccaaaagcaaggtatcagcagggccacgctctctttgatgctgtagcagggaatccttccttgcctcttcctagcttccggaggttgccagcagtccttggcattcctgggcttataactgcatccgtctaatttctgcctccatcttcatgtagctggcttccttctgtgtgtctctgtatcctgtatctctgtgtctccaaatctccctctccatataaagacaccagtttttataaggtgggttaagggtccactctaattcagtatggcctcttttttttgagatggaatatcgctcttgtttcccaggcttggagtgcaatggcatgagctcagctcactgcaacctccgccttccaggttcaagtgattctcctgcctcagcctcctgagtagctgggattacaggcacgtgccactatgcccagctaatttgtttttgtatttttattagagacggggtttcactatgttggccaggctggctcgaactcctgacctcaggcaatccacccacctcggcctcccaaagtgctgggattacaggaatgagataccatggctggcctcttcttagtttgattacatttgcagggatcctgtttccaaataagatcacattcacaggttcagggtagacatgagttttggtgggatactattcaacccagtacaccgtctcaccttatgattgctgtctgtatcccactttcttactgtctctcctcttttggtgtctctctgtcccttccccctttaacatcatgcccaccccaccatgccaggacaacagccgccgggtagacaatgtgctaaagctgtggatcatagaggcccgggagctgccccccaagaagcggtactactgtgagctctgcctggatgacatgctgtatgcacgcaccacctccaagccccgctctgcctctggggacaccgtcttctggggcgagcacttcgagtttaacaacctgccggctgtccgtgccctgcggctgcatctgtaccgtgactcagacaaaaagcgcaagaaggacaaggcaggctatgtcggcctggtgactgtgccagtggccaccctggctgggcgccacttcacagagcagtggtaccctgtaaccctgccaacaggcagtgggggatctgggggcatgggttcgggagggggagggggctcggggggtggctcagggggcaagggcaaaggaggttgcccggctgtgcggctgaaagcacgttaccagacaatgagcatcttgcccatggagctatataaagagtttgcagagtatgtcaccaaccattatcggatgctgtgtgcagtcttggagcccgccctgaatgtcaaaggcaaggaggaggttgccagtgcactagttcacatcctgcagagtacaggcaaggccaaggtgagtgttgtgccctcagggaaaggtgacttgggaatgggcacttgcttgggggttagtgaggacagggcaaattcacgagattgggttgtgcagaggctgacacttggattttcctgggcctcaggacttcctttcagacatggccatgtctgaggtagaccggttcatggaacgggagcacctcatattccgcgagaacacgcttgccactaaagccatagaagagtatatgagactgattggtcagaaatacctcaaggatgccattggtatggcccacactcaggccctcttcttcccaaacctgccagatgtccaccccagaccccaagtccacccttccacagcttgatacttcctaacccagagtcctaggactccagcctccaacacctgattctgaaatttccccaaccctggccacccccttccctgcccttggaaagtgtgaccacaccctcttgtgcccccaccccccaggagaattcatccgtgctctgtatgaatctgaggaaaactgcgaggtagaccctatcaagtgcacagcatccagtttggcagagcaccaggccaacctgcgaatgtgctgtgagttggccctgtgcaaggtggtcaactcccactggtgagactgggaacgctgggctggggggccagggtcgggggaattatgtgttcatctgttcatctatctgtccatcctcaaagaggactgagcaccatttatgggcaaagcattgttctaggcgctatagagcaaacaggtgaaagaggcctggtccctgccctcagagggcctccaccagaatggggacaaattagaagaaaaaaaaaaaaagccacagagccataatggtgtgtaagtgctgagtaagggtccccccaacctctgtgtgacataaggtcagagagaaggcagagctttgagataagtggggaagaggtgcccccttgggtaggctttgaagactggtttaggttctgatatatggacatagttggcaagaaagacatttcagaagaaggctgtgagaaaggcacatgtgtgatggtgaaaaggcccaggagttttcaggggacattaaagtaggttagtagcaattacatcaggtttagtggagcatgtgcctcataatggggagtggcgggagagatgtctgggcaggaagattagctttagaaactggaaggcctcaaggagtctgaggtcattggtaggccttgggatgccattaaaggtgtcagaaatattgtgatttagaagattaatccataggctgggcacggtggctcacacctgtaataccagcactttgggaggctgaggcgggcagaccacctgaggtcaggagtttgagaccaggctgaccaacatggagaaaccctgtctctactaaaaatacaaaattagccagatgtggtggcacatgcctgtaatcccagctattcgggaggctaaggcaggagaatcacttgaatctgggaggtggaggttgtagtgagccgagatcacacgattgcactctagcctgggcaacaagagtgaaactccatctcaaaaaaaaaaaattaatccataagtagagtgtatgtagtagagtagagggatgtatgttgggggatgactggaatagagccagctgggggctcggaggcatgaaagtcagatcctgaatcagaacagtgacagaagttaggaaggagctactggaaggaccctctcgggaaaggatcagtaggaattgtcagcttattggaaaggagggagcatgtctgtggggagtcacggatgactcaagaggccatgaggctggtggttgggagaccggtggcctcattgacaaccaggaaagtcaggaggaggagccagttggaggtgtgggggcgatggtgagctctgctttacaccagccgagtttaaggtgtcagtgggacattgaagtggaactgggaggtgcggggagtgagctctgagccattccagggactggggatcatgcctggggcacctccatccccatttccctggaatccagaagagttggggggtccgagctccctgtacctcaagtgaccctccatctctctcccatctctgtctctccctggtgtctgtttttcttctcctcctctccttgtctctctcccacacccctccatctctctcccacgtgtctctcccctcaccttctctccccctccatttctctctccctaatctgtctgttccctctgccatggcccccttcttcaagcagcctcccatcttgctcctgcggtccctccttccctgtctctctcacccctgtttccacaccctcacctcctaccacccccctcagcatgttccctggaagctgagggtctctggggctcagtcccggtctctctctttctctctctctctctctgtctccccgacccttccccccagcgtgttcccgagggagctgaaggaggtgtttgcttcgtggcggctgcgctgcgcagagcgaggccgggaggacatcgcagacaggcttatcagcgcctcactcttcctgcgcttcctctgcccagcgattatgtcgcccagtctctttgggcttatgcaggagtacccagatgagcagacctcacgaaccctcaccctcattgccaaggtcatccagaacctggccaacttttccaagtgagggaagcttcaggagtgggcagggcagggagtggcagggcagggagtggcagggctgggggtcggcaagaagggtctcctgagtccccagagatcctgagatggggaggctatgataccttgtgtgtgtgtgtatgtgtgtgtatgtgtgtgtgtgtgtgtgtgtgtgtgtatgtgacctttatcttctgcattcttggctaggtttacctcaaaggaggactttctgggcttcatgaatgagtttctggagctggaatggggttccatgcagcagtttttgtatgagatctccaatctggacacgctaaccaacagcagtagctttgagggttacatcgacttgggccgagagctctccacactgcatgccctactctgggaggtgctgccccagctcagcaaggtcagcagatcccctctttgccctatccccagatggctccagaggttcctggagcctgagaaactaccctttgaagattttttttctccccttgtttctcgaggtgtcaccactactatcccaactcaggccccctccacctgcaccctcagaggccctcttagagctgggcactgagcccccaggtaacagcctcacccttccaggaagccctcctgaagctgggtccactgccccggctcctcaacgacatcagcacagctctgaggaaccccaacatccaaaggcagccaagccgccagagtgagcggccccggcctcagcctgtggtactgcgggggccatcggctgagatgcagggctacatgatgcgggacctcaacaggtgagcaccctgggacagccaggcctgtgccctaggagcccttctcctattctagatactcctcactgggccccacatgcatctctctagggcttgaaagaagggaggaaaaagcaccaagttctcaggggagacgataaggagacaggtacagtcagtggtaggctgagagccctttacagcctgagggagtgagagatttggagctctaggaatagggctgaggctccaccaactcacggcttagttgtaagcctagagcatccctgctgcaagctctgatttgctgtccctctgcctgcccatgctagtccccaggctgaggttcagccagcatgtcatgtcagccatgtgtcaaaatgttcaaacatctcagtaatagctagtgaataagcacttcccccagcccccgaccacaaccccacagacctccccatgatccagcacttagagcagtgacagcagaagcctagcagggcctgcagcctgctccagagtcccagcctccattctgataggtggtgcccgtgcttcatttgctgctcattattttgatgatggccctgctttttcctctgcccgtgtcttcctccatgacaccatacccatcccaccattcccgcctctcctttcatttgtccacatctctctccttctctgtctgtgctcgcccctctttccatctctctccagctccatcgaccttcagtccttcatggctcgaggcctcaacaggtgaggggctctcccctcccccgccctcctctcctctcctgtctgttccctctcccactccactggccttcgccctactcctctcctctcctcctccatggacctcatctcctccatatgtgcccagccctgcccccatcccttctcttgctgcccccatctcccctcctctaggcctcacccccttcccggaggggccctgtcctttccctttactcacctgtcccctcccatcctccctgcctgccctcttcagggctgccaccgctagctctcagcccttccctctgggtcccacttttcaccccaaggcctgtgccagaccacagcaaggttcaattgctaggagccctgaccttaccttctgcttgtgtgcccccttcccttctgacagctctatggacatggctcgcctcccctccccaaccaaggaaaagccacccccaccaccgcctggtggtggtaaagacctgttctatgtaagccgtccacccctggcccgttcctcaccagcatactgcacgagcagctcggacatcacagagccagagcagaagatgctgagtgtcaacaagagtgtgtccatgctggacttacagggtgatgggcctggtggccgcctcaacagcagcagtgtttcgaacctggcggccgtaggggacctgctgcactcaagccaggcctcgctgacagcagccttggggctacggcctgcgcctgccggacgcctctcccaggggagtggctcatccatcacggcggctggcatgcgcctcagccagatgggtgtcaccacagacggtgtccctgcccagcaactgcgaatccccctctccttccagaaccctctcttccacatggctgctgatgggccaggtcccccaggcggccatggagggggcggtggccatggcccaccttcctcccatcaccaccaccaccaccatcaccaccaccgaggtggagagccccctggggacacctttgccccattccatggctatagcaagagtgaggacctctcttccggggtccccaagccccctgctgcctccatccttcatagccacagctacagtgatgagtttggaccctctggcactgacttcacccgtcggcagctttcactccaggacaacctgcagcacatgctgtcccctccccagatcaccattggtccccagaggccagccccctcagggcctggaggtgggagcggtgggggcagcggtgggggtggcgggggccagccgcctccattgcagaggggcaagtctcagcagttgacagtcagcgcagcccagaaaccccggccatccagcgggaatctattgcagtccccagagccaagttatggccccgcccgtccacggcaacagagcctcagcaaggagggcagcattgggggcagcgggggcagcggtggcggagggggtggggggctgaagccctccatcaccaagcaggtaggtgaaggcaggaggaaggcgggctgggtcacaacagggagggaagaaggagatggggggtggggttgaaacagagtctgtggcctgaagttacaatcttcttgcctccttttggccattaaacaaatgtgtatagagggcctgctatgtgccatgtgctatgccaggcactaaggatacggcactgaaccctcttagcactctcattccagaggggattaatccataagtagaatgggggtgactggaatagggccagctgggggcttggaggcatgaagatcagatcctgaatcagaacaacaggagaaattctctggcattcaactcacatctctggcattcagaggtgataaaggctacagcagggcaataggactgggactgtcgtctcctttggctgtgctgttgccctctaaatgtaccctgctttttcccaccttttctttctctgttcgccctcactgtgccttgtcccagcattctcagacaccatccacattgaaccccacaatgccagcctctgagcggacagtggcctgggtctccaacatgcctcacctgtcggctgacatcgagagtgcccacatcgagcgggaagagtacaagctcaaggagtactcaaaatcgatggatgagagccggctggatagggtacgatgggctctaccagctccaagccccagtgtttccttttacccacaggggagatctctagtcacttccaagggaaacctccagggtcagttatggtggtaagaaaaggcaaagacctgatcacctcttgagaagccttccgtccatctggggagaccagatacacacagttgttaaaagtcactttcaactctattttgtaggttatatatatcatagactatctggggatcatctattttaggcttacctccatgttcttccccaggaggaacataagccctggctcctgtgactgcttaggaaaggaaatgttactttactggcagtaggagctaataaattggatggggatggagggggttgcagctatattacaagtgatgtctggcctacccagtcactgtcccatgggcataagtgacagtcagtgggcagggaatgcatgtggtaaagtagtatgtatcagtcatgtgtgaaaagaccatccagaccctcacttggtggaggctgagggcaaagggcaccaagagctctggggctaacacagataacttagcagaaagttacttgaggaagctgttgttcctagggcctgaggaagagggcggctgcaggattaggtcatatataaagaacatatgatcctaacacggggaagtggtctttgagcataggaaatgttgggactgactcagatgggcttgaccagcaaatttaatgagaattaaaccctaatattagccccaaggcagccaccgtaggaagttaattcacatctctcctctgcatgtagaagggttggtgatatatgtatgtatcctcttcagagaatgaggaaatagtcttttgaatcatttttttttctgtgcttcagatgaggaaaccttgttgagaaaggctgtagactagcactatccaatataactttctgcagtgatgaaatgttctgtaatctgtagtgttcacatgtgtctagttgtgattcaggaactgaatttttagatctatttaattttaattttgtaatttttttgagacagggtcttgctctgtcacccaggctggagtgcagtggtgcaaacatggctcgaggcaacctccgcctcctgggctcaagacatcctcccacctcagccccctgagtagctaggactacagggtcgtgctaccatgcctggctagttttttttcttttcttttttttttttttttttttttgtagagacggggttttgccatgttgcccaggctggtctagaacttgtgagctcaagtgatctacctgcctcagccttccaaagtgctgggattacaggtgttgagccactgtgcctggcctaaattttaaatagctacatgtgggctggtggctaccatattagacagcacagctgtagactctagagccaatagggcagataaaatgactcttctgagctcttccagctctggaattcctagattctcagcctagaattcacttgtagacctcctatccttggcaccttgacagagccaaggagagggtcacatggaggacagcacctgcctttcccccgtcaattgccttttcttcctatgtctccagcatgtgttctggggcctggcttagggctgaagagtcaccctatttttaatttctgagcacagttactcaaggtgtgtttgtgagtgtaggtttctgtgtgggtcttcatgaggggccatacatagacctcagggtgtgggagtctgtgaccttgctccattttgagggaacctcagcaccatggcagggtcttctcaaaagcaggtgtgtggatatgatccacaggcagggaaggggttggggaaggcagctggatgtccctcaacatgcagtggctgtgcttggcagacagggatggaggctgggtggtgggcttggggtggggcgcccctcatagtgcggggtcgtgtgcccggcgggcaggtgaaggagtacgaggaggagattcactcactgaaagagcggctgcacatgtccaaccggaagctggaagagtatgagcggaggctgctgtcccaggaagaacaaaccagcaaaatcctgatgcagtatcaggcccgactggagcagagtgagaagaggctaaggcagcagcaggcagagaaggattcccagatcaagagcatcattggcaggtgaggggcggcctggggagggggttgtgagggagagcctgaggctggagagagcaagtgggtgagctactccgctgactcccatccccaaactcaggagcccaccaggagagcccaccactctcctccccaggaagccacccactcactcatcaccagatggagagaaaccccaacctgcttagtgcattaaatatctctttaccaaaccctgacctctcttctgatagagtagcttcggaagcccttggaaaatgtacctgttcctgtccaaccatcactgcatttgcatttaccctaggccagagctccccactagttattctcaacttaacctgtgatgttcactccaaacctaagcagggctccctagccagagtaggccctgcccttcctgggtggaccctccctctctagccttggaaaggtgttctgttagaaagggtcttttagcctgtgtatgttttcagctgctccagcaagtcctgggctccaaagagggtatcctcagcaaagaggtcaattatcttcagagtggtggggtcggggtgggggggaccctgggcgcactccaaccagagccacctccattttgatccattctaaatgtattttatgtaagatttaattagaagaaaagggcttcttgaaatattttttgaaaaccactgctctaattgatatcctttatgataaatcacctcgaggatcttcacagtgaggtgacatgggggatgcagaagccaggtcctcagccatggaaggtctggggaaggggcactgctgtcctgattgggacgatggaggcctggaggtgtctggatggtagaagtctttgaggcacagaaagctgccttagcagggaggtgtaagggttcctgggaggaaggtggagagcatgatcctgaggaacagggagtcttgcatcacggcaatggagggactctgattctaagggataaggatgcctgaggtttttccagagagctatggggttccatgggcaggctctgagcctgtgcccgccactaaccccactgaagcccgtcccttcaggctgatgctggtggaggaggagctgcgccgggaccaccccgccatggctgagccgctgccagaacccaagaagaggctgctcgacgctcaggtggaaattacaatgtcatttatcttctccgtgtcccatccccatccatcccactgtctttcgtgcactcactacaccagccacctagccccatcaccatctgtctctcatagtctgctgtttgtccactggctgctcctggcagccccctagtgaccccatcttcatcccatcgtctgtgcctttgtcactcctggcagcgtcagcccaactcctgtgccttcccatccagtcttcccactcctctctgcatctcaggaccttctctaccagaaccttggtctttctgcccctagaccccacctagttccaagaacccctgccccttctttgctcactcctattcaagccacgttgttcagcttcctctgcgctcttgggccagagggctagaagctgccgttttctggaatagagcacagggcagtatgatctgtagtttctccaggccctggccggtaccctgaaaacttggggacccatcacctctgttctcttggctccctaattttcctgtctccttggcagctcctgcatagcttcctcttcctgactcttcagatcttgaaggccttccatcctgtaacctccctttgccctcagtatttaagtccagcctccctctggcctccctcccactctggccctcagaccttcccagctgcctgctgcccagcctctcttctcacaagccagcttctaggacctcccttctgcacccttaccccttgctttcccaaaattctgctcattttcctacccatactcctctttgctctgactgctaggctccccccgcctgccatccccccaccaaggctcctgaccccatgaccccactctctcccactgcagctcctcatcaggtaattctcctggttccgctttggccacgggcggaggacacagggggaggtgactccggaccactgcaggttggtcgtgaagcccactccctccaacacctccggagcctctcccctctcactgctgccctccacacccagagaacctccacagactccagccctccgacacctgcacagatccatctcccaagacaccacccaaagagagcatttgctgctgcttcccagaactgtccaacaataccttagcaacaccaagagttgggccctagatgggcccagcacattcacaggtcacacccacttccctgcaaaacccaccccctcccagcctcctcctgactctaagccctcctcttcctctacctctccagtgtatgtctgtcaccccccatttcaccagagcgtccttaggggctgggggtgggtttgttaatggggtggaggcaatgatgggttggaggatcttggctataggggctgtgctgactgcagcaggtaggttgggtttccctcttccttccctaatcttggttctctaccctcctttccactcctcacctgattctctctcttcctcctccttatatctgtgaggcagaaggcatctgaagctcatattagcccccattgggtgggaattaggagtgggtagttaactcagggagacttgagataccctggaaaaaatgctattgagatgtcctgacattaggcagggtggatggaacaagaaggagcaagaaaggaacctcaggcagatgttaggacatggacttgatcatgtggcctgggagtttagaaatggggagagacatcctcctagatcagatcgtgggctcagtaggcatgttgattcccagggagaggtgccaggaacagcatggtaaagaatgtactcttcacagctcacatccccaggttgctgatgccactcactccccctctcctgccatcgagtggccttgccggacacatcaccctacctaaaaagccagtaaatgagaacctgtcagctatagccatcatttctgagatgcgattttctttgggattgagctgcagtgggcagtggctccttacactgtaattttaattctctgcctgcccagcctctctgtcaaagtagctggtgatctataaagatgctaaaaggcaccaggggactttgccatttaaaggactcctgcagtgaattcttttgtaaaatgaataatggcaccctaatttatccactttctaaatttgggtccatgggggtgtccagggcatgcttatgtgctgtcaccagcagacaaacagagggaatggaatctgggggttccttccctgctctcccgccatactcaggataccctaccataagtgatttcctctcactgacttgcagaaaatgtgtgagatacccagcaagctaagaaggcagttttgctgggtatctcatacccaaggctggggtttgggtgatctgagaggttagctccttgatcctaggatggaagggagagcttatatagaagcttttacttggaaggttttgtatcctaaggtcagacatagctatattaccaagcctaaatgccatgtggcccaggaaataatttggacatttgttctaaaccacttgtggtaggtattggtctctctgcaactcagccattaattagaaattagttttgagcctgaattttaaaaagccaagtgttgcccccagcccacacacacacacacggacatgtacagtacaaaccccagataattacaacagccaaagagagaaggaagtgaatttcccaaccagaagcgtagggaaattcagatggctttcttttctcccagcagaggaacagaaggcggagctaagggcaggaaccaggagttggtcaaggagctataggaggtgatgagagtagaaccaggggtaggagctggtctggtacccctcaccctctaattgggagcccagggagaaggactgaaaagaagatgggagtggaaaagaataaagccagtttctgcttcccagggatgcagagattggggcatgctgtgtctgcagaagctcctagtcatttccgccataattgtgagagagaggggcagccctcccacaagatttttcccttcccatatcacttccctgaatccccttcctttccccccagtacagttaaacctctctctaatttggaatgttatatttgagaagatggccactgtgaataagtgacaaacggaatgacagtgtctatttaatgaaatgcatgtcttcaaaatatatacagaactcgatgaacaaggctttttccactcctcagggagcatgcattaatgaatagataggattcaaaagtctgttttctggtatgggttaaatatcccctcctacagacatatttccaccactaatttgcttagtacaccttttcttcacagataaaggaaaatgcaagctcagtttttcttcagattatgaagaaattccaaatccacaggggtttggattaatgaggttttgctgtactgcctccccttattcctcaacatgaagttcccacctcggattggggatgggtgggagggggtttcaagaggaggagggtgggatgggcaaggaatatacacaggtgaagccagagaagggttaggttgggggtgcggtgggaacttgctgttttgatctggtttcctggtgtgacactctgggttaaaggcttgaaggcccctgttaggagtctaggggtgagattctcttctctctgatcccagaggacgttaacttctactgcaggtgagaaacaaaataggaggatggtggggactgtcctgggaggagggggtggtccatggcttgtggtgtgggctggctataggggaggccactgctaggggactggcatccaggcccccttgaagcgtctcaataagtccgcgctctcctttttggtgtcttgcaggagaggcagcttccccccttgggtccaacaaacccgcgtgtgacgctggccccaccgtggaatggcctggcccccccagccccaccacccccaccccggctgcagattacggagaacggcgagttccgaaacaccgcagaccactagcccacccagcatcagagaccttctcttcctttcctgtgcaccccaccctgtaacagcaccaaccaccaggattggacatcaccgaggaacagcgggattgcctccccgaatgcctccctgggaggcacactgattgcccacccccaccactgcaccatttccaggagggagagtggggaccctcagccgcccccttttccttcccattggggtgctgccctctctttgacccccagggacccttgccccaggacaccgcctaccccgtacagaccccttcactccggggtgctatccccatcctctgcctcatcgttcccctgagcactgggggacagaccctcacccccaccctgggggtgtggcacctccaaactttcaacttcagggtgatttttttagcagtaaccagagctgacaatctaactcccctccaccgccccattttggcctcccctgccccccttgttatggggaggggaccccgggtgagggggccctattaccccttgatttctcaggagcgtctgggggggctcagcacgcacaaactccttctccttctaccactcttaaatttactccctccccacccagaacccagatggggtggagggggccaccggggcagggagggggcggcaaggggggaatgggagttgtctccccttctccccacacctgatctgctctcggctggtcccagagcggggtgagggggcttatgcccccccctcccccagtgtgttgggtggggtggaattgaggttagggtgaggggtcagggtttaggagggtgtgtatgttgggaggacaggctagttgatctgtcctactctgacacacagtcccctctgccccttccttctctcttcttggtctctactcccagggggaggggggaacttactctaggaaaagccatgtctctctcccccagggtggggggacctgtgttggaggaggggtgttggggggcccccttccatgactctgtcccctgggggaggtaggacagggctgggcttccctctcatcctccccctcccaatctccttccacctccctccctcccgccagctccacgatttttcggtgtttctctgtacatagttttctggcgggataggggaggtaggatggatggggtttggggtgggtaggccatgggaggggagaagcccctccttggcaccccctcttccctgactgctgtcccctacccagccttgcccccttcatccttttgcgtttggtattgagactctcctagactctactcctctttcttttgtatggacagttccccttcagtcccatccccctacacatacacccagccggggccaaatttatacttatataaaagttgtaaatatgtgaaattttatccctgtgccctttccccacctcaggccctacccctggaccctccccaaccttccttctctcttctttggctgttgtaattatctggggtttgtactgtacatatccggggtgtgtgtgtgtgggctgggggcaacccttctgtacagagcttcctggccccctccccccccgcccctctgcttccctccccacccaccacctcaagggtagggagttgctcttcctacctgttttattttgttttctcgttctccctccccaccccactcccagccttatctatcccccctcactgtccccttttctccactcccagccccatttcctttttttctggagtgtgtggtgaaacagaaaaaaacatgtttaataaacggagattgttcttttatcgctgtgccgactttcttaggcagggctctccagacctgtacggtggtaagatctgctttctgaaaggaagctgacagcctgagaggaaaaccgtatatccccacctgatgccacactctcctcatagaatgtcactctcccctcccaatgagattttttatattttagagcaggagttttgcaccggccaaacttctccaatctaactctcccctcaccactgtgtcacttagtccgaggccaggaacagcggcgttatctgataaaagagttcatgtatatatccacatttatctcttttaaaaattacctagaaataaggtttctttaattgctggttaaaatgctcccgtgcagaaaacaggaaagaacctgcctggttccttagcaaatctgagttccagtcccaggtccactactattagctgagtgacgcttccagcccgtttcccccgcctggaaactgaggacggcaacccccaccctcgcagggccggtgggaagacacaaagtgatgtgggcaagtgccaggcccacatggtaagtacccaactaatctcgcccctctcaggacctaccgggggcgggtgctacacttaatcaccgggaaacgcagctttccggggcggctgacggcccaccccctccgaccgggctgttctctcccgggccctgcctctcggtcctctgcagcggggaggacttcagcagctccccgggacgcccgttgcgaggacaccctgggcctgtgccctcctactagcaccgccctcctcgtctgcagtagccaatcaacacgaggcttgtaggctgccgttcctcgattggctacggctctagctccgcccgccgcacttggcgacggtgtccggcggggaggcggcggcttccggtctgggacggagctgtagcggcactgtaactgcgagggcagcgccgcgtgtgtaacggcgggggcgtgtcggcgggaaggacaatcgggccgggactcgcggtgtccgggtgaccgcggcttcccgggagcagacctctgtgggcactgtgaggcggaacggagcggcggggcaggagctgttctgggcaggtgaaggcaggctggtggctgaaggacctccttcttatcttccacaggggctggaagttaaaacccctgttggtgtttagtggtggtggttgttgttgttgtttgtttttgctttcttggtgtgcgggactgatttgcagaaaccgccactgacttaaaagtttccagttattgctcgtggggagggggttgtttgagaagatgtggctccctttatccagggcttctgtgacctccatctttttcctctgcagccttcatcccgcgtggagtctacccccaagcccttctcctcttcccaattcttgtcaccttcgaggaggccatggaaaccccaacacctttgccgcctgtacccgcctccccgacctgcaacccagccccacggacaatccagatcgagttcccacagcatagctcgtctctgctggaatctctgaaccgccacaggctagagggaaagttctgtgatgtgtccctcctggtgcagggccgggaacttagggctcataaagcagtgttagctgctgcctctccttacttccatgacaagctgcttctgggggatgcgcctcgtctcactctaccgagtgtcattgaagccgatgccttcgaggggctgctccagctcatttattcagggcgtctccgcctgccactggatgctcttcctgctcatctccttgtggccagtggccttcaaatgtggcaggtagtagatcagtgctcagaaattcttagagaattagaaacttcaggtggtggaatttcagcccgtggaggaaactcctaccatgcccttctttccactacatcctctacaggaggctggtgcattcgctcttcgcctttccagaccccagtacagtcctctgcttctactgaaagccctgcttccactgagagccctgtgggaggggagggaagtgaactgggagaagtgctgcaaattcaggtggaagaagaagaggaggaggaggaagatgatgatgatgaggaccaggggtcagccacactctctcagactcctcagccccagagagtatcaggggtttttccccgtcctcatggaccccacccactgcccatgactgctactccccgaaagcttccagagggtgagagtgcaccacttgagcttcctgcccctcctgcactgccccccaaaatcttctacattaagcaggaacccttcgagcctaaggaggagatatcaggaagcggaactcagcctggaggagcaaaggaggaaaccaaagtgttttctggaggggacactgaagggaatggggagctagggttcttgttgccttcagggccagggccaacatctgggggagggggtccatcctggaaaccagtggatcttcatgggaatgaaatcctgtcagggggtggaggacctgggggagcaggccaggccgtgcatgggcctgtgaagctaggggggacaccccctgcagatggaaaacgctttggttgcctgtgtgggaagcggtttgcagtgaagccaaagcgtgaccggcacatcatgctgaccttcagccttcggccttttggctgtggcatctgcaacaagcgcttcaagctgaagcaccatctgacagagcacatgaagacccatgctggagccctgcatgcctgtccccactgtggccgtcggttccgagtccatgcctgttttctccgccaccgggacctatgcaagggccagggctgggccactgcccactggacttacaagtgactgctgaggctatacactagcttctagaacaagataaccactgctgctgatggatacttttccctcactgccatggcacaccagtcatggatcttgtaatcatgccaagagaatagatacattatggacctcttgttcttagatatgggcctctcagcctggcagatgtggaaactcaaatttctcgtcccactccaggttttggctagccaaccctgcaggaaagtggtttataggccattcatacttaagttgatcacttgcccatggtggacatttttgtggtggtgatgtccattaaggaaaccagattttcaattatttagtgagagaagagttagagcaaaagacagtggtaaatgttttattccgtctccatgaggaattgaaggagttggtctccacctagagatacatttgatttacagcttaagtaattcagaggctaagctctaagcttttttctctcattgctggaatgatttaagcagaagtccttttgtgtacttttaaaattgtatctttccaggagcccctcagattgtaccttgctttctcaccaatagacaccttcccgacacttttttaatgttgtagctgagcactttaacaagttgagcattccatgtttcattcttagaaccttctttaatagagggtcttccctcaacagcctgtgcctctggtctacctttgaccaccactgataactaatatattggtcacaatgactggaatgtgactagtgatctcaggagatggcactgtcctaaagtgctgtcagggtggcaccactgctctctgaacaacttaccttggtcagagggactcaggtttgggacagcacaagctgaaggctggagagtaacttgcatagtaggaccatacctcttcctttcccatcccacccacatatgatagacagcccctctgttgagatatggaggggacagatactggaatcgggggtgggacttgcagttacttaaaattttttaataaactgtgccctgaaacct

SEQ ID NO: 212 - DNA, 336 bp, Homo sapiens
  source 1..336: mol_type = other DNA
gttttatctaccttttgtctttgatggggttttggtgtggatgtcctttttgttgatgttgatgctattcctttctgtttgtgtgttttccttccaacagtcagacccctcagctgcaggtgtgttggagtttgctggaggtccactccagaccctgttttcttgagtatcaccagcagaggctgcagaaccacaaatattgctgcctgatccttcctctggaagcttcgtcccaggtggggcacccaccacctgtttgaggtgtttgtcggccgctactgggaggtctttcccagtcaggctacatgggtgtcagggacccacttgaggaggcag

SEQ ID NO: 213 - DNA, 265 bp, Homo sapiens
  source 1..265: mol_type = other DNA
tttcagtgtttctctatcatttcttcttggtgaaataattttttgttcatgtttctaccaaacgatctaacttcctatgtcacctttttttaacctacaggccacttattatctgtcccttcctgccttctccagctgtggcatccatcttggtaactgtgtcaggttggactgcaaaggatttattatttctgttctggctctagtttttcatgctatcttgtgacaatttcctttgacaataagccacttcctgtatgtctca

SEQ ID NO: 214 - DNA, 361 bp, Homo sapiens
  source 1..361: mol_type = other DNA
ttttggactgcaggcattaaacatcctggtgctctccctaggcagataggaggataatgatacccaatggaaatatttatcatcatcccttcttcctcaggtttggcagggcaatgatcatctgtggggccaggtacccatacactatcattaacatatacttcaataggattatccatccatgtgactggtgtttccatctccgcggtggcgcttttctttgcatctccgatgggttcatcgtagatcttcaaatgtctagtgggtatccaaacaggaagctgattttctcctggtgaaacacaagcaaaacctctcccccacgtcaccaccttccctatttcccatgtcttatttttat

SEQ ID NO: 215 - DNA, 377 bp, Homo sapiens
  source 1..377: mol_type = other DNA
ctgactcagcctcccaaagtgctgggattacaggcatgagccactgcacctggcctgcaaagccttatttctttttctttttttttctttcgagacacagtttagacggagtttcgctcctgcccaggctggagtgcaatggcgcgatcttggctctttgcaacttttgcctcccaggttcaagtgattctcctgcctcagcctcccaagtagctgggattacaggcgcacaccaccatgcccggccaatttttgtaaagccttatttttaagagaagtgagtactcagttatttgtagcattattctttagctcttgtttttttttttttttttttcaagaccgagccttgttctgttaccaggctggagtgcagt

SEQ ID NO: 216 - DNA, 322 bp, Homo sapiens
  source 1..322: mol_type = other DNA
agaaaaaaaatcctgttttcatagagtgaagagggaagatgtctagaaggaatgactttttatgttaatgaaattctttccaaccttgttttggctataggaataaagatggcatatagcataccagagattcattccaactagcattccaactctgacagtgacaccaagaatgttttcctgggactgcctggtgcttgttctccctggcattgtcttcaggtcagggatttttcttttttctttctttcttttttttaaattaaaaatagagatggggtttcgccatgttgcccaggcttgtctcaaactcctgagctca

SEQ ID NO: 217 - DNA, 375 bp, Homo sapiens
  source 1..375: mol_type = other DNA
atccgtcaaacaccgacttcgcatgaggctcccgcagcccctgctctcgctgcgtagtggcgtctgtcgcacggtgggttctgctgcgctctggttccagctctgtcccgggtctggctcgcgcccgctgtcacggccacgcagcccccgccgcctggtggctcctgctcacgctcgcttccgaagctccgtggcttctctctcgcgcggcttctcctcactccggcgggtgactccggctttgctgaggctcctcctggttcctgacgacgctggtttgtgttgcttctcggctcgtgctgcctcgtgctcccctctgctctggctcctaggccacggctcttgccggagtcctcctgtccctgctccctgttc

SEQ ID NO: 218 - DNA, 304 bp, Homo sapiens
  source 1..304: mol_type = other DNA
gtagtatggttgcccagtcaaccccataaatatatggctgtgttcttaaagaaatgagactggcagaaatctcataccctcgttctaatgttccctgtaggtgcttcttttaaaacacggttggtagctctgttagcaaacgaccccaccagcaagcccaagtcagtaggaagaagcctgccaattgtgtcattatatttttccgtaagtaattcaagtttgtggaagaaacaagacacttttggtatgttgcaaagggcagccaaagaatgaaaactctgtggccgagcaaacatattacatt

SEQ ID NO: 219 - DNA, 306 bp, Homo sapiens
  source 1..306: mol_type = other DNA
taataaaaacttggggtttcattttaggtgaggtttttgtatttgggtttgtttttctacagtagagtttaatccatgtgttgcttttcttcaagtatagtttaaaggagtacatttggaacgtgtttttggaaaaagcatgttaatgtagcagaagagacttcagtgcacactttcgaagaaaaacagtttctgagcattaagtggtaaaaggcaataataattcaaatgatgataacaagccaacctgctaaaaagaatgcatgttctgtgtatccagccatttcacatgaactaaccccattt

SEQ ID NO: 220 - DNA, 308 bp, Homo sapiens
  source 1..308: mol_type = other DNA
atttcagaatggcctcaatgccttaataggaagaaatacttgaaatttttaaattagggcttggttttgtgaggagctagtaaaggtttttctctttcagctttagcttgtttctgcggaggattccgctctttctccatcagtttcatagccctggaattgtagaaaagctctggtttcaagaccattgatatccatttctgtcagggtgagttttaaatttatttcatgatgcaaacaatatattgaacaacaggacatgaacttgttcttgttgtaagtggctgaattttatcagtaaagcacat

SEQ ID NO: 221 - DNA, 240 bp, Homo sapiens
  source 1..240: mol_type = other DNA
aaatttggtataaaacggtcataccttaggtttaaaagccttaaaactaacaaatagcctaattatgtaagtgaatgattatgcacctcaatccctctaggataactaaatatggagaagagttcattgagacttggaaggtatgaatccttttaattagtttattctcccaaatcctaaaaagaaatcatattgcagagcatgtaatcattttaatgaacatgaaatatataatccaag

SEQ ID NO: 222 - DNA, 238 bp, Homo sapiens
  source 1..238: mol_type = other DNA
agttgttgctttttttcttttaactcagcctctcaacctaccagaataatgaagttatgctgtgagtaataacaccttgtgtttttatattgttcgttagccaccttgtaagggatggattgtgatcccatattacaggtaaggagacttcaacctagagaaattaaatgatttgattccagtcacataagtgcatgctggagtcagggactagagcctatgtctttacactctcagt

SEQ ID NO: 223 - DNA, 280 bp, Homo sapiens
  source 1..280: mol_type = other DNA
caggaaaaaatctctacgatagagatggagagatggaggcaagtgctgaaagtaaatcacacactaacaacttttggctggcactatctttattatgtagaaaccctaaggtgttcagaaaatatcagaatcatggaggacagaaatacggtctaagactggaggagagggaaacataaggttagtcgttggttactatggtatttttagcttttgttttggtgatagttcatggagcttactatattattgaatttagctaattagataattcaatgaa

SEQ ID NO: 224 - DNA, 304 bp, Homo sapiens
  source 1..304: mol_type = other DNA
tgggttcaaagagggtccaactttataacatttatgctatatatttttattaactgttgaatgtttgactttgatattctttttctttttatatttaaaagggttggtatttctttattacaaagaactgcaaaagaggatatcgccttaccttacaaaataagatttaggtttgatttacaagcaccaccaaaaaacatttctgtaagtgaatattttataatagcaatagattcccaggagaaattgttgaaaccatctgtatatatctagaagaagatgctcatctctttgggattgttta

SEQ ID NO: 225 - DNA, 305 bp, Homo sapiens
  source 1..305: mol_type = other DNA
tagatttcagggagtgggaaggggaagagcggagaaaaacgtggtctgtttagggaggagtccaggccctgttttgttaggttgtcctgtttctccccagcctggaggggatccctctctgaagactttataggatactggttgggctctggtttgggatcccgttggactcctggtgttgcttccgggaggcgtacaacaggaggtgagagacttcaagtccatctaacaattcccctatctagacactaaagataatttcctaagtttccgcagagtttggtaaggttgaaacgacatcgaac

SEQ ID NO: 226 - DNA, 296 bp, Homo sapiens
  source 1..296: mol_type = other DNA
ggtgtctagatagccttgggatacgggtcccatttttggtccattcaggtccccaccccacacaatatattatgggagagtcctttttcttgaactgtaggagttccaggaagcgctcgcccctggccgaggatatgtccttgcaaaacacgagccctcctagtgaagaggggatgtcacccaaagcctaccaccggtgtgtacatttgctttttcccattgtcccttccagttggccactctcggtcctgttaaattcaccttgcaaattagtcatcatatttgagtttccattg

SEQ ID NO: 227 - DNA, 298 bp, Homo sapiens
  source 1..298: mol_type = other DNA
agcctcccaaagtgctggacttacaggcgtgagctaccacgcccagccaattattttcttttttggggggtgggggatggagtcttgctctgtcacttaggctggagtacggtggcgcgttctcggctcactgcaacctctgcctcccgggttcacgccattctcctgcctcagcctcctgagtagctgggactacaggtatgtaccaccatgcccgactaattttttgtatttttagtagagatggggtttcaccatgttagccaggatggtcttgatctcctgacctcgtgatcca

SEQ ID NO: 228 - DNA, 428 bp, Homo sapiens
  source 1..428: mol_type = other DNA
gctggggatctgaaaaatgtttgcagacattatttcttaaatcctgaaaacatccctgtgaggtaggtgggtggtaaatattattatccccattttacagatggagaattgaggcacagagagattatgtgactcacccaaggtcacactacaagtcagtggtggagccaggaatagaacccaagactcctgactcctaatccactcccctagccactaggccctgctccctcctcaaggtttcctcttgtgtgaaattctcctttgaaatgcaatttcttgtttttaattcatggggaaagaagtacctgctctaatgcttctctaggtaaggccaccagcatattcttccagtcattttaagttttaattttttgaaataaggagccgtttatataatttattaacatatttattaaatgttttat

SEQ ID NO: 229 - DNA, 483 bp, Homo sapiens
  source 1..483: mol_type = other DNA
acgggtagccctggccacatggactgacgtcctcttgggccgggccctgtgccacctcctatccaccctgactccctctgctgcttcccccaaactccagattgggaccgagtgctgcccaggtggccccctaggacttgctgtgactgttttgcccagaggcccctcggacagtaacgccacagacctcgctggtcaccgggcagccaggctgagactggcgctgctctgcacctggtctccggaggcggtaccagggcgggtgtctacagacccccatgccctgtcccctgcacctgcagggtttcctccatggcctgcaagctgcagcggctacacagctcccgagagctcagctgcccttggagggccaggcctggctggtgggtgcccccagttgggttccccagtgtggggtgattcacatctggtgcccagggtcaagatgccctgtgcagggctcctgcccacccccgtcagtgc

SEQ ID NO: 230 - DNA, 463 bp, Homo sapiens
  source 1..463: mol_type = other DNA
atttatttagacttaggggtctgactaaagactgcgggatgagtgaggccagtctttgaaaagtggagccattacacccattcattctctgtgcccataggtccagtgctaaactgaaaccaaatcagcttcccctgcgtaggagacacaggaggcatattagatattctttcttatcctctgagaatggccagctaggaagagagcaagcagatacaactcttccataaatggagggaatggagccatgaacagaagaaaagggaatgttgctgagcatctactatgtgcctattccagaatcttcattatattcttgaaacaattgctgagatagatatgagaatccatctcacatatgaagtatgtgtctgtcagcaatggttggaaatttaatcccaactccacacataatctgttctttctacaaagtaatgcatcacctgtgtgatgaattcagcaa

SEQ ID NO: 231 - DNA, 381 bp, Homo sapiens
  source 1..381: mol_type = other DNA
ggtctcagcaatgtgcatgtctgaacaaagctgcctccttccttctctcctgcagttttcattctgagaatcatcttctttcactcatctgtccctccaggtctcactttcagagggtcctcacggtccccagcacaatgaggaccacacaaggggttcaacacacacttcttggctgattaaaaagaggaaaggcaatgatggcagccagagagaggaaagcatggatcttgtcactgatgacaagtcggctagtaggagcagcctcatagaaataaaaagtagctttctggaattaattcctttactctttttctttttgtttcacatgaaaagaaactgtttaaattaatctgcgtttttgtttttctgtaggtcact

SEQ ID NO: 232 - DNA, 278 bp, Homo sapiens
  source 1..278: mol_type = other DNA
gaggagcttgttaaaacacagctcgctgaggtcccccccagacctgatttgttaggtaaggagagggctctgagagtctttatttctaacatattcccaggtgctgccgctgctgctgctggtccagtaactactctgatttaaggagtttccactttctcactacgataagcaactggtaatgatatcttacttatacgcatccctgattatcatgaagaaatagtgtaatggataagaacagaggttctggaaataagggctgggtgtggtggctc

SEQ ID NO: 233 - DNA, 351 bp, Homo sapiens
  source 1..351: mol_type = other DNA
gtttttactatgctaatgtgcattgtgagtctgtgggcacgtggcaggcagcagttctaggtcagactttatcacagaacacttttctttgttttggtagaacatctcaccagactagggatctgccaaactttgggaaattctgcttcatgaacctggggttctagaatgctaaaatgtgaaaggacatttaagaccacctgggacaacatcatattaatgctggtgtttttaacataatatccccacaggtatttttccagttatttcttatagtcccgtgatgtataatttattaattaatgtatgtatttatttatttgagatggagtctcgctctgttgcttccaa

SEQ ID NO: 234 - DNA, 378 bp, Homo sapiens
  source 1..378: mol_type = other DNA
cacacacacgcatctgtgaaaccatcatcacactcaaaatagtgatgtagaaattttgctccttagttcgactaaatctgggttcttgtgtcatgaccaggaaaaattaggcacgtggacacgttgaagggtgaggagagcagtattgggcgaaaaggaaaaaagaaaaaaactctcagcaaagctagaggggatcctgccaatgagttcccagctcacagactgattagcaggccaccacacatgagctggaggccaggctcctcccgctgcgcaaggtgagaacttcccgtggctccaccccattctcccaatgcccaggtgggtccccgtcccttgcgggcctgtccagacaagggaaccctgggcaggttccct

SEQ ID NO: 235 - DNA, 244 bp, Homo sapiens
  source 1..244: mol_type = other DNA
aatcactgagttctcattttctctctagagagaagattctctacactttgtaccactatgttattttttaaattataaattcaattcaatcattttgtaggtttgacaggacactgaaatttcaagggacatcatgctgcatgtgtaagttctacattaattatatgcaagtgctacaataaattctactcatgttaataccgatgtaatcccacatatttgtgaagataaggaaatccaatca

SEQ ID NO: 236 - DNA, 332 bp, Homo sapiens
  source 1..332: mol_type = other DNA
ttttaacctcccaactactagttttaaaactgaatcaaatttcaaatggttgttaacttgaaacagatctgcagactcgacattttctttccattttcaggctctctggaaaccagtgtgtgtgccgtagggtatgttgcttgtagagaaaagtgagcactgaggactgaaatggctgggcaaagacaaggcacaagttcatctttgtgaagcagcgtttttcagtgttcaggtacaaatagttctcagctgtgctcagtatcacacaaggcatctggaaacatgtttaattcatgttagctatagcaactacatttgaactcaggcatgtt

SEQ ID NO: 237 - DNA, 282 bp, Homo sapiens
  source 1..282: mol_type = other DNA
tgtagagaggtagcctctcctcacattggatatgaaatcaggacatgtcacatatctattaataaaaaaattatttcatcaatatctcctttgtgctcagttgaaaccactgagattctggaatggaagtgactcgtgacccagtcctggagtgattctccctaccatacaagtggatggtggttggtatgagctatctctcttttaagctgtgtgttccctaccatcaagattactctactgaaaggctccctgaagaccagatgcttgtgggatgcacac

SEQ ID NO: 238 - DNA, 338 bp, Homo sapiens
  source 1..338: mol_type = other DNA
caaagtagaggcccaggacactgatgcggtccagggcacctgtgagatcccagggcttgttgcctggggctgactcaaatctctgcttcccatatttcagtgcagggctctttggccttcccagttgtgactcagctggtccaaggtgtggcttggcctactgctctggaagatgcaagccatacatctcggtagtatccacgcggtgccaactttgcaggctctcagagtgcaagaggtatggaggcatggatacatccatctagatttcaaaggatgtcttgtacagcttcaggacccaggcacagacttgccacaggggcagggccactgcagag

SEQ ID NO: 239 - DNA, 248 bp, Homo sapiens
  source 1..248: mol_type = other DNA
aataaaatacttcctgacttgatattgtatcattattacacattttactaaataacagtaaaatccgtgcataactcatggattctattatcttccacagattttttttttttatatttagcctccagaaagctgctgcaaatgtaaggtatattttgaacaccactttcatacattaaattctaaacattgaaacttgtgtgcatgacgttgaaaagagtgtaatgataaatgcttatacttatgat

SEQ ID NO: 240 - DNA, 292 bp, Homo sapiens
  source 1..292: mol_type = other DNA
aaatgaaaccatagcttgtatataagaccctttcttccccccattctcaaaccctcgcccagtggtaccattacaagttaactttggtttgattctgcaggtatataacagagtttgtaaacctaggcaatgtttcagctctacgcactttcagggtactgagggctttgaaaactatttcggtaatcccaggtaagatggtccggggttggtgttaggtgttgggatagggccctgacgtgacgtattgtactttttgttttgttgtggttttgttttttcctttggtgtt

SEQ ID NO: 241 - DNA, 270 bp, Homo sapiens
  source 1..270: mol_type = other DNA
agtaaaagagcttgtccctcttggaaagccaatggtgaatgagctgaggagggggcagcttgtgtggagtatgtgtatttatctgtattcttttccataggtaccattaaatttgtctggcttaatttaatggggacttctgggacctgcagagactgtaaagggcgagggtaaggctcttgtcgtctgttcaggctcctctccttccagtggaacttcctcactctctccctctcctgtcagcctctccccttttccaacttgtgtgta

SEQ ID NO: 242 - DNA, 292 bp, Homo sapiens
  source 1..292: mol_type = other DNA
aaaatagaagccccaaacgtagaaaataccttgactaaaggctcaggtaagtatcatagactctatctaaattctgaataattctgatttaattctacaggtatttaacagaatttgtaaacctaggcaatgtttcagctcttcgaactttcagagtattgagagctttgaaaactatttctgtaatcccaggtaagaagtaattggtgtgaagcattaggccactcataactccaactatttgggagttgttctttgttcgtttgtgtgtgtgtcgtcactgtgtgtataa

SEQ ID NO: 243 - DNA, 322 bp, Homo sapiens
  source 1..322: mol_type = other DNA
taactcagggtgcttgtagataccactgaaacatgtagcttatggttttaagctacatgtttttagctataatgttttttgttttgttttgttttttgagatggagtctcgctctgttgcccaggctggaatgtagcggtgcaatcttggctcactgcaacccctgcctcccagattcaagcgattctcaagcctcagccttccgagtagctgggattacaggtgcgccaccacgcccagcaaattttttgttttgttttgttttgttttgttttttagagacagagttttgctcttgtagctcaggctagagtacaatggc

SEQ ID NO: 244 - DNA, 251 bp, Homo sapiens
  source 1..251: mol_type = other DNA
gcccagactggtggcccaccgagtcctccagccccaaatgtctctgcctgtcaacaccttgcatcctccagccccacaagccattctaatctccttctaggaacagaactggcaaagaggcaagaggtcactgagggcctctgtcacccaggtgaggacctgagccaagcttcagctctgggtgtggcagaagcaggtggggccatgattgctttgggaggggcccagcagcgcccagcctgacccagatt

SEQ ID NO: 245 - DNA, 371 bp, Homo sapiens
  source 1..371: mol_type = other DNA
ctggaagaaacattagtgggtctggaatttgggataggggtggatataagggaaatacacagttatcaaaacccatgtctttgtgtctctctctttgcagagtcatcgcagccatttgcttttttagcacacggcttcagttgcttagagacgttaacagcatcattgaaatcaccattttaaaagctgtttgaggctgctctatgtgaattttttcaccattgctatttttaaagatgtatctgttctatctgtaaaaaagcttttcacggtatacatagatgataaaacatacttaaccttgtctctcttaatttatcatgacttttctgcctttacaaaaaggctcaaggaaacttaggaaaatcctg

SEQ ID NO: 246 - DNA, 270 bp, Homo sapiens
  source 1..270: mol_type = other DNA
gtagattatttactcttctttctacccataatgtgaaaaattcctgaaaaataacgaagaaagaatttttaaaatgacaaagatttgactacttttgtagactgaggggaagaagaaaagaggaaaaggctgaaaaaggaaggtgtcatttggagcaagataattaagaggttggtttttcacctggactcaagtcctgtttctaccacttcatagctgtgtgttcgtaatctccctgggcctaaattcttcatttctaaaatgggcata

SEQ ID NO: 247 - DNA, 286 bp, Homo sapiens
  source 1..286: mol_type = other DNA
ttgttctagtttataaagagcaaatgtatattcagcatagaacaaaagactctaaaatctggataatttttttttcacttcctttttgttcctatgaaagatagatgagctttttcaacttctgcgagcaaaaaccaaagtaaatctgggagtcaaaaaccaagttaaagtctaagaaactgtcaggtatcttgttcatgattttctaagtctgactagactttataccatctgatatccttgttagtatgggttctccaacttcaaatctgtatactgataatta

SEQ ID NO: 248 - DNA, 293 bp, Homo sapiens
  source 1..293: mol_type = other DNA
gtataccaatctttatccattgtcaaatactaacctttgttcagatatcaattattgctttttgttatcatcactttggattctttggatttgaaattaggattcttcatgactcattgaggtctcacaagcttctggagcataaaatgaagaggggatggttatagtcaacaaaatgtcgtatcaacaaggggtgagttgtaaagcatttatagatcacactagggctcagggtggctgtaagccaggaaccagatttccagaatttagtcaactctgccttccctctctac

SEQ ID NO: 249 - DNA, 316 bp, Homo sapiens
  source 1..316: mol_type = other DNA
cagaaactgacagggcaagagattacagttgggattttttgcaaagaggagctttcaagtttgtgacatctttttttttttttttttttttttgagatagtcttgctctgtcaccctagctggagtgcagtggcgtgatcttggtttactgcaacctctgcctcccaagttcaagcgattctcctgcctcagcttcccaagtagctgggactacaggtatgcgccaccacgcccaactagtttttgtatttttagtagagacggggtttcaccatgttggccaggctggtctcgaactcctgacctcaggtgatcc

SEQ ID NO: 250 - DNA, 293 bp, Homo sapiens
  source 1..293: mol_type = other DNA
tatctgattgcctctcctaatgttcttgcttctgcatactgtctggttgaccttcaaaccttctctttcccatgtgttttctgtttccttcctcattcagcggttttgttttagctggagtagtccagctcgggatggctagagaggactagttgagttgagagaggaaagcaggcacagccaggggcttcaggtaaatgatcgccttcatggactcctatttataaagtggctgccatgttaaaaagagcccatctgaagttaatgattcagtttgtaattcattttcaatg

SEQ ID NO: 251 - DNA, 280 bp, Homo sapiens
  source 1..280: mol_type = other DNA
cctacccatactcctctttgctctgactgctaggctccccccgcctgccatccccccaccaaggctcctgaccccatgaccccactctctcccactgcagctcctcatcaggtaattctcctggttccgctttggccacgggcggaggacacagggggaggtgactccggaccactgcaggttggtcgtgaagcccactccctccaacacctccggagcctctcccctctcactgctgccctccacacccagagaacctccacagactccagccctccga

SEQ ID NO: 252 - DNA, 609 bp, Homo sapiens
  source 1..609: mol_type = other DNA
cttcccagatacagattaaagacaagatgagattaatggttccttcacccttccctgagaggtctgcttagttctcttcctctgtttccttctatcttaggtaaaatgtacatttactgggcacttactgaagtctcacaagtacgtaaccactcacctcacagccaccctccctctttgaaggaccacatgtaattactaaacctcctgagaacctcttgggacagaaacaagcacagatgtgccgtgactcatgtttttcctgtgggcaccctcaggctggctcagtagccctcacttgcttgagatcctgaatctgcgggttggcgtctttcatggttgctggatcatactctgccgttatctcttcggatatgagttgcccctagcccactatctggcccctctctttagggacctctgattgaacatacattagaccttctctctcctgctgttcctgatcactcttctgtcctgtaattgctgcttcttgtgctgcattctgggtaatttcttctggtcttttttccagtttactaatattgtattctgttataaggtccttccattgagtgtttctttctttcttttttcccaaacagcaac

SEQ ID NO: 253 - DNA, 370 bp, Homo sapiens
  source 1..370: mol_type = other DNA
ggccccacctcccggcccccagcacccgccccttggtgggcccgggctgatttctgagctcacccacccatgggagctgagtgcttcctgcttcctgcaggcctggtcccgtgctactccacccagccccagaagctgagaagccatccctgagaggggggaaaagggccccaaatgcatcttctccgactcagcgggcagcgaggactcaccctgcagccgaacagtcccagctccctcccgtcctccccattcccgctcgccaagggggtaagaaaagatgctcttccgcttctcccaattggctcgagccgctgctcctcttggccgtggggtgaggtcagggcgggcaggagcgggtgggcagctc

SEQ ID NO: 254 - DNA, 313 bp, Homo sapiens
  source 1..313: mol_type = other DNA
agttgttgtagcaaggaacagatcatgtcctggcgtagctcagtgctctccggcaatgctctaagaagcattttcaatctaaaacgaagctttaacctagctccagggattccctgctcctggaaggaggaaatccacgacggctgggatgctctagcagatgaagccacaagcccctcctacctgagttgttctaccctgttaacagcacaggtaggagccattgggagagctggatttctccatcccattttgtaaaatgagaacggctcgtgagggattttcagtgactgggagccatggacatgagata

SEQ ID NO: 255 - DNA, 366 bp, Homo sapiens
  source 1..366: mol_type = other DNA
aaacgacgactttttttttagtttttgctcagctgatgaggcacccacttattgagctttttcacttttccaatttgcttcaaatgctgaacgaccgtagaatggtcgacgttgagctcttcgacaacttcttgggtaagttgtaataggatcagcttcgatgattgctctcaattggtcgttgtcaacttcccatggccggctactactcctcatcttcaagggtctcgcctgcttcgcaaaacttcttgaaccaccactgcactgtacgtttgtttgaagttcctggggcaaacgtgttgttgatgttgtgaattgtctccactgctttatgacccattttgaacctgagtaagaaaattgctc

SEQ ID NO: 256 - DNA, 223 bp, Homo sapiens
  source 1..223: mol_type = other DNA
cctattgaccccttacttcatttatcataatgtcttctaagttcatcaatgctatagtatgtttctgaatttctttctctctctctcaatttttttaaaggctacataatacgtcattgtattgtaagtaccacattttgtttttccattcatccatcagagaacatttgggttgttttccttttggccattctgaacagtgtttctataaacattgtatagt

SEQ ID NO: 257 - DNA, 356 bp, Homo sapiens
  source 1..356: mol_type = other DNA
tttgaatagaatgcccaagaggggcattatttaggaaacactgatcttggaaggacaaataagtaatcaaataaacttaagaatgttttctctcccttagtgaaaccttaaaatggaacagctcagaaagttccagtggaacaaacagcctcagagcagttagtggcagggcatgaggcgcccactacccgcccaatcacagcagggttagaactaacattgcatgcagtccgcccgagtgattggctgaacatctgtaagtgcttaatggctagacaaatagcagcccagagggagggggtcaaatggaagagacatcaataatacagatgtgggacattattttttctttgcaa

SEQ ID NO: 258 - DNA, 355 bp, Homo sapiens
  source 1..355: mol_type = other DNA
cactaaaattccataccgtgtcttagatttagtctgatggacttacatggtatttacaagacagaatcagttttgttctttgtttgttcctttgagacagggtctccctctgtgacccaggctagagtgcattgctgcaattttggctcactgcaacctccgcttcgtgggcgcaagtgattctcctgcctcctgcctcagtctcctaagtagctgggattacagacatgagccaccaacgcctggctaattttggtattttttgtagagttggggtttcaccatgttgcccaggctggtcctgaactcctcagctcaaagcaatccacccacctcaacctcccaaagaactggg

SEQ ID NO: 259 - DNA, 270 bp, Homo sapiens
  source 1..270: mol_type = other DNA
taaaatgtcacctttgatgcattgtgataactggaaatggtgttatggtttatttttcatattacatggattatacctatttttctctttgtcttgatagcatacttcttatcactttagtgatatggggacaaggaaaagacgtggaactatactgcttaatatctagggtaatgattttatggcagaaaagattgaaaataatagataaatatgtatattggggccctccaaggaaacagaaatgacaagatgtgcatatatatctta

SEQ ID NO: 260 - DNA, 374 bp, Homo sapiens
  source 1..374: mol_type = other DNA
cctgtaattccagcactttggaaggccgaggtgaggagatcacttgagcccaggtgttcaagaccagcctgctcaacacagtgaaaccccatctctacagaaaaatacaaaaattagctgggcatggtagcccatacctgtggtcccagctactcgggaggctggcatgggaggatggcttgagcctgggaggtggaggttgcggtgagctgagatggcaccactgtactccagcctggacaacagagcgagactgtcaaaaaaaaaaaaaaaggtgagtgcaggcaggcaggctgagggcattgccaaggactaaaaccagtagagcaacctctggccatgtcacccctgcagtacagctttatggcggtcat

SEQ ID NO: 261 - DNA, 291 bp, Homo sapiens
  source 1..291: mol_type = other DNA
gtaatctctacattaactacttgctatttatgcctgattatcacatagcacaatcataaaatatgcattttttgaattccaacatcattcattttttcagcaaacatgtactgaatgactgctgtgtgtcaggcactgggaatacaaagacactgagattggtccctcctgttgaggaactcacaacctaggtgaggagatagacaaataaacagcatatcttaagaaaagtgttttgaaaaatgtatgtatacattgctgcatgatcacataggagggtttcttaggaaa

SEQ ID NO: 262 - DNA, 300 bp, Homo sapiens
  source 1..300: mol_type = other DNA
ttgggtgtgcaaagtttacattttaaggacctctgctgctgccactgtcattgtggttaatgatggctttaaggtttattcttattcccatatctttgagagaggaagagagtgggattgctacccacattttaatgaaggtggagctgagccgtagaactctctgggagccatccaacctggctgtggctcataacaaggtattgatcacttcctttggcctgagtgagtccagggtgcctagacaagaggtagcagcctgtggatgtccagcacctttgcagggaatacagggcccaa

SEQ ID NO: 263 - DNA, 384 bp, Homo sapiens
  source 1..384: mol_type = other DNA
taacttacaacaataaaaataattgtaatgataacagctagtatttcttgagtgctttatagaaattaatgtgtcagatatcaagctaagtacattttagatttgttaacagatttcctgggttggttccaatctctgccatctactaccctgtggtcttggacaaattccttaactttgcacaagttacttgccttatttaaataaggtgataagaagaatgcctggcacatcacaagtactctatttgccactaaaattcactctcacaacacacctataaggtaggtaccattactgttccccttttatggtgagaaaaggaatatttagtgatgttaaataatctgctaaacattccataattagtaagtaggcaactga

SEQ ID NO: 264 - DNA, 331 bp, Homo sapiens
  source 1..331: mol_type = other DNA
ttcacacggctgtgcaaccactacttctaattccagaacgttcggtcaccccaaaagcaagccccattcccattgtgtcactctccatcccctccaccagctcctggccactctgaatccacttcctggctctggattggcttgtcctggatattgcatagaaatgggatcctgtcggccgggcgcggtgactcacgagagcaagagatccagaccatcctggccaacatggtgaaaccccatctctactaaaaatacaaaaattagctgggcgtggttgcgggcacctgtagtcccagcgactcaggggctgagtcaggagaaatcgctt

SEQ ID NO: 265 - DNA, 424 bp, Homo sapiens
  source 1..424: mol_type = other DNA
ctgcttctgggccctgttcaccctccgaactcccaccccagagggcagtgctgccctgcgcctcccccagccccaccctcgggggctccctggcttgcagggtctgtcagggttgtcctgctgcacttcctacgcatggcagcaggtggcactggccgtccgtccatctgcccagtggccttgggagaacggaaccgccctggccgtccagcccagccctgtctccctgccagccgcgcacaggctgtccccggcatgtcccaggagtggagtggcctctgtcagggagaccgcctgtgcgcggggtcccccttaggagcgtccaggtatcacccagggcctgacaacagaggctgggcaggcggggacggttggtggggtctcaggcctgtgcccagctgacaggctcctcgccggcttctcc

SEQ ID NO: 266 - DNA, 284 bp, Homo sapiens
  source 1..284: mol_type = other DNA
taacccgtttactagttgccattttggggctctttaatgtggggaaaaggtagattgtgattttattgcttttaaagctgctccattaatttttttctagtttttgtcaacactgtgaatttcatagaacatcagtttatgtcctgaaatatgttttcagaaaatagaaagccaagtatatttcgtaagtgtgctgaatgatttttgtttataattaagatttttgtatatgaatgtgaatacgaatacagatatctatatttttgtttgtgcttgcaaataca

SEQ ID NO: 267 - DNA, 276 bp, Homo sapiens
  source 1..276: mol_type = other DNA
ctgatgggcatttaggttgattccatgtctttgctgtggtgaatagtgctacaatgaacatacatgtgaatgtgtatttttttttttttttttgaaacagagtctcgctctttcatccatgctggagtgcagtggtatgatcttggctcactacaacctccacctcctgggttcaagtgagtcttctgcctcagccatatgagtatctggtactacaggcacgtgccaccatacctggccaatttttgtatttttagtagagatgggtttcaccat

SEQ ID NO: 268 - DNA, 258 bp, Homo sapiens
  source 1..258: mol_type = other DNA
attgagcataaaaatctgctaaagcatttcactgatatttgggttcatttctacaagtatgagcttcagtcttaataacagcaatctgcatttgtaacaggatagcagaaaggagctcatctgtttggagtccatttttgatggggatcccactagaggtgagaaaccttcgtagtttccatatcatgccaaaatcacgtactactccaaaagcatgtctactatccgtaaatatttactgacttgtccttagctgtg

SEQ ID NO: 269 - DNA, 105 bp, Homo sapiens
  source 1..105: mol_type = other DNA
ttaatgggttcaaagagggtccaactttataacatttatgctatatatttttattaactgttgaatgtttgactttgatattctttttctttttatatttaaaag

SEQ ID NO: 270 - DNA, 131 bp, Homo sapiens
  source 1..131: mol_type = other DNA
ttatatttaaaagggttggtatttctttattacaaagaactgcaaaagaggatatcgccttaccttacaaaataagatttaggtttgatttacaagcaccaccaaaaaacatttctgtaagtgaatatttt

SEQ ID NO: 271 - DNA, 111 bp, Homo sapiens
  source 1..111: mol_type = other DNA
gtaagtgaatattttataatagcaatagattcccaggagaaattgttgaaaccatctgtatatatctagaagaagatgctcatctctttgggattgtttagatcacatttt

SEQ ID NO: 272 - DNA, 157 bp, Homo sapiens
  source 1..157: mol_type = other DNA
ttctgttatgtaacccgtttactagttgccattttggggctctttaatgtggggaaaaggtagattgtgattttattgcttttaaagctgctccattaatttttttctagtttttgtcaacactgtgaatttcatagaacatcagtttatgtcctga

SEQ ID NO: 273 - DNA, 149 bp, Homo sapiens
  source 1..149: mol_type = other DNA
gtcctgaaatatgttttcagaaaatagaaagccaagtatatttcgtaagtgtgctgaatgatttttgtttataattaagatttttgtatatgaatgtgaatacgaatacagatatctatatttttgtttgtgcttgcaaatacagaaat

SEQ ID NO: 274 - DNA, 110 bp, Homo sapiens
  source 1..110: mol_type = other DNA
gtatttcagaatttcagaatggcctcaatgccttaataggaagaaatacttgaaatttttaaattagggcttggttttgtgaggagctagtaaaggtttttctctttcag

SEQ ID NO: 275 - DNA, 151 bp, Homo sapiens
  source 1..151: mol_type = other DNA
gagctagtaaaggtttttctctttcagctttagcttgtttctgcggaggattccgctctttctccatcagtttcatagccctggaattgtagaaaagctctggtttcaagaccattgatatccatttctgtcagggtgagttttaaattta

SEQ ID NO: 276 - DNA, 104 bp, Homo sapiens
  source 1..104: mol_type = other DNA
gtgagttttaaatttatttcatgatgcaaacaatatattgaacaacaggacatgaacttgttcttgttgtaagtggctgaattttatcagtaaagcacatcaaa

SEQ ID NO: 277 - DNA, 103 bp, Homo sapiens
  source 1..103: mol_type = other DNA
gacaaccatttcttgagttcttaaattatttttatttgacagaattataaattgaggtagacataggggttctctcttctggtgagatccttttttcttttag

SEQ ID NO: 278 - DNA, 125 bp, Homo sapiens
  source 1..125: mol_type = other DNA
ttttttcttttaggtccccaagaattcccatccctccatggtttaaataataggtaggttcttgtattataaaggaagctgtgaagaaaaggcactggcagtaacattacttgtaagtaagtttt

SEQ ID NO: 279 - DNA, 103 bp, Homo sapiens
  source 1..103: mol_type = other DNA
gtaagtaagtttttttttttctcagtaagaatctaatattttattttgtatatggcaagcatttttttcttaaattcaattgtaactggtacacaacaaaatg

SEQ ID NO: 280 - DNA, 103 bp, Homo sapiens
  source 1..103: mol_type = other DNA
tttcctacccatactcctctttgctctgactgctaggctccccccgcctgccatccccccaccaaggctcctgaccccatgaccccactctctcccactgcag

SEQ ID NO: 281 - DNA, 106 bp, Homo sapiens
  source 1..106: mol_type = other DNA
tctcccactgcagctcctcatcaggtaattctcctggttccgctttggccacgggcggaggacacagggggaggtgactccggaccactgcaggttggtcgtgaag

SEQ ID NO: 282 - DNA, 103 bp, Homo sapiens
  source 1..103: mol_type = other DNA
gttggtcgtgaagcccactccctccaacacctccggagcctctcccctctcactgctgccctccacacccagagaacctccacagactccagccctccgacac

SEQ ID NO: 283 - DNA, 103 bp, Homo sapiens
  source 1..103: mol_type = other DNA
cccagttgttgtagcaaggaacagatcatgtcctggcgtagctcagtgctctccggcaatgctctaagaagcattttcaatctaaaacgaagctttaacctag

SEQ ID NO: 284 - DNA, 105 bp, Homo sapiens
  source 1..105: mol_type = other DNA
agctttaacctagctccagggattccctgctcctggaaggaggaaatccacgacggctgggatgctctagcagatgaagccacaagcccctcctacctgagttgt

SEQ ID NO: 285 - DNA, 106 bp, Homo sapiens
  source 1..106: mol_type = other DNA
tcctacctgagttgttctaccctgttaacagcacaggtaggagccattgggagagctggatttctccatcccattttgtaaaatgagaacggctcgtgagggattt

SEQ ID NO: 286 - DNA, 81 bp, Homo sapiens
  source 1..81: mol_type = other DNA
ggctcgtgagggattttcagtgactgggagccatggacatgagataggatctgaggctttatctatattttgggtggttgg
